United States Patent 10,233,495 (METHODS AND COMPOSITIONS FOR SCREENING AND TREATING DEVELOPMENTAL DISORDERS) - sequence listing, part 139

SEQ ID NO: 687 - DNA, 1941651 bp, Homo sapiens
ttctcaagcacgacacagtaaattcagtgataatcaagatccatcaaggcaaatatttccctccagggatttagtaagcaattaagcaaaatcactgctttgagcacttatgtaatattagcgatttcttggtcctcttgacattatattcgtctttagcaattggttcagcaggtctcctaaatctcttctctcatggagcattcaaaattctgtcctagtagctaacgctaaaattaggtgacatcattggcaatactccctggacccccagactctgctgaggtatagaaacatggccaggttggtccttagtctggggtctttgggtcatgggatatgtttagggatagtgtgatttttgacacagaaagaaagaaaaatctgcagttgatttttcaatcgcaaggtagctgctaaaatagtgcatgtctacctgaataaaatttaaagatatactgaaagaaaaataataaaatagtaatatttagttaattttatatattcatttcccaatctactttcattggaattacatataaacataaataaattccttaagccaatattcgaaggttctattcattttcttttctaagaaatgtattgacataaataaaactgtgctatttagaaaaagtacttatggattcaattgatttggctctattcttcccaccagttttttttttaagaaggcagctcatttatgtggtgatgtagcagttcgtgtcacaagcaaattaaaataaaaaatgtccacttctagaaatttttcttttatggtctgagtcagccataaccacagaggatccatcttgtgcaatactgttttaaaaattcattcaattatatttggccaaatacaaaatattaacttgagttacattgagtatttaatagttagcaaaacttatatccattgatatcgaatgctctctgccaaacatgtatggtcttgttttcatttgccctccaaggttaaatgctttgttctaataaagtgttcaaacacagaataaatcaggtattagctgtcagttaaattagtggcaaaattgacaagcagtaattcttgaccagagtttgtatttgttcatcactggttcaaatgttttttatttctttctatattctgcacttatattcttgcccaaagacattttcctctcttggaaaatcataattagtttatttattttcaaaggttagaaacccacagaatcatgattaatgatgtggaaattaaatacatacaggtactgttgccttttgcaagacacttcatggttaatgagtgctggtttgtattctcttcattcagacagtaaagtcagctttaaatgcgtcagtgtggcgagttgatgacaattgctgagctgagtgagaggcatggtttggaaattctctttgttctttgcggctctgtcctgtgacactgccattatcctttcgagtggaggctgggataatgggccttagagagggtgacctggtatagcttgacctgcacaaatgtgtttgtctttattcacttgggccctttgacatgctcttctagatattatgatgttggtgttatattggaatggaaggatttgattactcagggatcaatagctactctggacattttttgaaacacgttgagcatgacaaacttgccatttttgccttcctccatttttagacacatgactctattaagggaaatttaatccgtatgtttctgattcccttacacttaactcatcaaaatgttgttttgtaagaacactttgaagtcagggaagccttttaagtcattttttatgagactttttcaagcctcttttcttaggaacaggaagtggcatttagccaacagttaacaaactcaaacaccaaaaggttgaagttgggtttgaatctctgaacccataagtgtttgaatggactcttgacatgagccatcctactgtgtattagtgccaacggccatcagaaccgtcttgattgctgagatgactccaggaccccaaccaaccgccaacttgtgtttccctaatcagtctacttcatgctgaattatgactcatttaactttaaaggaactactttattacccattctgctgagcatttttgtgacttctgtgagagctattgaatttggcactgtcccacagctagctagatataacttttgaatccagtcaccagtaaaatcacacaagagttcaagttcacaggacaagtgagtgttgattgaccatgaaggcttctacccacaaatacacagaaattatttcagcgactcagtttcctagtggagaagataacatggacgttttagaaaataaaatgcatgttaaaataacaaatgaggcatctggcttcagaagttttcgtttgatttatactcaacagttgttgtaagtaaaaactaagctccatttcccaggaaatttatagcttagacaagcaccagcgttgtcacggtggttcccactgcagaatgcactggaagtgatttcttcctgtaggttttcagaggatcctactaagtcctaattctgcaccttgcaaattatgcaacaataaatgccaaatagcaacagctgatctaggttaaaagatttaaagaagtttcaaaggtagcctaggagaaacagtgagaaataattctagaaacaagagagttccgataataaacactcaagtgaagagagctcaggcaggcagaatgctactcctctcctttagggcactgcaagtcagcgctctgtagacagcatttattatctaggtgaaaaagcctggggacgtggtacaggccacccctctacagatatatcaggattgcatagtggctgcatgcccaggggctctggagtcagactgcctggtggtttagagccagactgtatcactggatctgtgctcttggataaacgagacaaattataggacctgtttaattgggctgttgtgaggattaaagaggatgctacatgtgaaagtcctggtagagtcttgataaatattagcgtgatgaggatgtggttggctaggactagggaatagtataacaagggcgcaatcgctccggtgtaagttaaacactgggaattatgagcatctcatgttctttcatcttcctagaaatccgcagctatgtccaaggctttaagtgacagttgtttcttgatgactctcaaatcaatgtccttcctctagatctctctctgagcaaggcctacaaggccactaccagcctaaccttcagctcttctcactgaactactggccctttctgcagctggaatgttcgtttcatgctccgtaactttgcatgtgctgttcccgccgtcattagtacccctacttcttgtccatctggcacattgctgctcatccttccgtgctcaagcaccatgtcctctgcaaaagcctctgacttccttttgctgatttaagcgttcctctctttacgcgtttatggcactctctcgcatttccttatagctctcatgaagtgacactggaaatcgtgtgtgtgcctgtctccacactcccctgtgagcactgtcagggcaggggctgtgtcttgcatctttgggtgccagtcctaacacagcattttgcatagggaggacactcaatgcaattttggtgaaggaataaagtgtgtctagagaaacagcaggaaggttaggtgggctgaaaatgattttggttttatcagcaccacttttactatagtagactcgacgccgtgtctcatttcttcttgtgctcacatctagcaaatttgagtgtcctggaaatagttttcagggtgagttttatctttctctatgaaagatgtgcaacaatgctctatgaaggaaaggcgcacattgagtttctgatatgatctatagagtgtcatcacccagattccaagcagccccatcaggacagagcctcttcttgttagatcagtgcctgccatggaggagacacacagtatttgatgaatggttgcatgaaagccaagaataaacagtacctggataatgaaaatgaaagcaccactgctccacccacatcttgaggtatttgctttagttccctagagggatttttcagtccttagagtgactcaattgtgtttaacatcagtcctatcgaataccaacatcaagactatttttttcttctcattgctaatgatattgctacattgtcttcaccattgtgaaacttgctgagaaacttgtatataaccttcaaaacccaagtatgtgtgccctgcgaagactgcatgtcactagctatgagtgactgatgtgcgtgacaaggggtgccgaaagccgagcgatgccctgctgtgaagaaccgtgggctctggctggttacagagctgccgtgtgaacttcaaacccatctgaagccatcacaacctttattcttttacccagaactggtgaaaccattgtaatctttattcttttacctagccctggaaggtctagaagtcagtcacttgctgagagatgttgagatgctgttcctccatggatcttctgcaccagaaatacgacttaagacctctctgccacactctgcaatcattcctccttcctcatgcctggctaaggtggtcctcaggggtcattttcaaactgttggtcacaacctcttcattggtctgaaattaatctagtaggttgcaaacagcactcaaaaaggagatagactagaacagaccagtatattttacatagtaaggctaagtgttatttcatgaaagtttttttttggttttcaaaacacacctctctctctgtggtgtggtgtgtgtactgggtactgatagaaaatttatttcttactctgggttgcagtaaaagcagtttgaaagctcctaccttggaaactctgaagcagcctggggtttggatgtggatcagggagtcacaaccatgctgtaaagccaaacagctaacctgtgacactgctgggcacagactgaggtatgtctcgtggctgttaccgatgccaactctcaggattcatacaaatggaagacaagaatatcttaggtaatctacaaatccccaggtctgatttaactcacctttctcccttactttgagaaacatctgttgcatatctagcatgcgccgggcagttctagatgctgggaagatagtgtgaaagtcaatccttgccctccctcatggaacagaagatgcttcctacaaaaagtcttacaattctgagtaactaagttaactggtttattttattgcctccttttccccagcctgtcagtcttttctgataaaaaggctaataaacagaaaccagttaaatagcaaccagaggaaaagaacaggaaaaaaaatcgagtctgaataacacataattagccccttgatatttgaggcaataggggaaataataatgtcatatacatgattaacttctaaagttggctaaaaaaaataaaggaaaaaacaaaaaaccctcagttctatctatgagcccagcatgtccagagtattgtcggagtggctgttgtctttgggtatcctgaattttcttcctagaaaggaagaagaaggcccccatttagttttgttgcaggtttcaaattcttctctgggagaaaagctaatgcagcaagttattttttccctggctatttatttttccatttccagtcgctctatgctagattgtaacattcagggattggggagtacaatcgcttcagaataatcagtcataaacattccaggtttagttaactattaaggaaagcagcgtctttactttttaaagaggaaaaagaaagaacgtatgccacggcctgtaaaagactttcccatgttttgtttacattggaatttcaaaagctgacaatatctttccttccttcctgctccttgatgtagtgaaaggtcttccctgtaagtctgatcattttagttgaaagtgtttagactatctcgtgtactcaagtactcatcacgatagaattccaccgtgtaagggcttggtggcttctaagctcatattttctttctttcttttctctcaacaaactcaactatcattgtcatttaactttaggctccatcccacattcctgcaggaaatcttcttttaaacagaattatatactgcaggaatggagctgctcaattttcactgggttgcattttttatggttgttcctttacttcctggtagcatatttctgatgacacatccgtagcaacagtagttttatttataagcaaagggaagaagaaacatggactttggctaacctgggtgtacaaagaacacccagaatgtaattgtaattatgtccacttgtggtgatatggtccaaggtttatcaggatttccaaaggaatctgtgggaggaaatctaccagtgatcacagccataatgaaacaaactgatgtggaaatttctattctttaaaacctattttaaatttagtgtttacaaataggtataagttagcaagagtgctgaactcaggggacgatctaaatccactcaataattagttcaacaaacttaggctaggcacagtggctcacgcctgtagtcccagcactttgggaggccgaggagggtggatcacctgaggtcaggagctcgagaccagcctgaccaacatggagaaaccctgtctctactaaaaatataaaattatccgggcatggtggtgcacacctgtagtccaagctactcaggaggctgaggcaggaaaatcacttgaactcaggaggtggaggttggggtgagccgagatcatgccattgcactccagcctgggcaacaagagtgaaactccatctcagaataataataaaaaataaataaataaatgaataaataaatacagtcatgggacccaacattacagactttagtcattgacgttacagaattgagccactcatagacagggacatcacagagtttagaagaaacagagaagtgggaggggacagagtcagcagatgtgcctcaagcagagggttcgggggagtgtcggatgagaaagaagagctggaaaaaaatgttaagaaggagtagctggagatgttacaagaaaataaggggtgcttatcatcatagaagccaataagataatttgaaaaatatagcggttacaagagtcaaatgctaaacggttccgaatgcgtgagggttgggatcaggactggcgattagcaagttttatgtggcttttaagccattactttctgtagaaagagaagagcacagccagaggatagaattgaatgggaagtaaagatgaagtaaaatgagcgtagagtgtattttttctcgacaattattggtgtatggaagcatgtagataaatagttccctgaaaatatcgtttacaggggtgcttttatttctttggatgaggaaactacagtacattataggacaagtgaaaggagcaagtagagaaacagggtaatgatgactttagggaaagataaagaggggtctcaacagttcagaaggagcaagtctcggaaaagaagagggacagttgtgtctgtttcacttatgcattgtcatatgacaaatatcctcagaaacttggaggcatggccggacgctgtggttcatagtttataggtgcacagtgactataatcccagcactttgggaggccaaggcagggggattgcttgagcccacgagtttgagaccagtgtgggtaacatggcgaaacactgtctctacaaaaaaaaaaaaattagttggatatgggagcacatgcctgtagtcccagctgcttgaggggctgaggcaggaggattgtttgagcctgggagctctaggctgcagtgagctgtgttcacgccagtgcactctagcctgggtgacaaagtgagacctgtctcaaaacaaaacagaagccccacaaaacttagaggcttaaacaacaccattttattatttttcacagttctgtgtgttggctgcgctcccctgagatgtcttctctctgctctactcgtctcagctgagcacatctcgagtggcacagtttggagcagaggatctaaggtggttggtctgactccttgactgtgttagcttgggtggctgaaacgccgtggatgctctttcatcccgtagtgtgtctcttcccgtgtggcctttccagcagcatggcccagacctctcacatggtggttcaagtgagagaaggctgcagagtctcttaaggcctaggcactgagactcacgcatcatttctgccatattccaagatcaagtgaaggtactctgcaggtcacagggcagggcagattcaataagaaagagaactaggaaaagcacaaagatgtggccgcataacacattggggccagtttgcaaggatttgccacaatgcttctagaacaaaagagaaggagaaaggattagtgtagatttagaacacttctgaattaagaggaagcaattggagaaagttcaggctgaaaaccttcaattagcatagactgaaaaaagctcatctcttaaaggagaagtcataaaagagtttatatgaatcagagtgtgattcctttttttcttatacaatatgaaataaaaccactctgtaactcttgaataaatctgctgttagggaatgcagcatgctatgagcctgattttaaaagaaattttaatttttttgaataaaatattttaaaaatgcatatgtcacttgcctcttcatatttaatgcacttttagcaaaactcatgttatgaactgagaagggtctgatgttttactcaaattgcaagctaacaaattagtttgctatgattgctggaagaagacatgagacttctgtatcaaagacaaaggattttattattcatagcaatagtagtattcagaatataagcactcttgggccagttccccagccctaatccaccaaggcaatgagaaggtgaccaagtgacatctgaacatacagtgggttgtgttagaaaagaggaagttgaccttgggaaacctgaatcttttgtaattggcacttggcatgcttgctatttgctaggaaggaaatgtcatttttattatactgtacagcatgcatgtatatgtctcttgttgtggagggagatactatctttgtctttcaaggctgtaagcaattttatccattggtccagaaggagatcctatcactgtcttcccatgctatacaaggcctccttgaaaagacagctgagagcaaagatagctagtgcttctgtttgtaagacatgcagaaatgtgagagacccacgaattgtctccccaaaactaattttaaaatatgacttcagtgtgcaagaaatggtcaaaataaaaatctaaataaatttctaccataaagaaatatttcaaaaaaacaaatatttcatatgtaagaggtaatctcatatgtaatttcatatgtaatcttcagtacgtaagtacttaaaaatattctttattttaaaagtattgtatgtttacttatatattcaatgtaagatcaacaaatttttcatgtaggcagtgaaagtacaaacaaataggagtagtaagcagtttggaacactgatttcagtgttcagctccttgatcaagtatttggtgaaatcacaaccaccagggtgtgggtgcgcctgttgggcagcagtgacaaatggccttccctaggatggcctgtagatgtgtccttggctttgctatctggactattgcccatcccagcggcttccctgtacctcttatgaaacaacaggagcctgttaggctttggagtttatctagttttacaaatgttccagaaaatttgctccatcccaggataagctgtggacacataggtaggatcatgatgtggatttatgtttcagatttaccacagagtggtgtgttagaccatttatgctgctgcgacagagtaccacagaatggataatttataaagaaaaaagattgatttgctgtatggttctggaggctgggaagtccatggtcaagaggctgcatctggtgagggccttcttgctgcatcataacatggtggaaagcatcacatggcaagcgagggtgcaagacagagataggaaatcattcaaactcatccttttatcaggagctcacttctatggtaacagcattaatccactcagggggacaggagcctcatgacgtaatcacctcttaaaggtcccacctcttaataccatcacaatggcaattaaatttcaacatgagttttggagggggcattcaagccacagcagatagtattggtctgatgcagtcccaagtgtgatggaatctagagatctcttcaaagtaggagaggaagtttagagtgtccacagaatgcttttgcttcttggtaaagtttgagtacaatacatactaatcattgtgtagctgtcatatttttctaacaacttcaaagacaccaaatctaatttacctgtaagcagagagacacatcctattgtagatttaactttgctcaataggtccttatgagggaggagtgtccattctgtatcactggtgaataagtgagcatatgaagatgaaacgatccacaaggaaggcagggcatggaatggaatttattttattatattttttatttttttgagatggagtcttgctctgtcaccaggctggagtgcagtggcatgatctgggctcattgcaacctctgcatcctgggttcaagcaattctcctgcctcagcctcccaagcagctgggactacaggcatgtgctatcatgcctggctaatttttttgtatttttagtagagacaaggtttcaccatgttggccaggctggtctcgaactcctgacctcaagtaatcctcctgcctcagtctcccaaagtgctgagattgcaggtatgagccactgcacccggccaagaatggaattaagaatgttcagtttcttatttcagccttggaacactaatattaattgaatgtgttgttttctcctaaatttatgtttgtattttttcattggtttagttcagttggaagtgtaatttcacattaacgggggaactaaatcaattacatgtgttcttaatgttccagtagtgtctgcaacttggttaaacactgaagtggtttggaacacggcattagccaatatagccagaaagaaaaagggaagaaatcagtagaaaaaaatgcctatatcaatattaacttctttttcagcattcaatatgcttgactttttctcttatgacaccttaacctcctcctaaatgctagctgtctagacctacttcctatactcctattttcatattactttttgtgtttaaacatttacttcttcactatttatttcctttgcctttctatccactattttcttattctccctttttttcccttcatttaatagtttctgaaaactcatttttatcactgagtgttttttttttagccttttccagaggcagataattaccactagaatgatcaatggctttggagaaatgaattaaaacattagttccatggataaactcatacttaatgttaggagattttgatttccagataggggatttttttttttaatcatctagactactcttggctttccctgctaattcttaagtttgtgtacaatgtccaacctaaccgtgtaggctgattgttgaaaggaacactggtgaacagatccaaatctgtcacactccaggcaaatagcaatggtgacacaaaaatgagaaataggactgctgtggactatttgtgtcaccccaaattcatatttcgaaaccctaatccccaaggtgatggtattaggaggtggggcctttgtgagttgattatgtcatgaaggtgaagccctcatgaatggaattagcgtccttataagagacccctgggagatttctaactcctgccacatgagaacacagcgagaggacagctgtctatgatgcaagaagcaggccctcagcaggcactgtgtctgctgcaccttactcttagacttcccaacttccagaactatgagaaatgaaggctcgttgattataagccatgcagtctatgctattattgttatagcagcctgaatggattgagacaaaaaccctcctcaacagaactttaggctccttagccagtgttatggagctcttttaaaaagcatagaaatcactggcaaagagctcctggcattgagccacgtgacagttagcagaggctgctttctgcttggccagctgtgcaaggagacagagcagggggtcagcagagggagctgaaacagtaagactataagcagaggaagagtggcaggaaagaacaaaactcaattcaaatgttgccagcacacagtgaattgcagggaaccggctatcatgagagagggtcccaggagtacacacatcaaatgtggtttttgaaccagaggacctcctgactgctggtggcaggatgtctctattccatgtagttatcaatgtgttactcttttctttggttgaaaggattttgggtcaggcactgatctttctttgaatatatgtgcctgttggatgcctgaacagtgagaaatgcaggaacgtggtagttagtgatggttaggagagcaggggaaggcacaaaacctgaatgtcacaggaaattgtgcaagtataataaaagtaacagatagcatttattgcttgattgctatctgccaggctcagtgctaggatatggaaatatagagtcacgccaagtaactttggtccctgccctcaagcttagtctgatgcaaatccaccatgaaccagggaattgacaggcactgaaggtaaagccagtgcttcaagacgtcagacaagacaaaatgtcagaaaaacaaacaacagaggaattgctatgggaatcttgaaagaaaagctatttcttctgcagccaagaaggcttctttcaagtaggggtgcagatgtctctcagtggatgtgatataccgaggtcttgcagaatgaagcaagggagagacaaaggggtggggaaagtggccaacctggcgggagaggggagggcagctcaaaacccacccaccggccagacatttactttaggtcaacacctccagccccgtagaggcatactgtgcatgcaaacagacagtgagggtttgattctgaaaacacaaagaacaagtctggctgtaccacacctctccttaatcctcttcatttctcttctcatctcttatttcccgctcagatttgaggctcgtcgtgtctcaagagccatgcttggtgcctaagcagtaaccaagaaatatggactttgctattaaaacagatgttctttagagggtactagaggctgggaagaggaagggaaaagggagatagggagacattctttaaaggataaaaaattacagctagataggatgagtagtcctggtgttccgcaggtctgtaggatgactatagttaacaataatacatgatatgctttcaaatagctagaaggaggatattgaatgttcccaacacagagaaatgacaaatgtttgagaagataaatacactaattaccctgatctgatcactatacattgtatgtatcatcactatgtatcccatgaacattatgtgccaattaaaaaaataaaagaaaatatttttaaaaggggatgctctttgttaagaagagagatggaaatgaaagatgtcagtacagtgcatttaagtactactggaagatgtttaaagcatgacgggatccttgagatggaacgtctaattctaggggggtggattttaaggatgttcaaagagaaggtgacatttacgcagaattttgaaggacaactagtagtttgccaagtatatggttcctggggttcaagggtagctttggagagaggagaaagcattctaagcagataaatagcacatgtgcatgtaaacaagagtggaaatgcatcgggaacccaggacactgcgggactgtggtatggaaagggagagctacaggcagaaatcaggctgaaaggttggggagtgagagggtaataaaggctctgcttgttgcaatgtactcaaatttaggggcgcctgcccaagacatgcctttttacaggggctgcccatcattcacaaccttgctggagatgtgagccaagttaacatgcctgtctctggctgtccctggctagagctgattggacaagggttggttctgtgatcttggaggaatctaacaatagacttggctgaaacaagcgtaagacttgtcttccaaaatatgaactaaaggtctgattggtgtgtgatggatgtgtgagcagaggtaccgagagcaggggctgaagcagctcttctccacctcctgaagtacagctgagcaggtctgtagagagaagcacaggcactcagggaaagtggagacgaggccatgcgagtcatgagtggggcgttggtggtgcacttcctgctttgtgtgccataggatagctctgtagactttcataaataccccttttagggagactccatttgcgttctttgcaaacaaatgcactgctgtaaaatacatgccattctaaagagtttggattttatcctgtcagtatggggaatccatgaaaaatattaagcagggttaacatagattcattgtgttgtcttataaattaacttgactgcaacttgaagaatagttcagagaggagcaaaatcaggagaggaaaacgctaggaggccatgggaacaatctggacaaagcctgacacatccctcagctgaggagaggcctgggggaagagagagtctagatctaaggacatctagagagccccagctgaaggacttgtgaatgagtgttgccgaggctacaggttgggtgggtattggctcgcttgtgggactggcatattggtagacgtggtaaaactttagaaggaaagagatgtgcaagtgaaaaaaatgagattcatttcagagacattgaggcacatacaggatattcttatggagttataggctccaaggaaagttctgggctgccacatgcaaatgggcgttgaaacaatgggtgtgaaagtgattgcctgtgaggagcaagtggaatgtggaacacaaaagtctaaaacagagctgggaagaaggcattcctcaaggagcgggcagaaaaggctgagaaggggtgaattggagaacaaagccagcagagcagcatcagagaaaaaagtgtggtttcaaaagaaagagtcaaatggtgcagcacagtcaatgaatgtaagaggtggattaagacgtttcaaggccatgctggactctggcacaaggcgtgccaggctctaaggcgcaacagcccaggctggccagaggcactgggtttgggagccactgagcagaggtcacctgcggtggcggggcaggggggtgcggggggagccactgtccacagccttgatggccaggaaaggcttttagggatttgttaaacactgtacatattctcaagtctggggactttttaatttctttttttctttttcttttttttttgcagtaggctttttttttaactctgaattttaacaacctaactatctaagagatttaagaactgcagtttttccaggcttatgaaatgcaaaatgttaaacctcccactttgctaatgagagaatacaattactgtctaaccaaaataatttaatggctaagtgagataatttaaaggatctggaagagtcatgaatgcaaataagtgattttctgcaatgtttatctgcccctcccagctgaagtcactgagtataccagcagctgcagatcccactgagcagcgctgacgggatgggatggagcccaggccacctgctggcctgagatgcaaggttccctctggctgcgggtgagccttgggcacagggagtcagcctcctgcaggtggggcctgggcctgtctgatacccacagcctttagtgtctgtcttcagcgcgttttgctctcttttcctacctagactccaagattccttgccacctgtgctcctgccgccgttctccgccatctgataagcactctctgggccctgacactgacctgaactggaccagggttaagcccaagtcgccccgtccttctgggaaggctctgtggagtctcccacatttctctccagctgccttcacctctcccttgctccatggtcttgagggctcagccttccggcccccattcattaaagttcatgattttcaatcacaaagaaatggctactttaccagaaaaagcagtcagtttgcttaggtatttttccagagacaaaatggaagttaaatgaaagaaataaggtatcgcattccacctaagccagtgggtagctttacttgaaaaactgcccgaatgtccctgttttgtcgttgagtgaacagaggagcggatgtgagcatttttcagcagagatgtgctgctttgcagggaacaggcaatatggatgcatgtaaaattcttgcttgaggattaagagtccaaatgtgttttaagaactggctatgcaaaatctcagatataactgataaactgttgtaatctggttggcatatagtcctgtctgtaccacactttttctttccctaaaacacaatttggctttctacttgttgaacaaacagatatggcaaataaaagaaggacaaatgttattgatttttttttttcctgagaaagagtcctgctgtgtggcccaggctggagtgcagtggcgcgatctccgctcacagcaacctctgccttcagcattcaagtgattctcttgcctcagcctcccgagtagctgggattacaggcatgtgccacctcacccagccttatgaagcgatttttacatatgacattagagatatcaaaggggagtgtcttatggtaaaaaagctctacacgtttttaaaaacatgattccactggtatacatttttccaataaaactccaaaattgatcctatcctaggtataatcttatccttcttcacacctctcccatccttaaaaaaactctaagttaattggccttgggaacatttttggtttcaatatttacattaggattttgattttttaaaataattattgatcatttccagtttgaaaatgttaaaaaaaatttttgaacagtaacaaattttaagaggactttttatcccctaaagaaagccagtttatatagaactactgttatgccagtattttaaggtgccaggtatattttctgctctgatgaaatatttaggtaatttctagccagacgagatcaatagaacagggctgtacactttgtcgatattttgagattctttttattcccagaccacaaatggacagaggcagctttgctcttaagaagcgagtatttaaccactaaaaatagcttatagaatgtgaagtcaccaaaaagatatcttgagcatgggaaaaagagagccctgcgatctcccttctgtgataagaaaatttcaaagcacattagggactggaatctatcagacttccattccgtccccagaggtacttattttgggaatgcttacagatgataaaaacatgtttgtacactaactactcaatctccaggctaaatatacagtctacagactgtgttggtggctgcgaaggcatcgttttcctcgcagcaaagccagggctcgattgatggagaaatcagattaggaacctcattagcctttgaaatgcgtggctgtggggcgaggccagactgagggagattcagggaggccagtgagaaaaccaacagctgcaggaagcagtgttcatcaagtggagcacatcttgtgggggttggagtatttggaaagatctcagaagatatgctttccttttcctgtcaccaatgagatatgcctggaattgctcgttttgtatatcttagaatgggaaatgtccagcttacgaattattttgaggttaattgctcttaggagatgtttggctgttgctgcatttttgtagccttcctcttccaaattgacatcaccctttcctacgtagtgggtgagatcctattgtgtctagagatagagacagatcagggctgtctgtggctgggagtgatggcagtctccaaacagagaggggtttctctcgctccctgtcgtcccatctcaggccacaggtgggcagcggagcccagagttaagtgggaagccatgagtgggcagacattagctgtgccttcctctgcctcaggggtcaccatcaggattttcatcattgtactcgcttccctttcgtaccctaccacatccagactggacctgtgatgggagctgaggctccttctgggtctcagtgtgtctgaaacggtcctgtgttgggtgctgggatgatagaaccgacacccagtgagtcctagcagtggaaccacctgccctgctaatcagacaactggaaacaccattccaagtggtttggagagagctgtggctaagtattactgtctttttaaattcaaacgtcgtgttagtttgttttcagtcccctgtagttgtagccttctgaaaataagaggatagcttgttcaattattatggctctaaggagaattgttgtaggaggggaagaattccctgctgaagcctcttggcttacatgtattaatgctaactagtggccctttagggcatacataattgtaaatacagctatgtactgcttaacaagaatactctgagaaatgtgtcattaggtgattttgtcatgcaaacatcatagagtgcacttatacaaacttagatggcatagcctactacacacggaggctgtatggtacagcctgtagatcctgggttacaaacctctacggcacgttaccgtactgaatactgtaacacaatggtaagtatttgtgtatctaaatatatctaaacatagaaaaggtagagtaaaaatacagtatcatcatcttatgggaccaccatcctatgtcgatccattgctgaccaaaatgtcgttatgtggcgcgtgactgtataatcctgtttcacctgtaacagccgtgtgattttgtggctcatatctttatataaatagcaggttagtgcttactggctgtatgtccttgggcagtcacttaatgtttctgagccactgtgtccccacctgtgaatataggagtagcacaccattcaagagttttattagaaatcaagcaatgtgctattatgtttaccgtgtagcaggtatgcaagcagtatacacaattaattattattaattaaatctcaggtgctcctgtaatttactcctgttaatcattactagggaggcttccgtttccgtagttcccaatctttttaaaaattgattgctaatatttgtacatattcacatgggacgtgtgatatttggatacatgcatagaatgtgtaatgatcagggtatttaagataaccatctccctgagcatttatcatttctttatgttgaggatatttcatatcttctcttctagttattttgaaatgtacaataaattattgttaactatagtcaccctactgtgttactggacgctagaatgtatttcttctctctaactgtatgtttgtaccccttaaccagcctcccttcatctctcctgccaccccctttcccagcttcttgtgtcattccactctccacctccatgagatcatctttttttgctcccatatataagtaagaacatgtggtatttgtctttctgtgcctggcctatttctctgaacataatgacctccagttccacccatggtgctgaaaatgacaggatttcattctttattatggctgaataatatttaattgtgtatgtatactccattttctttatccacttgttcgttgatggatacttaggttgattccatgtctttgctattgtgaataatgcggcaataagcatgggggtgcaggtatctctctcttatactgatttcctttcctttggataaattacccactaatgaaattgctatattgtatcgtagttttactttcagtttttttttgagaaatctccattttacataatgactgtactaatttacaatcccaccaacagcatccttgccggtatctattttttggcttcctgttagtagccaatcttactggggcaagacaatcctcattgcggctttgatttgcattttcctggtgactagtgattttgagcattttttcatatacctgtttgtcatttgtatgtcttctttaaagaaatgtctgtttagatcccttgcccatttttagtgggattatttgttgttgttttgttgttgagtaatttgagtttcttgtatattttggatatcagacctttgtcagatgaatagtttgcatatattttcttccactcaagaggttgtgtcttcactctgttggtagtttcctttgttgtgcagaagtttagtttaacatagtttcgtttgtctattttttgtttcctgtacttttaaggtcttagccataaaatctttgcctaaatcaaggtccttgagtgtttctcctgtattttcttctagtagtttcatcctgttgggtcttatatttaagtttttaattcattttgagttgatttttgcatatggtgagagataggggtctagtttcattcttctgcatatgaatgtccagtttttccagcaccatttgttggacagaatgtcctttccccagcatatattcttgatgccttttttcaaaagtcagttggctataagtacatggatttagttctgggttctctattctgttccactggtctatgtgtctttttataccaataccatgctgttttgtttgcagtagccttatagcatattttgaagccaggcagggtgatgcttccagctttgttctttttgctcaggattgctttggctatttgggctcctttttgattccaaacaaattttaagactgttttttctattactgagaaaaatgtcattccagtctgtttatatcctctctcaggctacttcatacatgcctggatttgaatctcgaagcttgtggttcttaagttttttatgtcgaagaatcccctggattgtgtgttaaaatgcatacctcctggcactacctggagaggttctaaatgtaggtttttggtgaggcccagcactgcattgttaagaagcacctcaggtttttttgatccagacaggctgatcacaatttgaaaaataagacccaacatgtgaaattccctgaatacatgagcctttggtttctcatcatttgccacttacctgtcatttattgagcagccaactatgtgcaacatatttttctagggtatttacatacagtatttttttgtcttcataatagtctgatattataatgattagtgtcctggttttacattgaggaaactgaaactggaatgtcccagaaaactccttcactcacatgtctggcctggcctgagatggccgaaaatctgagggctgactagcattgctcattctttattttctgttaatcagtttatatacaacccctaagcaagataatattatgtgttctgaagttcatttatttgcactgctatataatattcattgatttaacataatacctcttgaagagtaaccaaggaccaagaacagtatatgccaagtcagagtttaatttttagagcagcaataccctggagtaagttcagtgagtctctctgaaagctccttccaaatacggtgagattgtaaaaggcacttttggattgactgtgataaggaattgagaagtcgctcttggcaaggatcatcattgcagcctaatgtcttctgcgtgggcattaaagctggcccagttctctacaaggtgtaggatgagtggtagaggctcaagcaggctcagagttaggcaacagtcaaatctgtttgcccatgaacatagctgggcaaaggttctttttaacacatgatcaaattatccattccctttgccaatggacatttgtgttgtttccatttttttttttttgctattaaaaataatgcagctataaacactttggacatgtctccttggagcacttggggatctctctcaagaaaatattcccaggagtggaatatttgggccaccgtgtacgtgggtcatcaagtttcttagataatgctaaattgtttctaaaaagacttgtgtgagtccacactcccaccagcagtatgtaagtaagacctgttgctgtccagtcccacaacagggtgctctttctggtggcagtgaatgaatggatcccttgtgagtcaatttgggatgtgataggagagttaaataaatgcaacattatagaatctgtacagaatcagcatcagggatcttcaggaaggaacttggcttatacatcattttttggtaccaaaatacctcatagaatgctgcaccccgtacattcatatttactgagttatgaaattctagcccatgaaattgcctttctacctggtttgtgtgtttttaaaaatccttaaaaggcttgcatgcattctgtcttctctgaaatacacataattccagtctgtcatataggatttttgtgtgggtttataataatgggtttaatggctaaaaagcataatgcaatgttcatataaataatgaagttggtatatcaaaataaaagtggagagatgctcaaaggctgagttaatgagagaagacaaacacaaaaatctttgactgtcttcaagtacagtaaaatttcagctgtgtcatcactgggggttttcctggatgcggaacagctgtgactgcttcgtgtagcaggtgctggacttcaccggtctctatagtggtagcaaatttgggtcaccgggaaaggcagttcttgctgttcctgtcactttctagccatctgaaaaaatgatacagtgttgttaggatcacagaaggatatggagaacacccaaagtccaaggggcattggccaataagaagacaaatgtgggatttgtcctctttgccactaaattaccagaaagaatgctgctcacgttgatcatgactcagagtcagcgcctcggtgcccgggaggagtctgtgaacttgtgtggtgattcggctctggccctgagggacaaatgtccgcttttgaaaaccaccagccactcagcagccctcacgacggaaccaatcagccactgcatgttcagcagtggagccgattgcaggaagacctctctgggagaataagaataggaccagccaaacttccctttagaaataaaattcagctcaatccaaaacagtcatattgcatttttattatgtccaccacagtgaactggggattgcgggggagacagagaaggaaggcatggctctggcttcaaagacctggtaatcagatgtgttcttcactgaaaaagggaagagaggcagaaagaaggaagccacgtttgctgtcaagccttcaccctaccttgcttgcaaaattataatttacaaatttaacattagtgactttcagaaaaagataggcagcagaaacataggaactggcactttcttagatgtatgttgccgatgaaagagggaaaagatgtagacaagaaatcctctcttaaaatggagagctggggaaaagtcgggtctctcctatcaaagagacaactacaagtgctgcttgcttctgtgtgtttgacaccgcagtcggtgaactgggccaatgtcagcccacagaaattggaacagcctgagtatatctggaagcaaatactccacagatggagagggaagtgggaggttagctcagaccacttgattttacttaaacagctttcaattttgtgaacttggaaaagaaaaggccagcagaactaataaagtccacgtgacatcaattctgtttctttaacacctagataaataacaagtgaagtccactgtcaccaaacatgggacctatgttgcaattccctttcctaaggagggtcgttttctgattgctgggcatgagtatgagtatttgagaggcatcagatcatagaaggaggccttaataattgtgggcatgtacgtgaagaaagggcagatgcagcagtgattatttcctgtttagagatgtttgtcaggacaccttcgagggtgggaacaagtttccacggttagcagaacagatggacggaagggcagctgagccctgcttccacagtggactccagagctcttgggtaacatttaggatgcagccatccagaaacatcgtgaggccaaatgtaggaagatgccaggacccaggtgtacccagcgttggggtgaactagtttgttgcttagaactaaatctaactcaggttctctttctgcagaaggctttacaagaccataagggagaagggagaaggagaggcagtctataattgcctctaccatcttcactcccacccctaaccttactcatgccagccttctcttcccacatcccatacttttcttattcagaattcattagccagaaaatatagtagcagccataactgacattttcatattgacatgtaatgtctaggtcaattctcagccaagtgtgattttacttcccagaggacatttattggtagctagagataactggggttgtcacaactgaggagggggatgctactggcatgtagtggggagaggccagccatgcagctaaatatcctacaaggcacaagacagccccaacatttaagaattattgggcccacaatgtcaatagtgtcatagttaagaaaccctggtctaaggccagacgcagtggctcatgcctgtaatcccagcactttgggaggccgaggcgggtggatcacctgaggtcaggagtttgagaccagcctgaccaacatggagcaaacccatctctactaaatatacaaaattagccgggcgtggtggcacatgactgtaatcacagctgctcaggagtctgaggcaggagaattgcttgaaccccagcggcggaggttgcggtgagccgagatcatgccattgcactccagcctgggcaacaagagcgaaactccatctagaaaaaagcaaaacaaaaccggaaaccctggtccaagataagatgtgaattttgctgagaaaaactggaaaggttgaatggagtcggatcaagttgtgatggtggatctaattttataaagttgattttagactttatttcattggccattaaatattagcaggcagttttagtgatgtttttgtcatcagtgctcttctaacagccctgatgatggatttcctttttataacatgttgcagatcacacttgtgaatcacatcttcattctgtcagttgctgactttgggggaaaggtgagatttcctacctaccttctaatctacattctcttgtttttcctaagtgggtaggatcttgttgtctaatgatcttttttgctcttgaggacatttacatacccagtgagaaacaacaacatactttgcatggccactggtttgatgttcattctcttttaatttatttgaatttaattaagataatcttatttagaactcaactattaacatggcgaatacattggttcagtcgtgtgaaccaacaaaaggtttttttattttttaatttatatatatatatatatatagttttttttattatactttaagttctagggtacatgtgcacaacgtgcaggtttgttacatatgtatacatgtgccatgttggtgtgctgcacccattaactcgtcatttacattaggtatttctcctagtgctatccctcccccctccccccaccccacaacaggccccggtgtgtgatgttccccttcctgtgtccaagtgttctcattgaatgggcaaaagccaacaaaagttttgatgtgaagcctgcagcatgctctccatctgattgtgtttatcttcctttctgatctctcggggtaactaactactgcttctggggcagatggcatgatggcttcttctgctgggctgtgctgcatgacttgagatatgacagaaatctggagatttagtgcagatgcccaaatattagttgacctcgaatataaaacactcttgatgagaagttcctgaagtttttttctttttttgggccatcttgaacatatgaatattgagatttagataaaataatcaatacagttaattaatttaatatttaataaatttagttgtatccataatttaaaattcctttattatctaagataacatttgaacagtatttttttcgacttctcactttggtaaaacaatttagtttggctcatgatgtgtggctctaaataggggatcttcatcatcaccagaactactttctgagctctctcctatgacatttttcccacgtcataatccattgatttttttgagaagtagttttttaaataatatatgtgatgtcattggaaattgtatcccatgctgtagctgcccattcacacaacattaaaaattactttttcattcatctttttacatgcctgtttgcaacattcacttacatgtgtgaggttaaatatctggaggaataatgattataatgattatatctgtttagcgaattctgaagggtgacttttataagcaacaatcaactagcaaagactgaggtcatttcaggatttgtctttcataagccatattttgttgttcataataaagtatctaagatggcatcctttaaggtaaatcattttgtaagatcacaaatggaagacaattactcttttctgaggtacatttttgtttcagatgaaaaactcccaccttaatgtttgaatatgcaaaatatgtaattgtatatttttctattttgattcattaatgttattatgagactttcacttggctttactctgataactcatttattacctgactataactaggatacactaagaaaaatcggatataatagttgaaaactgggctaataaaagattttaattctaagctcagttaagttttgctaaaataattcattgaaagctactaactggattcgccctagttcctgttccaatatctaaactatagaaaaggcttttatttatttcttaaataaaagattcctgaagaatgcccacacaagagaaaccacagagcccagattctccctttgtatgaactcatcctgaaaccacacatttactcccagagaggtaacaatatgtttctgcaatgatatgcaggttaaaaaaaagctttcaggacaaaaaaagaaatgaataaaaaatcaagccaaaacacatggattccaggtgtgcatccaagacagctttttgacagatgtaaatatttcctgagcaattttgctgatcttatgatgtgtatctcacagccatttccataaaaaaatgcaagtgagtcaggatgaaagagacttccacctggacttcaacgtctccagcatttactacctgggtgatcttgaacaagtcacagtttcttttcaattttccttatctctgaggacgcttctcaggctgactgccaacaaatatgtaggaaaacatactcagtacaaaacatctgcctggcacataaacattggttgaaactgattagtaaaagtataaaacttgctgatgacttagtgattattactgctgtcttcaattgccagtaatttatttctactatcttgatggtaaaggcgtgattttttttttttttgaggggctgcaatagtattctctatttataatttgggaaaaattacaaatgtttttgctttcaaaatctggaataacagaggccaggaattgataggccattttagatttttccaagtggagttcttcctggtccagttttcagtggatttggggataaataagtttccctccaggttgtggagtgctttatttcctggaactttttcacatgaagtcatcacttgttctttatttaggtgggcctacggccacatttgaatcagatcagtgtaaactttgactcgtgtactgagacttctggaaaagacagcacactagcttgggagtctgacccccttccttaaactcaacctgaaatgctacataagcaactgggagaatgactgctaacagaatcagtacagctcttgcggtagcagaaggtgttaggtgattttctgggagagagcagcccatacccgaagagaaccagctgtcactaatgaggggacactgtgggaaggagctttctagttgtcctaaggttttcatccttcgttgcctcagagggagcattgttttcccccatccctgcaggtggggaaacacagcatccccaggacggcacatgaggaagagggaggcgacatgcgagtgctgaggaggaaccccggacgccaccatttcacatggaaaaggcaggcaccatgcgagtgctggagaggaaccccggacgccaccatttcacatggaagaggcaggtgatatgcgagtgctgaggaggaaccctggacgccactatttcacatggaagaggcaggcgacatgagagtgctggagaggaaccccggacgccaccatttcacatgaagaggcaggcgacatgcgagtgctggagaggaaccatggacgccaccatttcacatggaagaggcaggcgacatgcgagtgctgaggaggaaccctggacgccaccatttcacatgaagaggcaggcgacatgggagtgctgaggaggaaccctggacgccaccatttcacatgaagaggcaggcgacatgcgagtgctgaggaggaaccccggacgccaccatttcacatgaagaggcaggcgacatgcgagtgctggagaggaaccccggacgccaccatttcacatggaagaggcaggcgacatgcgagtgctagagaggaaccccggacgccaccatttcacatgaagaggcaggcgacatgcgagtgctgaggaggaaccctggacgccaccatttcacatggaagaggcaggcgacatgcgagtgctggagaggaaccccggacgccaccatttcacatggaagaggcaggcgacatgcgagtgctggagaggaaccccggacgccactatttcacatgaagaggcaggcgacatgcgagtgctgaggaggaaccctggacgccaccatttcacatggaagaggcaggcgacatgcgagtgttgtggaggaaccctggacgccaccatttcacatgaagaggcaggcgacatgcgagtgctgaggaggagccccggaccgcaccatttcacatgaagaggcaggcgacatgcgagtgctgaagaggaactccggacgccaccatttcacatggaagaggcaggcgacatgcgagtgctggagaggaaccccggacgccaccatttcacatgaagaggcaggcgacatgcgagtgctggagaggaaccccggacgccaccatttcacatggaagaggcaggcgacatgcgagtgctggagaggaaccccggacgccaccatttcacatgaagaggcaggcgacatgcgagtgctggagaggaaccccggatgccaccatttcacatggaagaggcagtcgacatgcgagtgctggagaggaaccccggacaccaccatttcacatgaagaggcaggcgacatgcgagtgctgaggaggaaccctggacgccaccatttcacatggaagaggcaggcgacatgcgagtgctggagaggaaccccggacgccaccatttcacatggaagaggcaggcgacatgcgagtgctggagaggaaccccggaagccaccatttcacatggaagaggcaggcgacatgcgagtgctgaggaggaaccctggacgccaccatttcacatggaagaggcaggcgacatacgagtgctgtggaggaaccgcggacgccaccatttcacatgaagaggcaggcgacatgcgagtgctgaggaggaatcctggacgccaagatttcacatggaagaggcaggcgacatgcgagtgctggagaggaacccgggatgccaccatttcacatgaagaggcaggagacatgcgagtgctgaggaggaaccctggacgccaccatttcacatggaagaggcaggcgacatgcgagtgctgaggaggaaccccggacgccaccatttcacatgaagaggcaggcgacatgcgagtgccggagaggaaccccggacgccaccatttcacatggaagaggcaggcgacatgcgagtgctgaggaggaaccctggacgccactatttcacatggaagaggcaggcgacatgcgagtgctgaggaggaaccccggacgccaccatttcacatgaagaggcaggcgacatgcgagtgctggagaggaaccccggacgccaccatttcacatggaagaggcaggcgacatgcgagtgctggagaggaaccccggacgccaccatttcacatgaagaggcaggcgacatgggagtgctggagaggaaccccagacgccaccatttcacatgaagaggcaggcgacatgcgagtgccgtggaggaaccccggacaccaccatttcacatgaagaggcaggcgacatgcgagtgctgaggaggaaccccggacgccaccatttcacatgaagaggcaggcgacatgcgagtgctggagaggaaccccggacgccaccatttcacatggaagaggcaggcgacatgcgagtgctagagaggaaccccggacgccaccatttcacatgaagaggcaggcgacatgcgagtgctgaggaggaaccctggacgccaccatttcacatggaagaggcaggcgacatgcaagtgctggagaggaaccccggacgccaccattacacatggaagaggcaggcgacatgcgagtgctggagaggaaccccggacgccactatttcacatggaagaggcaggcgacatgcgagtgctgaggaggaaccctggacgccaccatttcacatggaagaggcaggcgacatgcgagtgccggagaggaaccccggacgccaccatttcacatggaagaggcaggcgacatgcgagtgctggagaggaaccccggacgccaccatttcacatggaagaggcaggcgacatgcgagtgctgaggaggaaccctggacgccactatttcacatggaagaggcaggcgacatgcgagtgctgaggaggaaccccggacgccaccatttcacatgaagaggcaggcgacatgcgagtgctggagaggaaccccggacgccaccatttcacatggaagaggcaggcgacatgcgagtgctggagaggaaccccggatgccaccatttcacatgaagaggcaggcgacatgggagtgctggagaggaaccccagacgccaccatttcacatgaagaggcaggcgacatgcgagtgctgaggaggaaccccggacgccaccatttcacatggaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctgaggaggaaccccggacgccaccatttcacatgaagaggcaggcgacatgcgagtgccggagaggaaccccggacgccaccatttcacatggaagaggcaggcgacatgcgagtgctggagaggaaccccggacgccaccatttcacatggaagaggcaggcgacatgcgagtgctgaggaggaaccctggacgccactatttcacatgaagaggcaggcgacatgcgagtgctgaggaggaaccctggacgccaccatttcacatggaagaggcaggcgacatgcgagtgctggagaggaaccccggacgccaccatttcacatggaagaggcaggcgacatgcgagtgctggagaggaaccccggacgccactatttcacatggaagaggcaggcgacatacgagtgctgaggaggaacccttgacgccactatttcacatggaagaggcaggcgacatgcgagtgctggagaggaaccatggacgccaccatttcacatggaagaggcaggcgacatgcgagtgctggagaggaaccccggacgccaccatttcacatgaagaggcaggcgacatgcgagtgctgaggaggaaccctggacgccaccatttcacaagaagaggcaggcgacatgcgagtgctgtggaggaaccccggacaccaccatttcacatgaagaggcaggcgacatacgagtgctgaggaggaaccccggacgccaccatttcacatgaagaggcaggcgacatgcgagtgctggagaggaaccccggacgccaccatttcacatggaagaggcaggcgacatgcgagtgctagagaggaaccccggacgccaccatttcacatgaagaggcaggcgacatgcgagtgctgaggaggaaccctggacgccaccatttcacatggaagaggcaggcgacatgcgagtgctggagaggaaccccggacgccaccatttcacatggaagaggcaggcgacatgcgactgctggagaggaaccccggacgccactatttcacatggaagaggcaggcgacatgcgagtgctgaggaggaaccctggacgccaccatttcacatggaagaggcaggcgacatgcgagtgctggagaggaaccctggacgcaaccatttcacatggaagaggcaggcgacatacgagtgctgaggaggaaccctggacgccactatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacatgagagtgctgaggaggaaccccggacgccaccatttcacatgaagaggcaggcgacatgcgagcgctggagaggaaccccggacgccactatttcacatggaagaggcaggcgacatgcgagtgctggagaggaaccccggacgccaccatttcacatgaagaggcaggcgacatgcaagtgctggagaggaaccccagatgccaccatttcacatgaagaggcaggcgacatgcgagtgctgaggaggaaccctggacgccaccatttcacatggaagaggcaggagacatgggagtgctgaggaggaaccctggacgccaccatttcacatgaagaggcaggcgacatgcgagtgctgaggaggaaccctggatgccaccatttcacatggaagaggcaggcgacatgcgagtgctgtggaggaaccccagacgccaccatttcacatgaagaggcaggcgacatgcgagtgctggagaggaaccccggacgccaccatttcacatggaagaggcaggcgacatgcgagtgctgaggaggaaccccggacaccaccatttcacatgaagaggcaggcgacgtgcgagtgctgaggaggaaccctggatgccaccatttcacatggaagaggcaggcgacatgcgagtgctgtggaggaaccccggacgccaccatttcacatgaagaggcaggcgacatgcgagtgctggagaggaaccccggacgccaccatttcacatggaagaggcaggcgacatgcgagtgccgaggaggaaccccggacaccaccatttcacatgaagaggcaggcgacatgcgagtgctggagaggaaccccggacaccaccatttcacatggaagaggcaggcgacatgcgagtgctggagaggaaccccggacgccaccatttcacatggaagagggaggtgacatgcgagtgctggagaggaaccccggacgccaccatttcacatggaagaggcaggcgacatgcgagtgctgaggaggaacccttgacgccactatttcacatggaagaggcaggcgacatgcgagtgctggagaggaaccccggacgccaccatttcacatgaagaggcaggcgacatgcgagtgctgaggaggaaccctggacgccactatttcacatggaagagtcaggcgacatgcgagtgctgaggaggaaccctggacgccaccatttcacatggaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctgaggaggaaccctgggcgccaccatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacatgcgagtgctgaggaggaaccctggacgccaccatttcacatgaagaggcaggcgacatgcgagtgctgaggaggaaccccggacgccaccatttcacatgaagaggcaggcgacatgcgagtgccggagaggaaccccggacgccaccatttcacatggaagaggcaggcgacatgcgagtgctggagacgaaccccggacgccaccatttcacatgaagagggaggcgacatgcgagtgctggagaggaaccccggacgccaccatttcacatgaagaggcaggcgacatgcgagtgctgaggaggaaccccggacgccaccatttcacatgaagaggcaggcgacatgcgagtgctggagaggaaccccagacgccaccatttcacatgaagaggcaggcgacatgcaagtgctgaggaggaaccctggacgccaccatttcacatggaagaggcaggcgacatgcgagtgctgaggaggaaccctggacgccaccatttcacatgaagaggcaggcgacatgcgagtgctgaggaggaaccctggacgccaccatttcacatgaagaggcaggcgacatgcgagtgctgaggaggaaccctggatgccaccatttcacatgaagaggcaggcgacatgcgagtgctggagaggaaccccggacgccaccatttcacatgaagaggcaggcgacatgcgagtgctgaggaggaaccccggactccaccatttcacatggaagaggcaggcgacatgcgagtgctgaggaggaaccccggacgccaccatttcacatgaagaggcaggcgacatgcgagtgccggagaggaaccccggacgccaccatttcacatggaagaggcaggcgacatgcgagtgctggagaggaaccccggacgccaccatttcacatggaagaggcaggcgacatgcgagtgctgaggaggaaccctggacgccactatttcacatggaagaggcaggcgacatgcgagtgctgaggaggaaccctggaccccaccatttcacatggaagaggcaggcgacatgcgagtgctggagaggaaccccggacgccaccatttcacatggaagatgcaggcgacatgcgagtgctgaggaggaacgcttgacgccactatttcacatggaagaggcaggcgacatgcgagtgctggagaggaaccccggacgccaccatttcacatgaagaggcaggcgacatgcgagtgctgaggaggaaccccggacgccaccatttcacatgaagaggcaggcgacatgcgagtgctggagaggaaccccagacgccaccatttcacatgaagaggcaggcgacatgcgagtgctgaggaggaaccctggacgccaccatttcacatggaagaggcaggcgacatgggagtgctggagaggaaccccagacgccaccatttcacatgaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctgaggaggaaccccgggcgccaccatttcacatggaagaggcaggcgacatgcgagtgctggagaggaaccccggatgccaccatttcacatggaagaggcaggcgacatgcgagtgctggagaggaaccccggacaccaccatttcacatgaagaggcaggcgacatgcgagtgctgaggaggaaccccggacgccaccatttcacatggaagaggcaggcgacatgcaagtgctggagaggaaccccggacgccaccatttcacatggaagaggcaggcgacatgcgagtgctggagaggaaccccggacgccaccatttcacatggaagaggcaggcgacatgcgagtgctgaggaggaaccctggacgccaccatttcacatggaagaggcaggcgacatgcgagtgctggagaggaaccctggacgccaccatttcacatggaagaggcaggagacatacgagtgctgaggaggaaccctggacgccactatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacatgagagtgctgaggaggaaccccggacgccaccatttcacatgaagaggcaggcgacatgcgagtgctggagaggaaccccggacgccactatttcacatggaagaggcaggcgacatgcgagtgctggagaggaaccccggacgccaccatttcacatgaagaggcaggcgacatgcaagtgctggagaggaaccccagacgccaccatttcacatgaagaggcaggcgacatgcgagtgctgaggaggaaccctggacgccaccatttcacatggaagaggcaggagacatgggagtgctgaggaggaaccctggacgccaccatttcacatgaagaggcaggcgacatgcgagtgctgaggaggaaccctggatgccaccatttcacatggaagaggcaggcgacatgcgagtgctgtggaggaaccgcggacgccaccatttcacatgaagaggcaggcgacatgcgagtgctggagaggaaccccggacgccaccatttcacatggaagaggcaggcgacatgcgagtgctgaggaggaaccccggacaccaccatttcacatgaagaggcaggcgacatgcgagtgctgaggaggaaccccggatgccaccatttcacatggaagaggcaggcgacatgcgagtgctgaggaggaaccccggacaccaccatttcacatgaagaggcaggcgacatgcgagtgctggagaggaaccccggacaccaccatttcacatgaagaggcaggcgacatgcgagtgctgaggaggaaccctggacgccaccatttcacctggaagaggcaggcgacatgcgagtgctggagaggaaccccggacgccaccatttcacatcgaagaggcaggcgacatgtgagtgctggagaggaaccccggacgccaccatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacatgcgagtgctggagaggaaccccggacgccaccatttcacatgaagaggcaggcgacatgcgagtgctgaggaggaatcctggacgccaacatttcacatggaagaggcaggcgacatgcgagtgctggagaggaacccgggatgccaccatttcacatgaagaggcaggcgacatgcgagtgctgaggaggaaccctggacgccaccatttcacatggaagaggcaggcgacatgtgagtgctgaggaggaaccccggacgccaccatttcacatgaagaggcaggcgacatgcgagtgccggagaggaaccccggacgccaccatttcacatggaagaggcaggcgacatgcgagtgctggagaggaaccccggacgccaccatttcacatggaagaggcaggcgacatgcgagtgctgaggaggaaccctggacgccactatttcacatggaagaggcaggcgacatgcgagtgctgaggaggaaccccggatgccaccatttcacatgaagaggcaggcgacatgcgagtgctggagaggaaccccggacgccaccatttcacatggaagaggcaggcgacatgcgagtgctggagaggaaccccggacgccaccatttcacatgaagaggcaggcgacatgggagtgctggagaggaaccccagacgccaccatttcacatgaagaggcaggcgacatgcgagtgctgaggaggaaccccggacgccaccatttcacatggaagaggcaggcgacatgcgagtgctggagaggaaccccggacgccaccatttcacatgaagaggcaggcgacatgcgagtgctgaggaggaaccctggacgccaccatttcacatgaagaggcaggcgacatgcgagtgctggagaggaaccccggacgccaccatttcacatgaagaggcaggcgacatgcgagtgctgaggaggaaccccggacgccaccatttcacatgaagaggcaggcgacatgcgagtgctggagaggaaccccagacgccaccatttcacatgaagaggcaggcgacatgcgagtgctgaggaggaaccctggacgccaccatttcacatggaagaggcaggcgacatgcgagtgctgaggaggaaccctggacgccaccatttcacatgaagaggcaggcgacatgcgagtgctgaggaggaaccctggacgccaccatttcacatgaagaggcaggcgacatgcgagtgctgaggaggaaccctggacaccaccatttcacatggaagaggcaggcgacatgcgagtgttgtggaggaaccccggacgccaccatttcacatgaagaggcaggcgacatgcgagtgctgaggaggaaccccggacgccaccatttcacatgaagaggcaggcgacatgcgagtgctggagaggaaccccagacgccaccatttcacatggaagagggaggtgacatgcgagtgctggagaggaaccccggacgccaccatttcacatggaagaggcaggcgacatgcgagtgctgaggaggaaccctggacgccaccatttcacatggaagaggcaggcgacatgcgagtgctggagaggaaccccggacaccaccatttcacatgaagaggcaggcgacatgcgagtgctgaggaggaaccccggacgccaccatttcacatggaagaggcaggcaacatgcgagtgctggagaggaacccggacgccaccatttcacatggaagaggcaggcgacatgcgagtgctggagaggaaccccggacgccaccatttcacatggaagaggcaggcgacatgcgagtgctgaggaggaaccctggacgccaccatttcacatggaagaggcaggcgacatacgagtgctgtggaggaaccccggacgccaccatttcacatgaagaggcaggcgacatgcgagtgctgaggaggaaccctggacgccaccatttcacatggaagaggcaggcgacatgcgagtgctggagtggaaccccggacgccaccatttcacatggaagaggcaggcgacatgcgagtgctgaggaggaacccttgacgccactatttcacatggaagaggcaggcgacatgcgagtgctggagaggaaccctggacgccaccatttcacatgaagaggcaggcgacatgcgagtgctgaggaggaaccccggacgccaccatttcacatgaagaggcaggcgacatgcgagtgctggagaggaaccccagacgccaccatttcacatgaagaggcaggcgacatgcgagtgctgaggaggaaccctggacgccaccatttcacatggaagaggcaggcgacgtgcgagtgctgaggaggaaccctggacgccaccatttcacatgaagaggcaggcgacatgcgagtgctgaggaggaaccctggacgccaccatttcacatggaagaggcaggcgacatgcgagtgctgaggaggaaccctggacgccaccatttcacatggaagaggcaggcgacatgcgagtgttgtggaggaaccccggacgccaccatttcacatgaagaggcaggcgacatgcgagtggtgaggaggaaccccggaccgcaccatttcacatgaagtggcaggcgacatgcgagtgctgaagaggaaccccggacgccaccatttcacatggaagagggaggcgacatgcgagtgctggagaggaaccccggacgccaccatttcacatgaagaggcaggcgacatgcgagtgctggagaggaaccccggacgccaccatttcacatggaagaggcaggcgacatgcgagtgctggagaggaaccccggacgccaccatttcacatggaagaggcaggcgacatgcgagtgttggagaggaaccccggacgccaccatttcacatgaagaggcaggcgacatgcgagtgctgaggaggaaccctggacgccaccatttcacatggaagaggcaggcgacgtgcgagtgctgaggaggaaccctggacgccaccatttcacatgaagaggcaggcgacatgcgattgctgaggaggaaccctggatgccaccatttcacatggaagtggcaggtgacatgcgagtgctggagaggaaccctggacgccaccatttcacatggaagaggcaggcgacatgcgagtgctggagaggaaccctggacgccaccatttcacatggaagaggcaggcgacatgcaagtgctgaggaggaacccttgacgccactatttcacatggaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctgaggaggaaccctgggcgccaccatttcacatggaagaggcaggcgacatgcgagtgctggagaggaaccccggacgccaccatttcacatgaagaggcaggcgacatgcgagtgctgaggaggaaccccggacgccaccatttcacatggaagaggcaggcgacatgggagtgctggagaggaaccccggacgccaccatttcacatggaagaggcaggcgacatgcgagtgctggagaggaaccccggacgccaccatttcacatggaagaggcaggcgacatgcgagtgctgaggaggaaccctggacgccaccatttcacatggaagaggcaggcgacatacgagtgctgtggaggaaccctggacgccaccatttcacatgaagaggcaggcaacatgcgagtgctgaggaggaaccctggacgccaccatttctcatggaagaggcaggcgacatgcgagtgctggagaggaaccccggacgccaccatttcacatggaagaggcaggcgacatgcgagtgctgaggaggaacccttgacgccactatttcacatggaagaggcaggcgacatgcgagtgctggagaggaaccccggacgccaccatttcacatgaagaggcaggcgacatgcgagtgctgaggaggaaccccggacgccaccatttcacatggaagaggcaggcgacatgcgagtgttgtggaggaaccctggacgccaccatttcacatgaagaggcaggcgacatgcgagtgctgaggaggagccccggaccgcaccatttcacatgaagaggcaggcgacatgcgagtgctgaagaggaactccggacgccaccatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacgtgcgagtgctgaggaggaaccctggacgccaccatttcacatgaagaggcaggcgacatgcgattgctgaggaggaaccctggatgccaccatttcacatggaagtggcaggtgacatgcgagtgctggagaggaaccctggacgccaccatttcacatggaagaggcaggcgacatgcgagtgctgtagaggaaccccggacgccaccatttcacatgaagaggcaggcgacatgcgtgtgctgaggaggaaccctggacgccaccatttcacatggaagaggcaggcgacatgcgagtgctgtggaggaaccccggacgccaccatttcacatgggaaggccggcttcctctttgctaatgaatgagataattacaacagaatcaagccaaccccagaaagcgcagcgcctgagcagaagaaatgggaagttcactgggtggcagtgttgggaactgaggtagaaatagagcattccaggtttgcaataatacaggttatttccttacgtcatttccgtatatcctaaaaagaggagcaggagggcacatactaggtctaagcttccatctctactcctaaaggaatactactagctgaggtagtccatactcccagcagaatttgagctcataggaagagagaaaaaaatatatctgaggaggagtactagccctttaaaagaaaaatagatactgaagaatcttatcagagagagctgaattaatggtccagataaaacaagaactggaaataaaataaatatcttcagagagcaggaaaggatattgcaaatatgaagcaggaacaatcagtgaagacaaagaatcaaatgaggatgggaataaaacatataatagcaaaatgtatatagacaaagaataaatcagtaagataaagaatctggttggaaaattttccccaagtttaaataaaggcataaaagatggaaaatatctaagaactaaaataaagagaaactaaaagtggaaaggtcaattttgatttactacataaaactaaatagagtatagaattgttttcattgttgttgagatataattgagaattaaagaaagatagaaagtcagatcaaaatggctccataaaacaacagaccacattgataagcaaaacctcaaatcttgacacattacacttaatttaaaataacaaaggcaaaattctaaaagcatctgaataagaaataatatttcattgtaaattaagataattagcatcaaatttttgaatggtaacactagaatattaaagtgacatttgaaaaatattgaagaaaaataaacttagacctagagttttatatacagataaactattatttaaacactaggttgaataaaataaaggcatttcaagagacacatagaaggcgagggcacataaaatcttacagaaaacattctacagggagtacttctacagagaaaacaaataattccaaaaagaaagtttaaggtcaaccaaataagcaatggcaaaaaagaaatattgtgtgtgattatttgtatatgtgtataagagtgtcgtccaatgggcctttctgttttgatggagatattctatttgtactgttcaatatgatagaccatagccatgtgtggctgttggatgaaaagtatggctagtgtggccaaggaactgagttttaaattttatttaaccttaataaatttaaatttgaatagccatgtgtggttagtggctactacattgtacagcagagccctgtactaacacagatgaaatgttccagattataccaatatatgctgagggtcaggaacatgcagaaatcagaggatttggacagtatgttcaggttcttgtcttttacacagggaagaaataataatgagctctaaaaaattaagtctgaaatttaaggtattagcagaaaccaactgaaagatagacgttaaaatttggctttcaaaacagaagaaaaaaaattgctctcttcaataaaatgcaagaatggagaaaaaataaacaagaagaaaggttgatacatagaaaatatgcaataggatgacaagaataaatcatagtatgacagtaatttaagtaaatgtaaataggttaaacatgcacatcaaatcacagagactctcaggaaataagatgctgtaatacattgtctattagagatatttgaaacaaaagaaaacagctagttgaaaatacatgagacatccatttttattatcaattttaataacaaagaaattataagttgttaaactatgtaagtaaaagatatgaataccatatatgtgtatatatacacatacatatgaagaaaggagatgctgggcgcagtggctcatgcctgtaatcccaacactttgggagaacaagatgggcagatcacgaggtcaggagatggagaacatcctggctaacacagtgaaaccccatctctactaaaaaatacaaaaagttagccaggcgtgttagcgggcgcctgtagtcccagctactcaggaggttgaggcaggagaatggcgtgaacccaggaggcggagcttgcagagatagcgccactgcactccagcctgggcgacagagcaagactccgtctcaaaacaaacaaacaaacaaacgaacaaaaacaagaaagaggaaataaaaaagaaaatgaaatgtatacatccacctctatgatgaagacagatacattctgagaaaaaggtgcataaatcaacaattgcagttggagttttggacacactttcaagaagaaaaactgatccaaaagacaaaaaataaaaagaggaaggatttagacggtttgaaaaaaactctctgattgataagctcaaacccataaatgcatatagattttcacactccaaaacctagaatacacctgcacatagtaaatatttataaagcctcaaattttatgaaatcaaaagcataaaacatcagagatcaataaacaaaaagttacttttaaaggatctgcaggtgaccttgaataacacagggatcaatgtatgatcaaagtatatcatgaacaacagaatggctaaaaattggagaacttagataaaattgatgaatttctggagttatatataataccaaaattgttacaggattaagcaaaaaccttgaatgagacaatcatcagggaaataattaaaagttaatcaaagacttctcccctaaaacagcttcaacaccagatggttttaaatgtgagttctacctaactttagaggaacagataatcttgatcttatacaagagaactcttccaaatgcaattaaatctaataatgtgtgaaaattcgtaataacgaatatattttttccaaggaatataatggtattttaataacagatattctattaaagtaacaatcatactcattgggaaagctgtaattacttagtttagtttagtttacttatgggccaagtaaataacaacaaaaatctggccacatctccattaaggccttggaatcatcaatccacataattaaaatggaaaagttgtgtcatgagtcacgacagatactacaaattcactcacttaaaaatgggaaaaggaaagaaagatgtaccctattactacaaatgcttaacataacattggaggtatttgttaatgcaagatagtaagaaaaaaataagatgcctaaggatcagaagggtcgcaaaaacagtcttatttatttacatgtaataggaccctctaaatagaaaaccaagtaaaatcaaaagaaaatttagtaatgataaaactgaggaaagttgtttaatacaggacagacatctaaaatcaataccattggtttattatattttcaaagttgaaaatataatttatgttttatataaatatataattgtgaataatgtcttaattttcaactttgaaaatataataaaaataagacattattcttagtgacaacatttctaaaatttctcaggaattattgtaacaaataatccaatcattcctacaatttagagattggaaaagggactagggtaaatctagttagtagattttcaaagaattattttagcaaaatttaactgagcttagaacttacaataatattttcctaaaccaattttcaacaataattctagatttttctcagtgtatccaagttatagtcagttaacatatgagttacttagagtacagcccaagtttaactttcataataacacctaattagtgccaaatcgcacagataatgtggtaggcagcctctgaaatggtttcccactgaaccctcctcgctgtatttactacttcccgaaatcctctccttttgaccatgggctggacctagtgcctaatgcatagaatatgacaaaggggataagatgtcatttccaagatgaggttacaaagagtttgtgctttccatcttgctgtcattctctcttacccacttgctagcttccttggtggcaattcaatggccttgctatgagctgtgctgtggagagacccacatggcaaggaaatgaaggaggccagtagccagtgggcaactgaatcctgcaaccatgtaagtgagtttgaaaacatcttccccaagtcaagtcttcagaggagactgcagcccctgctgacaccttgattatagccttggcagaggctttaggcagacactcagctaagccacgatctggattcctgactcacggagataatgcttactcttttgagcttctaacttttgatgtaatttgttatatagcaatagataactaatataggcaagtatctgaaataaagtagacaactagctaaagaggaatgttggtgattatgtgcctcaaaatgagaactatgattaacgtagcttacttatgggccaagtaaataacgacaaatacaagccaaaaatctggccacatttccattaagaccttggtatcatcaatccacataatcaaaatggaaaaagttgtgtcatgaggcatgacagatacttcagattcactcacttaaaactcattttagctcattcatccttgttttcctgtacatggttctggaaagcaaatgcttgaatttccagtctgcctttcagctaactgtgatcatggacacaggtctggattagaaaatgaaagcagaagttcccaaggagagtttcattttcatattaaaaatgaattctccagaaaaggcattttactttcaccccctgcacattctttctgcttgcaatgtgaaagtgatatttagaaatgcaggacatcttgcagtcatgagcacagaggggaaagctgtctgctaagaatggcaccatgggaagctgggagcatcctgcgctcctggtggcattgtgcggtgaaggactagtctacactcttgttagtgttggggatttctgctgttcacagctgagtatttcctaactgaaaccagtagaataattttgatttttgtatctaaactttgtgggagagcataaattccatcagattacctcagttaataatgagtaaaatgggcagggcgcggtggctcacgcctgtaatcccagcactctgggaggcagaggcaggcagatcacttgagatcaggagttcgagaccagcctgaccaacatagcgaaaccccatcgctgctaaaaatacaaaattagctgggcgtggtggcgcatacctgcaatcccagctactaggatggctgaggcaggagaatcgcttgaacgtgggaggcagaggttgcagtgagccgagatggcaccattgcactccagcctgggcaacaagagcgaaagtccgtctcaaaaaaaaaaaaaaaaaaaaggtaaaatgaagagaatttcaagaaggtccatttcaggcactatttttgttttagcagaaatttaatgaaataaaaaagtgatgagaaattaatcaagagtattcaagacctaagttttcctttggtgttggtttacttgtggaagatcccgtgaatctggactgaattatacctgattccagtaagtttcaaactcaacccagctcaatccaggcatgtaatatctcaaaagggctctcttttattagtgtttaaggtcaaggatttttccagggttattaagtggaatttctgtgacaacttgaaatctggtattagaatgggactgatctatgcagtacggtgagtccagctgtattttacttcttacacttggtttctgagaaatttaagtacgttttaaatttagggcaccattcagcatcatctaggaaataccacactaatggtgtgagagtttactaaattttcctcttttactcagggtacttggtagctagcaatagaaaccaactttggctggtttaatcataaatagattttattgaaaggattttgggtaatttacagaattgccagaagagctgaagaatcagacatggaaaataggcaggctctataggaggcaatgcatggtgaccacagccaaacttccatcggggacagtctggcggggtctttcttgtgtcctggaatgatgacggccagtgcaggtcctgaagaatgcagctgccgtggacccagtcagcacctctggtcaactgccctggaatgagaaagcatcctcactgcctctagaatgcaattctcctctaaccctacttctttgctgaattgctccacattcaaagatgtgggcatcagtgtctgcctgaatctagtaatgaaattaaagtttaaagcaatgagaggtagacaaaactgggtacttattacgttccaaatactttccaatttattcccatatctctggaatacatgttttttaaaaggggtgatgtaagaatggggaaagcaaaataattaagaaaaaattatgaaaataactggttgatggaataattgaacggaataaatggaataatgaaaggatgtcaaagaccttcgtgcattacgtgtatatagctctgaagtgtgtgtatataactctgatggatgtgttgagatttggctctgagtgagggactcttgcaggaaaaagaaataaacatgcacgttaacttgctcttctaccctgtcttaggcaattcatccagatgaatttttaactatcccgtagtgatggggcatccaggccgtattttttaaaatgtgcaattagagtaaacaatttagaatcctgtgctcaccttacactaataactttgcatcaaaatttatgcagtttagtgtgtttggcaaatgacttgtgcctttagtttcacttcctcgcggcattttcccttccgtttggttaattatgatttacttctgttagtttccaagaccccatttcaccgagttcacatggtgttgtgagtaataacttgactgttgtaattgtcttccgggattaatcctgtttgtgttggagggttacaagcattctcaccagaggggatgctttggaagttttgcattattcatgtgtaaggcaaattcacgaatgttaagagttggaaaacaatgaaaaccaaaaatttggtctaaaatcctttttggagaactgaggaagacagatggtctggaagatttttagtgtcagatctgaactctaatcagtcaaggagagaaactttcagaactgggtggtcaaaatggcatcctaggaattttgacttgcagtcttaaagaagacagcctaaaagaaaaggaaaaaacgttctcaccctagagcatttttatgcaaaacgatgaaatttataggaaaattggaaacagtcaatttctgagaattatatacagacggtgaactaactgtggcataatcattatttgtgttgatactattaaacgttttgggggaatctggtttacttgattaaaaccaggattctttcttttccccaatgagcagattatttcctgcggatatatgttcctgcagtcttcgttcattgcactgataacaagtgtaatttctttattgtctgtttctctagtttgtaagtttcagacaggggagttaggtctaccttcttcttcttgttcccctcttccagcacatatgtacgtggcacatagtaaatctttcattatttgttgatcagttgcctaacaggagcatggaagtaaatgaattatatttggaacatttcatcctgaagatacccacccagaggagaaggcagggtaaaattctagtcagctcagtcttagttcttgactcttcaaaactcttgttagttttgactcagttccaagattctgcatctggtttgtgattgtcctctgcaaatccttggaaaggaccaatcctcgtgtagaatagactttccataaatatttattatgtggattttgctcattgttgactgatctgggggtcttggctgcaatcttttcaaaagagtttggtgtgaatctagttgactggaatctggggttaccctgggcagacgttaagcctataattggttttaacagaaatatatatagcatatatatggcatatatatgtatatatagctatatatatatatatagcatatatatggcatgtatatagtatatatatatagcatatatatggcatatatgtgtgtgtatatatatatatagctatatatacatatatatgtatatatagcatatatatgtatatatagctatatatacatatatgtgtatatatagcatatatatgtatatatagctatatatgtgtatatacagcatatatatgtatatatacgtatatatacagctatatatatatatagctggcatccctagacgtggcacagtctgtctgaaactagagcaaagttccctcctctggctaccctaggatgacatagtctttcaaagtaggaatatgacagtattatataaatataacatatttattagcagtaaggactgtaacttttctatattgcctacaaagttcaattgagtgattattcccacggatctagagatatttttaaggtattatataacaatattgttattagctctgactatgccattatttttctagcttctaggcttctgtgtttactgttttgtctgaaatatttttctcctcttcacctcaactcttccccatccccacccccataaaaaaaccctgagttacattcgtctgctctaggttcccatcctataaaccaccatttacttcctcgtcattatgttttgcacacacgtattgctgcctgtctgatttcctgcctcccttcctaggccatgcataaactgtgtgagggcgtgtactacacctgtcctttgttccgagtactggtgccatttctgccatatagttgacaacatctctttattggatgaaaaatgaatgagtgcgtgaacatgtggcctaaacagagaatgtttccgtgtgaagtttctgtaccagccaactatcttcttaacagcttggtagagttgggaaaggggcaataggagaaatgctgtccctgtttcagcttctgggccagaccctacgactgaccccatttctgcaatggccccatcacccgtgctgtgggtttgtgtcatatacacaagccttgtgaaaataccacagaccactgtgaggccattcaacaaagaacagatggatttcaccttgagtgttgttttccaaagcacacgtgtttcggtgccaccacgtttcccttgcccatcatgtgagcctcctccctccatcgtgctcctctttctgcttccatcacatcaggggccctgaaggcgacagcactgattccgtcctctttgcctgcccagcacctggtcacagatttggatggaggacaaataaagcataatagtgttctaagagcctttcccctagcttggcagtcagcttctgacaaggtcatcaggtagggtggggaggagggtgcaggggcaaaggagaagctcaccccttgcctttggagggtttgttgaaaaaaaacatcaactcgcagtaaggcaaattaagaagaggaaaggcatacaaattcattcaccatgtgcttggggagaatcacagagtgattccctaatttcccaatggggcccacacacttacataaactcctttcagaggaaggggagagagagaatataggtaattctgttgaggggcattaaatgacgaccaaggaaacatgagtgggtacttgagagaaggaacggcagaggggaagaggcagagactgatttgtaaatggttgtctttggaagttcagtgaatctgagagatgggcattatcttgtaaaaagattgggtgagatctggttacattcttccgctcctttcctgaaatagatcatgagataacaggggaaaaggaaatattcttgaaagagaaaatgagataacaaggaaaaagcaattcttcttctggtgggtccctctggtcttcatgaagctagggaaaagtgtcttccaaggcctgttgttttctaagggttttaattaaaaatattcattatcccagggagccgtattttggggtgaaaaatctctttcctgagggggcatactctgcaagagggtggttgagtctcctgatggcatcgttctcagaatttgggattgtatgctcagaacctttgatgcatgttttgtaggttgtataaaaccacacatctgtcctttccagaccgaaatatcgagttctccacaatgatcctctgtgacacaagttacatttgcaatagaaacctatcttgtatatgagaaatgcaatccagtattgattcgacacatctgggttgaattcctgacttgtccacagccagcgatatgcccttggacaagctactttatcccattgagactctgttctcacctctacgaggagagtgtcagaggcatttggaccagagcgactccatcttgaataggggctgggtaaaatgatgctgagacctagtgggctgcattcccaggagttaaggcgttcttagtcacaagatgagacataggtcagcataaaatacaggtcataaagaccttgctgataaaacaggttacagtaaagaagccagccaatacccaccaaaaccaagatggtgaaagagtgacatctggtcctcttcactgctcattatacgctgattataaggcattagcatgctaagagacactcctgccagtgccatggcagtttacaaatgccatggcaaccaacgtcaggaagctaccctatgtggtctaaaaaccggtctaaaaagggcaggagccctctgttctggggcaattgcccagccctttcccggaaaactcatgaataatccacccctcatttagcatatcatcaagaaatcgccataaaaatgcgtagccagcagtcctcagggctgccctgcttagggagtagccattcttttattccttgacctccttaaactttctttcactttatggactggccctgaagttataataaaatcactgtttcttttcacaactggaagttgagataaacccgtaagaccacattttagttcccaggctagcatcttgagccctgtgagtctgagttctatttttccctccagtcttaacttttattgtattatggcaattatgaattatgaatattttgataacataatgcatgaatgcacgctcttgatacatacttcaaacggtaaggaattttgtaaagttaaatggaagagttcttcactcaatatccttggcccaacagacgtgcctatgaactctgtggcttttcctccctcgtcctgtttcacctccgctcctgctgttgcctccctcctcctccctggctcctaagtctttgagtaactcagcggccttttggtgattgttccatttaggggtagattcctcagagaggccttgtccacccaacgggaggaagtctgcctgaccttactccacggtattttaaaccagagtatgctgtttgcatccttactaaaactatgcaggatcatgactggccagggcggcttgcacctataatcccagcactttgggaggctgaggcaggaggctcacttgaggccaggagtttgagaccagcctgggaaacacagtgagaccccatctctaaaaaaagaaagaagaaaaagaactctgttgtaattctgtttgtttgctttgcttctttccactgtctgccttacattcttgccttctgcattgtaagcataagaaggcggagtgcaggatatgcttgttctatatactgttgtggtcctacttttcctcatattgcctgaagtaaatgttggtggaaaaattaatacacacacatacacagatgcatatacaaatacattttactcagtgccccgtgttatatatataactttgttttgaacatagtaaatcttagagatcttcctatattgggacattcagtgactgactagtattgcactgtgtggaaataccaataatttattaaatcttctcattgcaaatggacaaattaggttgtttccaattttttataatcataaagaatgaatcattgaccatctcagtcttgcccagaccttatctggccacccatgcaggtatttttgtaagataaattcctataagaggaatgattgagttgaagggatgacacaattttgattttgagagataatctcgaattaactttaaaagttgatgtaccaaattacatgtgagccagctgcaattgtaagagttcttgttttgtaattctcaatatcagcagatattataaatcttcaagttttgtcaagttaaagggtaaaaatcctagctatatctcattgttctaatttgcatttatgattactaacaaagttaaatattttaatgtgtttatagtcgtgtacttttcctatgaattgcctttccttgtacattaccttttttcattcattttttcttaatgattgcagaagctttaaccttttgatgtttattatttgtcgttatgtgcattccaaagaatttctgctgatctgttgtttatgattaacatttttgaatggtattctttcaaatgtaactaattttttaagagctttattgagatgtaattgatatatgaagaactgcactgtacttgaactcctgagctcaagtgatcccctgccttggcagctcgggtagctaggaatacatgtgcacactatgtcacccaggtcatttttaaattttttgtacagatgggttcttcctgtgttgccaggctggtcttgaactcctggcctcaagcaatactcctgtctcagactcccaacactatgggattacaggtgtgagccagtgcacctggatcaactatgcatgtttaatgtatacaatttgataaatttgggcatatgaaaacacctgtgatattatcagcataatcaaagaaatagacactgtattagttcattttcacactgctgataaagacatacccgagtctgggcaatttacaaaagaaagaggtttaatggacttacagttccacagggctggggatgcctcacaatcatggtggaaggcaaggaggagcaagtcacatcttacatagatggtggcaggcaaagagggagagcttatgtagggaaactcccccttataaaaccatcagatctcctgagacttattcactaccacaagaacagcatgggaaagacatgcccccatgattcagttacctccctctgggtccctcccagaacacgtaggaatccaagatgagatttgggtggggacatagccaaaccatgtaattccacccaagctcctcccaaatctcatgtcctcacatttcaaagccaatcattccttcccaacagttccccaaagtcataactcatttcagcattaactcaaaagtccacagtccaaagtctcatttgagacaaggcaagtcccttctgtctatgagcctgtaacatcaaaagcaagttagttacttcctagatacaatgtgggtacaggcattgggtaaatacagccattccaaatgggaaacattggccaaaacaaaggagctacaggccccatacaagtccgaaatccagtggggcagtcaaatcctaaagatccaaaatgagctcctttgacccatgtctcacattcaggtcacgctgatgcaagaggtgcattccctggccttgggcagctccacccctgtggttttgctggatatagcccctctcctgactgctttcacaggctggtattgtctgtggcttttccaggggcacagtgcaagctgttggtggatctaccattcttgggtctggagaacagtggcccttgtttcttttcttttcttttcttttcttttcttttcttttcttttcttttcttttcttttcttttcttttcctttcctttccttttcttctctctctccttctctctctctctctctctctctctctctctctctctctctctctccctctcccttcccttcccttcctttcccttcctttcctttcctttcattttttttgacatggagtttcactcttgtcatccaggctggagtacagtagtgtgattttggctcactgcaacctctgcctcctgggttcaagagattctcctgcctcagcttcctgagtagctgggattacaggtgcctgccaccatgcttggctaattttttgtatttttagtagatacagggttttgccatgttgggcaggttggtctcgaacttctgaccacaggtgatctgcctgccttggccttccaaagtgctgtgattacaggtgtgagccactgcacctggctgaacagtggcccttttttcacagctccattaggcagtactccagtagggactctgtgggggcttcaaccccacatttcccttcttcactgccctagcagaggttctccatgaggaccccacccctgcagcaaacttctgcctggacattcaggcatttccatacattttctgaaatctagacagaggttcccaaacctcaatcctcgacttctgtgaacttgcaggctcaacaccacatggaagctgccaaggcttggggtttacatcctctgaagcaacagcttgggctgtaccttggctctttttagtcacagctggagtggctggaatgcagggcaccaagtccatagactgcacacagcagagggaccccggccctggcccatgaaaccatttttttcctcctaaacctctggtcctgtgatgggaggggctgcttcaaaggtctctaacatgcccggaagacattttccccatggtcttgggaattaacattaggttcctagttacttatgtaaatttctgcagccagcttgaatttctcctcagaaaatgggattttcttttctattgcattgtcaggctgcaaattttccaaacttttatgcccctttccccttttaaaactgaatgcttataacagcacacaagtcacctcttaaatgctttgctgcttggaaatttcttctaccagataccctaaatcatctctctcaagttcaaagttccacaaatctctagggcaggggcaaattgctgccagtctctttgctaaaatataacaagagttacctttgctccagttcccaacaagttcctcatctccatctgagaccacctcagcctggatttcattgtctgtatcattatcagccttctagtcaaagccattcaacaagtctctagggagttccaaactgtctcacagtttcctgtcttcttctgagccctccaaggtgttctaacatctgcctgttacccagttgcaaagtcgcttccacattgttgtctatcgttgcagtagcaccccactctactggtaccagtttactgcattagtctgttttcacgcggctgataaagacatacctgagactggtcaatttacaaaagacagaggtttaacggacttatagttacacagggctggggaggcctcacaatcatagcagaaggcaaggaagagtaagtcacatcttatgtggatggcgagaggcaaagaaagagcttgtgcagggaaactcccccttataaaaccatcagcacttgtgagacttattcattacgctgagaacagcttgggaaagacctgccctcatgtttcaattaccttccactgggtctctcccacaacacataggaatttgagatgagatttgggtggggacacagccaaaccatatcagacaccaacaccttctaatgttttcttgtgtcctttcccctcattgttgtagtaagaacacttaatgtgagacctcttaacaaattttggaatgcaccacatcatattgctaactataggcaatatgttgtaagatagatctctagaatgtattcaactagcataactaaaactttacaccaattgaacaacaactccacatttcccctactcctgagtttctgggaatgactattgtattctttgattctataattttgagtatttcacatccctcatataagtagaatcatgcaatatttgtccttctgtaactggcttattttatttaacattatgtcttttgggtacatccatgttttcacacatagcaagattttgttgttttcgaaggttgagtaatattcaattgtattatacaccacattttctttatccattcatctgtcaatggacaatcttttattgaacaatttattagtttttagtggtcaaagaacaagatcatgtcctttatatgatttatatgttttggttgttattttagaagcccttctccatttcagtagtataaatatatgtatttctgacctttttcttcttatactgttagtttttcagtataacattgaacttttaaaacaccttgactttttttctgagtatggtatgaattagggatatttgttacttttttcccatattaacagttattcacctaattatactttattcagttggtctagactttttcctacatatttgccatctttattataatttaaatcagcatatacacttggatttatttttggtctctctacatagggctatgtatctattgtttaattcttagagatttatgtggatatgtggtaggtatatgtcttcactcactgcgcttattttcaacatttttttccattatatttatttgtttttctcttatagatgaacctgagaataatctgtcaagctgctgataaaaattctttatgaagttaaagattgcacagaacttacaaattaaattgggagaattgaatttcctgtaatattgaagtttctcaaccaaaatattgttacccatttctatttttcactttttaaaaaatgtatgaaacaacatttatagcctttttaaatagaacttctactcttctcattaggattatttctcattttgtgtttttttgctgctattttgagttttttttttctctatttcattctaattgatggttagatggttagtagatggttagaaaattatttatttttatatgatgatattgaatctagccactttgaactcttgtgccattttataaaaatttgttttcttaagtatctagaaaaataatgaaatagtgtctgaaaataataaattttgcctctgtttttcaatatttttacttttctcctcattctattcttattagtgatgaaatatatatatatgtattcattgtctctcatacaaaaagtagccttgacaatctgaaaacaaaatagatttgcattaaaattggaacctaaaatgcaaggatactgaaagttaggtcactttaacaccaattggtgcctttaagatagtattaaaaatatacacatggtatttgccaaattttgaatataggagcatattgtgctttgtacatactttaaaatagccacagatggctgggcgaggtggcttttgcttgtaatcccagcacttaaggaggcctaggtgggcagatcacctgaggtcaggagtttgagaccagcctgaccaacgtggtgaaaccccatctctactaaaaatacaaaaattagccgggtgtggtggtgcatgcttgtaatcctagctactcaggaggctgaggcacaagaatcgtttgaacccaggaggtggatgttgcagtgagcctagatagggctgtcagcctgagtgacagagtgagactctgtctcaaacaaacaaataaaaaaagccacaaatgctaataaaataatacattcctaaaagatactgtttaatagtttctcctaaaagatactgtttaataattactcctattattctaagaacattggcattagaatttagaacataattaacagactcttcttccaaaaatgtgtaacaatgagaggtaatagtgaatggcaaatgtacagtgtgaatgagaggcaagagtaccaggacagaccttgtttaaattatgtaatacattttaaaaatccacagagaataaacatgagcttaactaaataaaatgacttctgtttgtttaaattttttggcagataaaaattaagtgatacaatagtcattctgggtggtgtgagatggtggtatcttattgtggttttgatttgcatttctctaatgatcaaagatattgagctttttttcatatgcctgtagctgcatgtatttcttcttttgaaaagtgtctgttcatgtcctttgcccactctttaatgagattgtttgtttttattcttgtaaatttatttaagttccttatagattctggatacaagacctttgacagatgcatagtttgcaaatattttctcccattctttatgtctgtttactctactgatagtttcttttgctgtgcagaagctctttaatttgatgagatcccatttttcaattttttgttttgttgcaattgcttttggagacttcaataacagacgctgccaaggttgtggagaaaagggaacacttatgcattgttaaggggagtgtaaattagttcaaccattgtggaagcagtgtgacaatttctcaaagagctaaaaatagaactgccattcaacccagcaatcccattactgggtatgcacccaaacgaatatacattattctgtcacaaagacacatgcatgcagatgtccattgcagcaccattcacaataacaaagacatggaattggtgtaaatgcccatctatggtagattggatgaagaaaatgtggtacatataccccgtggaatactatgcagtcataaaaaagaacaagatcgtgttctttgcaggaacatggctggagctggaggccattatccttagcaaactaatgcaggaacagaaaaccaaatactgcatgttctcacttataaatgggagctaaatagtaagaacacctgtacaccaagaggggtacaacacacactgggacttacctgagggtcagaattgggaggagggaaaggatcagaaaaaacaactattgggtactgggcttagtacctgggtgatgaaataatctgtacaacaaaccttcatgatatgagtttacctatataacaaacctgaacatatacccctgaacctaaaataaaagttataaataaataaataaaataaaattcaagtgtatgaaacatttattattattattattactattttttaaagaacctgctgggaatgtattgcaagtgcgttgtaactgtagttcacctacttaccttaacaatattgaggttttctgactagtgaacatggtatatctttccatttatctaggttttctttaatttctctcagcaagttttgtagttttcagtgtacaggtattgtacatattttgtttaaccatatgtaatttatactttgtatgctatttccaattttcattaatagcatataaaaatataatagatttttaaatattgaccacatatcttgtggccttgctaaattcatgtattagtccatttttaaaaataaatcctattcttttaatttttttataatttcttataaattctatttttcctgcatagaagatctgtcctctgttatttcatcctttccaaaaaaaaattcagtgatgtgatgttgtccatgttgctctgagggcatcactacgatggaaagcacatcctcccgattttcaacgtggagagatgtcccatgtaacctattccttgtgaaagcaacccaaaagtcctatagacacttgcttttggataaacacaggaatggaaccttctgctgttaaagtttgaaacttatgtttgttttatctgagttccttcctcaggaaactaccttcaggcctctcacaaaaagcatcaaagaactgaacccagatcaccacaccggttgccggacccctcattcaccaggatcgcttccttgctcctcccgagttcctgttttcttattcattcttacatttcttggctgctatataatcccctggttttaatcagtcaggaagatggatttgagactgcagcatctcctcagctgcagcacccaattaaagccttctcccttggcaagactcatcgtctcagtgactggctttctttgcagtgagtgcaggactgagactgaacccttggtgttttggtaacaattgttcaacaatcatttgttgtgaccctcatctttccttctcttttaattttcttgagctcatattttaatttttatttattacatgatattccaatttaattatattgaattaataagttattctgttgatgccctccagaatattatctcatggtatttatatcatttcacttaatgtctcttcatgaattaggactcacagctttggaactgcactgaatggttttgagcttggaccatatatcattcattcatttttgggagttcactttagtgtgcctcagggtgggaataatgcaactttaattcatgatctttaaaggaagccctttggatcgtatattgatgataggatgaaaggatctcaataaagcagaacttgtttgagattaggtcacatttcatttcaaaattattaggttgaagttgctgatttagtgggatattgtatcggttgatgttaaaatgatctcgtgtgttagattttgatagcatggaggaacagagatgggcaatcatatccttctgtatttccttcttgtgacaagatatgaccatggaagcactgatgtactaagggaaatagtgtttcatcaactgcactgagctatccagagtcaggaaatataataaaaaccattaatattccttgctaaagggatttctatttatttaactgctaactcagttattttagtaacataatggttaaatcagtagaggttcttttctgcaaattatatttgcagggagtcagtaagatagattttaccttcttgggaaaatgagtcattggggaaatatctgtaggtcttctttggaagaatattctagagactattgtgatcaagcatctacaaacttgtgatagattttgttgaatcaatttcagtgtgagatctttagagaagagtagaagaactattctgttaggataaagatttaatttgatagagagatcacaaagagccacaatgtcaaaagattcaagatagtttgcacctaacttaaaattggaacagtagtgtaaaatataaaaacactgtgcttaatatgtttcatatgctttctatgttaaatatatatatttaatatgctgaatatataggaggttctataaatagttttcattctcaaatgaaatcttacattgtaagatagaaaaaaagacgtaggcctcatttgcatttgaaaatagaaatgaagaaatgagaaaatgaataattctagtatcagactgtgtttcttctgcaatggataattactttaagaaaaacgaattttcatttgaattggtgaaaaattgataacttttcctcactttttaaaatgtaaatagagtggttggaaactaaaaaaaaaatcagtaagatcagctttctctgcacctgtgtcagcaaaacataaggaattctgaggggaaaaagtgaaacgttacttaacatcatctattaaggaactttttctcttaagttctttaataagttgctgtttagattgcaagaggatgtttaatatccagaagcataaccctgaaatctcaagacttcgacttacaattgcctacaaaaatattctaatttactgattgtaatgttttccatatacaattaagaaacagtttagcacattattattttaattttgcattcttcaatgtaattttacatcacatttattgattatagacttgtgtgtctttctcattatttggcttcacagtagttccctaggatgctttgtctgtaaagccactttaaaatgtcatccacatcacaaatgttacaaatcctattacacagttcacccaagattctgcacacgtttttccagtgtgcaatgtagcaaaaataactgaaatactgtatagtggatggatttggcatggaagtcatcccaaagatctgctggagtataacagggcttcagactggatcaaataggaattctcagtatttcaatagaataaaggtaaattccacacaaggcagtttttcccctccatatatagtaaagatttaatgacagtctctggaaagattgtactggcaatgtttcaagtatcacattgtcttttagggattaattgttcctaaatgtgatacgaacaaatttcctcagagctcctacgtcttctaaagatagctgtaatatgtgctatgcttgactgcaaggatgcaaaatgacttttccatattcaactgtctcttcggcactactcaaattttaacgagtaatggatttttgtgactaaaaaggtagttgtatgttgactggacgacagtaaatgtttccattctaattagagaatagcagaatgggaagtaaccatggaagtaatttgactgattgattggtttttgctttatcaagtatgtgagataatacatacaaagctttgcttaggaactcctaatttcaacatctccatccctgccgcatatcccattccggattctgtttctcatcctctgtcttcccaccccattcctggatttaaactctttgaaatcaattctccctaaacacctctgagattgagtggaaaagcctagaaggcagtagatccttgagattgtggccttgagggtttgagggagacaacacttaccaaacttgaatttccctcaactctggttgggttccttgttggagctgcccttgtgcggaaagccagtggattagagtgcagtgggaatcgcagggaaacgcctctgaaggcttatccatcacagtggttctcaaagtgcgttctgatggtcctttgaaggtttctgagtagctttcaggggatctgcaactcaaaacaaggcttagggtgataccaacattatttacccttttcactcattttatagcaatggcacaaaagcaatgatgcataaaactgctggtgccttagcacagatcacggtagtggcaccaagctgcagtgctggttactgtattctttattgctatacatgtgcgttcaaataaaacaaaacaaaacaaacagaacaaagcaatctgctagctttgctgaagaatattcttgatgaaacaataagaatcattaattgtattaattttggtctcggagtacacatctagaagaaacgagaagtgtaaataaagcacttctgcttactgaatacagtggatgacctaaggaaaagtctccaaccaactgtttgaggacaaactatcttattcagaccaactatggttattcagacttgcttattttgtagacatttccttgaaaatgaagtgagcttttcacctgaagtaaaatcactaataatgtgtgttgccagcgaaaattagaattttggaaaacttgtgtctgcctctgtgaaactgactgcttcctaatacagatgtttcttataagatcagtagtaatatcaaaacgtgattttgtctgtattgatgaatgaaatgtgtccatgtttggaagatctatatatttcagtaaaccaatattttcttataaggtcagtagtaacatcaaaacgtgattttgtctgtattgatgaatgaaatctgtcaatgtttggaagatctatatacttcagtaaaccaatattttccacatgaccatgtatgatattgcagaaatcatgccccagtaaagaagacctgagccagccgtatgctagagcagcggattttaatagaacggagcacaaagaatcatggatatggcttcatatcccacatcgcagctgtcttttaaaaactgtgaattgtcaagttttggtgtagtagtaaagaaccatatccacagttatctgaaaaggcaattaaaatacttctcctggctgggcgtggtggctcatgcctttaatctcagcacttgggaggccaaggtgggcagatcacgaggtcaggagatggagaccatcctggccaacaaggtgaaaccccatctctactaaaaatacaaaaattagccgggtgtggtggcgggtgcctgtagccccagctactcaggaggctgaggcaggggaattgcttgaacccaggaggcagcagaagtttcagtgagccaagattggccactgcactccagcctgggcgacagagcaagactccgtctcaacaacaacaacaacaacaacttctcacttttcctcacacataactgtgtgagaatgcttttgttcatacacattaaacaaaacttttcaaattttccattaggccagacactaaggagatttgcgaaatgtaaaatagtgccactcttcttattcatttcttttgaaaatatggttattttgcatgagaatatattatatgtattaacatgtaatgcgttaccatactattgtttttttaaaataaataataaatatgtatacatttctcaattttgaatataataaatattggtagatatgatccacatgaacagaagcctttgcctttgcagtcttcagtattttttaagaacatataggggagatccttagactacatagtttaagaccagctgctttagagaaatacttctggaaaaaattctacagcaagtaaaaaacaaaaaacaataaaaacccaaacatctcaatttgctattctgcaaaaaataattttgtagccttttcattattttttgtaaataaaattttgcaagttatttgccataagaatgaagatatatataccttctgattcagttctaaaagattcctgtaattataattgtgctagataatatataataataattggattaatcaaattgtcatgcctcacaatttttaactgaattttttggtgtctattaattctttaaaaaataaatgtatgctatgttatgacacccaccttgcattccacaacaccattccattctgtatttccaacaagatgctcagcactaaacagcatagagtagggtgtccctctaagccctggccagcgaggaggcctgctgagaactcaccttgtgtgtgggacggttgtttgttttttgcttgtttcttttggagctccagatccctgtctgtgcgtgagttcccatccgccagctgctgtgggtgctgactgcacaggggctgcagctgcagccttggaaggacagcccttggtctaggggagctgccttgtgctggaggcgatggtgccgttcccagtgacccgcagccaatggctgatggatgcaggtatgaaaggcccctggcctccttggaggacctactgtcggtaagacctaccctctggtgccatttttatgctccacagctctccaagcacccggcaggggctggatcacaactcaaatcacactctgcctggcttttccccttccctattctctcccccactttcccccagcttcctcctgggtgcagttccttaataataatccttcagagccagagacaagaatttttgttctgaatatcccaccttagatgactgaactgagacataattccgtttgttcttgggggtgagggatttgggccagcggatggggcgtttgaatggggaccaatgagggtgtgaacattccattataaacatcattctttccttttatatccttaactaggactatacttttataacctaaacttttgtcatcattgatgtgataagtgtaaggaattcattgtaaatgtgaaggcttatacctttttgaaaacttgcactgaaagagtggttctcaactgggatggttttatccccgcgggggggacatttggcaatttttgattgtcacaaatgggggaagggctgtagtgcataagggccggggatgctgctacacatcctactaagtacagacacagccctctaaaatgaagaattatccagcccataatatcaacagtgctaagcctaggaaatctgattgaaagtaaaaaaattttccaatatagtgttcattaataatggagtgtagcctttccacaaaaactatttgtgtaactcaaatgacagaaataaagacataattatttgtcctccttaaaagatatgattgtatctgttttcttcttggtacatctcataaggagggaaaaaaaacacttcatgctagaaactattcagcttcattgagtttccccggaaattgacaagtgatgaaagcagagctgtttgtgttcgagttcctgtttatgtcaaatgaatttgaataaaacaaccagagcagaaacttgaaacaagtactcctcccatatgctcatgttttcatttaagacaaagtgtaagagaaaatgttgaaaggcaacagcctaatattctggccataatattcctggaatgttatggggccattctcactcagcacttggcatattttcacctttagcaaaatcgtctttgtgcttatgagtagtttgtgaaataactgcattaaggacttttctgttctggtttaagttaaaaaatgattactttgaagtatcactatgtactatatcttaaaagaataaaacattaatagaaatcaattaattatcctttgactttgacctggaatggctactgctgagtgctgtgtattgatcacagaaatcttgaacttctcttttagtgttgttagtggggctaccggctatcgggtgcatgtagatattaattttctctaactcattcttgtcacagtgatatttccattgcattccatcctgttcggctcaaggcattttcagactctttgaaaataaaatcttctttctcttctctataaaatcttatctacttctaattttttgtctttactccatactatccccaaatctgagagcaaaaattccttttggtttcctgttcatgaacatatttgtgtatgaactttcttttacagtaaaataattggcagtgtgccttttggctcaagtttgtcttttgttctccggctttgttatctctcttggcccaagttcaagcatctccttcagcatcttctgtggtgtgtcctgtctttgcaggtaggaactcaaggtgactggttttaagccaaatattctcaccaaaagtagaattgacccataaatacttttgattctattctttttttttttttttttttgagacggagtctggctctgtcgcccaggctggagtgcagtggtgcgatctcggctcactgcaagctctgcctcccaggttcccgccattctcctgcctcagcctcccgagtagctgggactacaggcgccccccaccacgcctggctaattttttgtatttttagttagacgaggtttcaccgtgttagccaggatggtctcgatctcctgaccttgtgatccgcccgtctcggcctcccagagtgttgggattacaggcttgagccaccgagcccggctgattctatttttaaagaagctcttctttaacttctctcatttacagtggactacatattttgtaagggcttcagtaatggatgaagcatgaatatgttccagacattttaaagggaaatatactgaaaatcgagtcgtggttgcatttttctcccccttcataaatggcaataaatttctcagtcttgtttgtccagtgaatttgaaaaattcgcccaaaaagtacaaatggaatgatggtctatttcattgttttcaaaattttttttttaaacagagatttttaaaatttaatttaatttaaagttccggggtacctgtgcaggtttgttacataggtaaacatgtgccatggtagtttgctgcacctaccaacccatcacctaggtatgaagcatggcatgtattagctatttttcctgatgctctccacccgccccccacctagttccttccctgacaggccccagtgtgtgttgttcccctccctgtgtccatgtgttctcactgttcagctcccacttataagtaagaacttgtggtgtttggttttctgttcctgagttagtctgctgaaggtaatggcttccagctccatccatgtgtctgcaaaggacatgatctcattccttatagctgcatagtattctatggtgtatatgtaccacattttctttatccagtctatcattgttgggcatttgggttgattccatgtctttgcaactgtgaatagtgctgcaatgaacatgtatgtatgtatgtgtgcaagtatctttataacacaatgatttatattccttgagtatatacccagtaatgggatttgtggatcaaatggtgtttctggttctaaatctttgaggaatcactaaactgtcttccataatggttgaactaatttgcattcccaccaacggtgtaaaagcattcctatttctctgtaatcttgccagcatctgttgtttcttgactttttaaataatcaccattctgactggcataagatggtatctcattgtggttttgatttgcatttctctggtgatcagtgattttgagctttctttcatatgtttgttagctgcatgtatgtcttctttttagaaatgtctgttcatgtccttggcccactttttagtggggttttttttgtttgtttgtttgtttgttttttgagatggagtcttgctctgtcacccaggctggagtgcagtggcacaatcttggctcactgcaacctccacctcctgggttcaagcaattcttctgccccagcctcctgagtagctgggactacaggtgtgcactaccatgcctggctaatttttgtattttcagtagagacggggtttcgcaatattggccaggctggtctcgaactcctgacctcatgatccgcccacctcagcttcccaaagggctgggattacaggtgtgaaccactgtactcggccacggttgtttgtttctttcttgtagatttgctttaattccttgtagattctggacattagacctttgtcagatggataggctgcagtaattttctcacattctgtaggttgtctgttcaatctgatgatagcttcttttgctgtgcagaagctctttagtttaattagatttcatttgtcaatttttgcttttgttgcaattgcttttggtgatttcatcataaaatccttgcctatgcttatgtcctgaatggtattgcctagattttcttctagggtttttacagttttgggttttacatttcagtctttaatccatcttgagttaattttttgtataaggtgtaaggaaggagtctagtttcaattttctgcatatggctagccagttctcccagcaccatttattaaatagggaatcctttctccattgcttgtttttgttagacttgttgaagatcagctggttgtagatgtgtggtttcatttctgagttctttgtcctgttccattggtctatgtgcctgtttttgtaccagtacaatgctgtttttcttactatagccagaggtacaaggagaagttggtaccatttcttctgaaactattccaaacaattgaaaatgagggactcctcgctaactcattttaagaggcaagcatcatactcataccaaaacctggcagagatacaacaacaacaaaagtttcaggccaatatctctgatgaacatcgatgcaaaaatcctcaataaaatactggcaaacagaatccagcagcacatcaaaaagcttatccaccacaatcaagtcggcttcatccccaggatgcaaatctggtccaacatacacaaatcaataagtgtaattcatcacataaacagaactaaagacaaaaaacacataattatctcaatagatggagaaaaggccttcaataaaattcaacatccctttatattaaaaactctcaataaactaggtattaaaggatcatatctcaaaataataagagccatttatgagaaacccacagccaatactaatatcatactgaatggacaaatgctggaagcattcccctggaaaactggcacaagacaaggatgccctctctcaccattcttattcaacatagtattggaagctctggccggggcaatcaggcaagagaaagaaatagagggtatgcaaagaggaagagaggaagtcaaactgtctttgtttgaagatgacatgatcctatacctagaaaactcctatcatctcaggccaaaagcttcttaagctgataagcaacttcagcaaaggctcaggatacaaaatcaatgtgcagaaatcgcaagccttcctatacactgacaacagacaagcagagagccaaatcatgaatgaactcccattcacaattgccacaaagagaataaaatacctaggaatacagctaacaagggaagtgaaggacctcttcaaggagaaccacgctgctcatggaaatcagagaggacgcaagcagatgggaaaacattccatgctcatggataggaagaatcaatattgtgaaaatggccatactgcccaaagtaatttatagattcaatgctattctcattaaactaccattgacattcttcacaggagtagaaaaaactgtttggaaattcttatggaaccaaaaaagagctcgcataacaagggcaatcctaagcaaaaagaacgaagctggatatgtcatagtacccagcttcaaactaagacagattatgtcatactacccagcttcaaactaagacggattatgtcatactacccaacttcaaactaagacagatttgcagcttgaaatgtttacaacctaatgctgccaatccttaatgtcttaaatacaatgaatttttgtagtgcttttcgagttcacaattcgaaatgatataaaactggattacagacaattacatttcccatattatttaaaatatgcactggtgctacaaaatttttctataatgatcattatatatatgtaatattatataagtgtgaaagtataatattatgtatgtcatatataatatataaccataaaagtagattttacatttatgattagctaaaaaattttgagacagaaactctgcgttttgcatattatgtattctcttgtctttcctaatccctagtaaaaaataaactttactatgtaaaaatctgttaatttgaagtcaaagcatggctgtattttcagttagttttttaaaaaaatgttttttttctgtagcaaattgttgacttggatattgcttattttgaggttcttcctctttcccctcctgtgccctccaattcagtgtaactgctacctctctaagtgtcaaagacaaatgatggatggttgttcagcttctttgaaatgcagcatgttttagtgcctttttacccttgactttcatcactagtattgattgatggtatgttatttacctggcattgaaggactactggtttataacattcaaggcaaaacattttaagtagtatgcaatgcggagatttctttctactgggcaaggttaatgacctaccaaaagaggaggggtcggtgtatgctgggaataattgatatcttctgaagccaagattgacttgtggggtaattttcatatccttgtgataattaagttagtagattttcatctttttaattgccctcaatttcttcagaagggggatttaggatgattagccttttatggtcaacttgctgaaaaatacctatacaaagcttgtatttagaaactagagtcctttttttcttctcttgtttaggtgatgtcgtcccacaataacacttactcgacatttatgtaggggaggtaattcttttggttgtactgcagagaccaagaatacattttgtacttcatttacattccccagaatacttaatataatgttgatgacatggtaagaacacaatatctcagtattttgtggctgagtgaatgacaatgcataaccttaattctaatttggtgtcaatctcattttttaaactttctgttttcagaaaatgagaaagggcagcaaagattttgttgaaatatgattttcagaatcttgaatttacaagtgtttgtttgtttttgattataccatggttatactatagatgatagagggatgattttgaatcaaaaagaaaaaaaagaaaatatatgtatggaggctgaagtcatagacaatttttgatgggataaatgttgccaataatttttccattaggctttagtttgtgtgttcagcatttgaattttttttagttcattttcaggtcacattttagttttatgtttcttaaaataacaaattaatggagcattaaaacatcaaacagttttgaatctttcaagtattgaaaacacattatgctgaaatttttgaaagtaaaaacagtatgaaggccaggatttccagaagattgacataaatgagtgggatatcatctgttaacttttaaataaacttcagattgatttgtgtctgggaagaagacccttttctatgcaggctggaagggggatttgctggcattcccgagtggttacaactttgtggagttaatatttaatgtgccattttatagcatatacagatttagaagctgaaaagatactaagacaatataatatgaatttatcatcaatttcatagcatgaaactgaagaaactactttttgtactgttttaaggaaatcctatcatcatatggtgactgtacaacattaaagcaacattctggaaagaaattgccaggtatgtagtcacaggttcaaagaatgactggaaactgaggaactttcacatagtgtataggaatttataacaagttctgacagcattgttaactgattaaaaatacctaataaggctgctggatttgttaatgagtacttttaaggcaaaattggcaataaaacaatagcatttgtttaaacagaaaaaaaaattcccctgcattccttcttttgaaaggaaacagccgcgttatgggagttctcatagttatatgttgaaacagggcagcttttcaaaaactgtcaagtttagtgtttcaaaggcatgttgaagaatgaagacgggggtgtgtgtaaataaatgtgctgattgcataaaggctgcttctagttttgctcaagtgattttagagcttctgaaggagcagttttcaaccttaaatatctaagtcaacactttttctttagtaagagaggtgaccttagaaatgtccttggtctaagtgaaaatactggccaattcaagacacagcaatgtagatcaatccttattctttaactttctgaacaaaagtttaaaaacattccaaatttattttcattgatggaagagattcctgtttatattttgttatttttaaaataaatgaaaatgaggttatcagtcaaaggtggtttgaaaaaacttctactccatttccagcgtgatgtcagggaacccgacagcagtcacaggcactctgctttcacactaataatttgtgatctaatcggtaaaattagatcagtatgcaaaactattagatgagttaatagtcaaatggtagagttttaaagactcctagatccggtggttctattttgttacacgtcttctaggaagcttagaagattgctttgtttggttgattcactacctgctgcatctttagccttgacttaataatgaagtaaaaataataaaacaaaagacagtaacaaagtcaacagaaaatcctctctcccaaataaacccaacaacaacaacaaaaaacaaagtactcagacaaatagctgggggagatttttagaaattgagagttttttgaacatgtaattaaatttaatttagtttttaaaaaaccttttaaaacacttcaatgggcagggccttttttaattgaggtgaaattcacataacataaaattaactattttgatgtgtacaaatgtattcacaatgttgtggaaccataacctttacccagttccagaacattttcatcaacccaaaggggatccttttcatcaaccactaatctgttttctgtctctgtggattttcctactccagacatttagaatcatacaatatatgactttttatgtttgcttcctttcacttaacataatgttttcaaggttcagccttgttatagcatgtgtgagtacttcattactttttgcaggtgaatcattccattgggtagatataccacattttgtttatccatccattcactgatgtaaatttattgatttttcaccttttggttatttgttaatagtgctaatatgaacattggtgtacagatatgtgtttgaatacctgttttcaagtctttgggctacataaataagaatggaattgctgggtaatctaatagttccatgttaacttttcggggcaaagccaaagtagtattcatggtggctgcatcttttatattgtagcaatacacaaggcttccaatttctcaacatcctcaccagcacttgttatttcagttttttaaaaaattatagccaccttagtggatgtgatatggtatctcattatggtttcaatttgcatttccctagtgactaatgattttgaacatcttttcatgtgcttgttgaccatttgtgtaccttcttaggataaatgtctgctcacttccttttccaatctttaaattgcattgtttgtctgtttgttgttgaactgtggtgctttaaatatatctatctatctatctatatacatattatatttatatatatacatagagagagagaattttctacatacaagattatgtcttctgtaaatacagatagttttacttcttccttttcaattaaaataccctttatttctttttcttggctaattgcccttgcttgaacttcctgtataatgctggataaaagtggtgaaagtagcatccttgtcttattactgatcttggagggaatgctttcagtctttcaccgttgagtatattttagccatgggtttttcataaatatactttattatgttgaggatgttccattttcttcctggtttatcatgtgtttttaccatgaaagcatgttgtatattttcaaatgttgtttcagcttcacttgagatgattttgtgttccctccttcattctattaatgtggtgtattatattcgttgtatatgttgaaccacccttgcattcttgggataaatcccaactgatcatgatgtataattcttttaacatgctacttcatttggtttgctagtcttttgttgcagatttttgcatttatatttagtagggatatctatctatagttttcttttcttatgtgctgcctttggctttggtgtcagggtaattctggcctcatagcttgatttaagaggtgttattttcttttctaattttctggaagagtttaagaaagattggtgttacttcttttttaaatgcttcatagtatttagggtgaaaccatctttagtactttactttttaaaaatggtaactatggacagttaaacctaaagtatcagaattcaaatggaaatgttttaaatttggcaataacaaaaaattataagttcaaaacatatctgcccaaacaatgactaataccacttccaaaattatctacttaatagatagtgaagggatataacattgtttttatattatttcaagatggggcaaaagttaacttctgttaagtaaagtctacacctatacaaaatgttgctcaatatgttcttgtgtttgatagcatggtagggtgaatatattgaacaatatattgtatttttcaaaatagctagaagagaagatttgaaatgttactgacagaaagaaatgataagtgtttgaggtgatggacatcctaaataccctgacctgatcattacacactccgtgcatgtatcaaaatatgtaccccatcaatatgtgtaagtattatgtatcagtaaagaataaaatatgttgaaaaatggagacaattacccaaataaataggaatatgattgagacatgggttggtattctaatgtattcagactattatcttaattctccattttactttacccatataaaaataatctcagttactcttagttggaaatttgtttcaactagaaatagaggaatatctccaaataattttacaactttattttctctcttagactcattgttttttccacaacatcaggttaatggtttaaaaagctttgcacaacttctgtttggttaagattttttattttatatacatagacacacacacatatctattagtcgatcattcagatatacaactaactagatttaaaaatagtaagccatggtttatacatcacatataaatgacctagataccagtagtgacattatcatcatgaatattagttccagaaagtatagatcagagaatatttgggaagagagatccaaaacaatgtctgacaagtttttgaggaatggggaatgatgatgaacagtcatgaaaataacagaattaaattccaatttgtttttcagtagaaatgatgttaatgtttagatggctcctgtcagcattaaatacacagttaagtacagaccttcagaggcagggagttggtgatttttctacctcttgaaataagtataccatacaaaaagcgctattttgcctgcttgaaatttcagaaaggtaaacactctgaattggcttagtgcttgggctattggcagacctttcacaagaaaaagtttttaggcagcgtctatgtgaatcataccagcttttctcaagataagggattcatattagaaggcttgactcactctgacattttatatgactttctattattgaaacaactctaaaggtcttttgagcattctattcacagtgttacctaataataacatatattagcttctggagtttaagcagcttataggcagagttcacataatcactttgaacgcctggcatctacgcagcaagtgtgcaataaatatttattgaataactaatcttacaatgaagaagcagcatgaactgggaattactttccattccagttctgaagtttagactcattctaagaactatgaatgcttacatctgtgaccttaatgtacctagatttcagttttcttgaattgagtttgacgagtgtatttctgaagccccttctagcttctaaatgtcatgacatgcgttcaagatgagacttgtgagtatcttttcaactaaactcagttctccaggtctttcaccacctgttgtaaaaggtaaagttgaatggacttctatcacttggatcttatttaacttgaattgctaaaaatacacgtacagccactgctgaaattaaacagcatctacaaatgcaggcattactctcagacattttctaagtagaatacatggcctctactcccagggggtttataatctagtgtagaaaaaaggaaatatatacaaaatgatgcaactgacatgagggaatttagggtgagttggacagtatttttaaatttctttgctgtgagtctagatttagttgagacttgaaataagtatacgtagcaatgaagaagaaaattataaaagctttagaaaataagaagcccatgtagagaagattgaataattatttgtttttaggagcatattcaatattttctgaatccatgctaaacctttcctcttcttctctaagctttctccagataaaatgtggcacagcctccgggacagtctcctccagactctggtcatattaatggccatagagagtcagagccacgatttttgtcttacacctcttttctctatgtacccaatgtttccttttaattgattcactgcttagatttaaacaaatgtttgttagaagaaatttaaatagaaaacccaattcattatatatagactgtaattataaagataagttcaatgaaaataaaacaatcttaaattcttcctgtgtactgttgacttactgaagcttctgtacctgaagccttctctctctcttttttttttcaattgaaccttagcacatgtcagagagtttattaaaaatggtagtattcccaagtggagacatcttccttgaagaattcagaagaactgagaagagttgaatgagaatggaaagggaatcactctatggggatagttctataaaccaggtggctttgtttatgcatactccttctgaaaacaccatacttctctacggggaggctggaggaagcactgttagtattgtttccatggttttgttagatgtcaaactcagagacattttttgagttaagtgactcacagactgaagaaaagtatgaggacttcaagccatcaaattttctaagttattgagtataattgcagtggattccctacctgaagctgagtcaaccaggaaaattgtactgtctaaattctttttccttttctcttgtcacccatggtgaatttttccaatgatataatcaattgatttttaccttatgacagtgggagaggacaggtaataaatgtaggaaaaccaggaaccaaatatgatttaacatacttggagttcacagatagcagtgatagaaagttgaactttaaaagcaaaacttaaagaaatccctttattttgttaaagaaagaaaatatatacactggaggatcataagtaaaatattccaagtacagttaccagccccaatgagtgagatccatgcttagagacagtcgtgattcttatttaacattaataaccacaaactgtgcaccagatgctatgaactcaagtccaaggtagatgatataatcaatatcatcatcactacagaatatattaaaatattattttactttagaagttgcctttcaagttaactagtatttgagcactttgtataccaaaaaaataaggtaaaacaatagtgaagaatccaagattatgggacaaaacccatcttcaaggaacttatgatgtacgacagtaatatcctttagtgaaaaagcatagcctcgtaagagatgcttgcagggatttaatagaagaaaggagcacactggaaaaggaggtggcttcatgaaggagcattttctatggagcgtgaagaaagggcaggctcttgacagggaattatatagggtgtaggacacttggctggacatctacgacagcgagacaggtggaaacagcagtgagaaagcgtgttgggtagttagtgcaaagcccagctttgttggaatagaggagaacaggaagacctgaggctgggaagagacgccaggatgaagaaagataagcaaagatttgtgactagcacagaagaactcgccatttgcagaattaagtgtcactctaatgtcaaggacaggcgcaaaccatggctctaacattaggcaagatgcatagtcttttaagcatcatcactggcagagctcctagatagatactcgtaatgataataggtaccatgtgttgaatgcatatcaagtgctgggcatagcactgggtggcttagatacactatacttctgtgacagaggcatcatctttattttcccagaccacaaaaaaaaaagtagagcctcttaaggagctggaagtcaaggataaataatttgtatcactctggtacaagtagtcattttagtttattacctaggtatcatcaaggaagaacgggctcataaatgttttgcagttaacatgcaaagtcctagaacatctcccacgtgagattcctaaacagttcttccaatctataatatctggtaatgaaatgcaaatgacaataaaagggcccagttccattcgcaagccatagttcataacaaatcacaagggttttctatggcaagcagcttcttgagaattgcagtcacacttgacatggtcatcagccatttttcaagatgccacgtctcaagcggggctattaatcccatttcttgcgtatttcaatctcattttacaatgtgaaattgctaggagacacacatttatcaatatgttccataatgttgtttggcatgacttctttcagtacatcgtattttttgttacatgatcaatatgagagtcttctctccagaaaaggcaactaatcttgctacctagtttgaagtggatggcttaaactatttacaaaaatccccctggttatttttctttcccgagtctctttccttatccttaggcccctttataaataagcttgtttctttgcagtctgtggctccaaaacatgaatgattattggaatatcagatttagttggcagctgtttatattaatgtaacaaggtgacattggtttggtctagaactagaagttattgttaggagaaactgaaaaactgttcattaaaaattataagaaatgcttttggtttctaagagaagtctgttaatcagggttctccagagaaacggaaccaatagagagagagagagaaagagaaagagagagagagagagagagagagagagagagtgtgtgtgtgtgtgtgtgtgtgtgtgtatctttgagggatatattcctcttgtcctgaaaaatcattccatagttatatgtagagagattctggtctagaatggagaagtctgaagttatggccccagaggactacaccgtcctgctctactattgttaaaggctgtccctgcaggttttgtttcctttggagaactgcttgttttcaaaatctaaatttatactgccatgagtattttaattattgcttgtccttggaaggtttatatgtgggttgtctgtgtaggaagtgttttgagcctttgctcattggaatttgggagccaaggaagggacgtacaccatggagtggcttggaggtagttgaggagctatgcagacaggggaaggagagtggtggtgctgggactgtgcagtcattttaagttattctgtgtgttatgttcccccattattatggaaactgtagcagatccccttagaaataacagccccatctctgatagtccatgggaaagccattccctcgacaaaatcacagtgagtacatgttatggactgaatgcctatgtacccccaaaattcatatgttgaaatcctaaccctaaaattaatggtattaggagatggggtcttagtaggtttaggtcatgagagtggagacctcatgaatggaattcgtgcccgtataagaagagacatgagaacttgcttcctctgttctctttcccatgagaacacagtgagaagacagccagtcacctgtaaaccagaaagcaggctcttatcagacgtgggatctgccagcaccttgatcttggacttcccagcctcaaggactgtgaaaaataaatgttgtttaacctcccaagtctatggtaatttgttatagcagctggaactaagatggtgttgccatggtgattacaagtggggcaaatgaattcatgcatttaacaaatgtttactgagcctctactctgtgctagatgcagcagagagggagcttggaataaaatagagcaggaagtgctagccagagcagtttggcaagagaaagaaataagaggcctccaaataagaagagaagaaatcaaactatctccctttattcatgacatgattgtcttcttagaaaaccctacaggctctgccaaatgctactagaactgataaatgattttagcaaggttttgggatacaaaatcaatatataaaaatcagtagcatttctatacaccgataacagccaggctgagcgtcaaatcaagaatccaatcctatttacaatagccacaaagaaaatgaaatatctaggaatatagctaaccaaggaggtgaaacatctctgcagggagaactacaaaacactgctgaaagaaatcagagatgatgcaaataaatggaaaaacatttcatgctcatgaactggaagaatcaatgttgttaaatgaccgtactactcaaagcaatttacagattcaacactattcctatcaaatgatcaatgttgttctccacagaattagaaaaaaccattctaaaattcatatgcagccaaaagagttgaatagtcagagaaatcctaagtaaaaagaacaaagccagagacattatactacctgacttaaaactatactataaggctacagtaaccaaaacagcatgatactggtacaaaaacagacacatagactaagggaacaggataaaaaactcagaaataaagccacacacctacagccatctgatcttcaacaaggccaacaaaaataagcaatggggaaagggctttatattcaataaatggtgatgagacaactggctagccatatgcaaaagaatgaaactagtcccttgccttttaccaatacaaaaagatggagtgaagatttaaatgtaagacctcacactataaaaatcctaggagaaaacctgggaaatacctttcttgacattggccttggcaaggtatttttggcttagtccccaaaagcaattgcaacaaaaacaaaaattgacaagtgggagctaattaaacgaaagagcttctgcacagccaaagaaactatcaacagagtaaacagacatcctacaaactatgcagctaacaaaggtctagtatctggaatctataaggaacttcaacaaatcaacaagcaaaaaacaacccaattaagcaaaggaaatgaaaaggcatttctcaaaagaagacatacaagtggccaagaaacatataaaaaaatcctcactatcactgatgatcagagaaatgcaaattaaaaccacaatgagataccatctcgtatcagtcagaatggctattattaaaaggtcaaaaaataacagatgctggcgaggctacagagaaaagggaatgcttatgtactgttggcaggaatgtaaattagttcaactactgtcaaagaaatccatttggagatttctcaaagaacttaaaacagaactaccatacgacccagccatcccattactgggtatatccccattggaaaatagataaatataccaaagagacacatacacttgtatatttattgccacactatttgcaatagcaaagacataaaatcaacctaggttctcatccctggtgaacaggataaagaaaatatggtacatatccaccgtagaaaactacgcagccataaaaaaagaatgaagtcatgtcctttgtagcaacacggtgcagctgcaggccacaaccctaagtaaattaacataggaacagacaaccaaataccacatgttctcacttataagtgggagctaaacactgagcacacatggacataaacataagaaaaatagacaccagagactattagaggggagagggaaggagcaagtcatggcttgaaaaaccacctattgggcactatgctcactacctgggtgcaatatacccatgtaacaaacctgcatgtgtaccccctataactagaataaaagttgaaattaaaaaattagaacaaaacaaaacaagtacttatcttcatgaagttctaatgaggagatatcaatgacaaataaagaaaaaatatgtaaaataaataacaagtgctgaaaaagaaaaacagagtacaggggctagagttctagagaggttctattatagatggagtgatttgggttgactgggattaatcatcccaggattacattccaagttcagagctgtttctcttatgctaccattcatctcatttgtagttggggaatttagtcagatggacaaataattgcatatctttttttagggagagctcaacaatgtgacgctgtttatgttgatgctgttgaaatagtgtgtcagcaaatccctgtctttttccctgttcagtgtccttaacgggggaggggatgttgaaacctgatcccttccaagagtctaaggtatagccatataagccggagtcatatgaattggtagttgaatctaatgcttgtagcaatattcctgtcatgaacagaatacactaaatttgtcatttatagttttaacaattcttgagttatactattatatatgtaataggtcctagtttggttttattttacttaaacttacctatgtacacacttttaagaagtaaataattctataaggcttgttacaaaaagcatcagctcctgactgccctacctgctttccttttgctgggaacaacccccttttaactcttagctaattttttttctagttatttattaccatgcctctaattaacaggtttattttgctacttcttaatttttaacagttttttcagtacttcttgacttttttggttttatgtgttaactactgacttcccaaaatgagagctgagaatttgactctctttgtaaccgctttcccctccatccctcttaattcctcatcccaacataaagtaagagtaagtgattttggttggcccacccttggcccaccctgggtatttgaatatactgtattaggacggcgtaaacattgttaacacctgagccaggtcatatgtatgattttctcatccttttctacactctttaaaaaacccacttgaactagtaactgtttgcttctgttcttggtttagatttgtatgttcttatcgctaatctactctcaaattctcctaccgttccatttgatagcatcttgctttttttgcagggtgcaatatctttcctgcccaggtaagcagaggactgcaggatgctgcgactaggttccttctttgaagatccccaacttcattagtcttagattttattctcctttctaagattccccagaagactctcctccaattctggcctggagtatataaactgcccatatcagatgtgttattttatttaaaaataatttttgagttcttttattattgcaaaagttctgttggtaaaataaaactttagaaatgcaaaaaaaagaaaacagatatacatttttaattccactatgaaaacagaacaacaatttaattgcttaatttcttctgtttaacaaagaaagttggagttggcaatacagtaggcactgaacacttctgataaagcattaatgcaaaaatcaatgtcacatcaaatacataaagtggtcaatatttttgtgttaaaagtaaaaagcacatcttaaacattaactttgaaatagattgatgtgcaaatctaaatttgttttgcaaagccactgtttcaatggaaagcaatgcgtaggaagagaaatcatgtgacaatgtattccaccctagtaatatgaaatggatcaaggaagcagaaggtatatctatttaagtttgattgatggttcaagaggattttgtaagtgctattgtggatgtaaaagtttttctaagaagttggggagattatttcaggtaaccctgacagttgttcccatccttcaaagtctagagtactgcaataccttgccggtagagaagacactttgcagacggcattggagaaaaactgtgccctttactctcccagcgactgaacagatctcagtattgctattagaaagaaattagtcatgagctattggcaagtaattgagtaagatgtctgagtatttttttaaaagtttaggtgggttgaaaactctctgcaataatcttccagagcacaatgcagggaagggactggctgatataaagctgcctgttattaaattatcctgggatgggaagcaagcaattatggggttacctgggatggtagggagcagaaaagcaacaaatgctgagaaattagatgaaacaacaatttaaaaaaaatgaatctaaatccaagccaagttatcttgtagactgctactgaccaaggatttagaagagagcttttatttatttatttattttttgggacagaatcttcctctgtcacccaggctgaagtgcagtggcacgatctcggctcactgcaatctctgcctcccgggttcaagcaattctcgtgcctcaccctcccaagtagctaggactacaggcacgtgccaccacgcctggctaatttttgtattttcagtagagatggggtttcaccatgttggccaggctggtctctaactcctgacctcaggtgatccgcctgccttggcctcccaaagtgctgggattacaggcgtgagccaccacgcctggcctagaagagagctttttggaaaaatgcaaataacaatgctaattgtctctgattcttttaaattgttggtaggtgaatgtatctatgcaaatgtgcatcgtatataactttcagtaagctgttcattggataacggtgattcagcctgagttatctcaatttgttttctctaatgttacaacatttcaggtggtacggttcatctggaccagcctctgatgtggggaagaccaagcgagagcacactgcggagagtgagtcctggtcggtttgggtatggctctcagcagactgacccacgagggccagcagctgctggatttaattcgctgattttgtatgaactgtagatttccctgggaaatctgctatgcacacacaagtgagaaggcaaccatgagaaggaggccagggctgaggctctgcaagtgcacacggctcgttgcagaaaagcacgcgcctcccagcaggactgttagcccagagaggaagcctgctggggtttgagctcatttgtgttgtcagtatctcttatcacagcatcagattcagtgttttcttaaggaacaaaacacaggaaacggcttgctgtcattttctatttctctagtgaatctcctgtaactgaaagtcacaaacttctttctttaagacctatggcttacctttccaataagaagtgaaaggtctaggctgtcaatatttgaaattgaggggcaaaaggcagcctcttttctatcatgaaggaaaacatacaatgtggaaaagagttcgctttggagtggatttatcgtcatctaaattgaatgcattggtgaagattacggaattgatgtttccaaaattcgttgacatgtgcagatgaaaatacaaaggattatttttaatattattatgttatattaaataaacttgctgagattttttaagtttcaatgccttcggcctccagtagaacagttgtgattaaaacaacacatatgcttcccatttggctggttatgggaatattttgaaacaaggaatattttaaagttaattatacatgcatttaatgcccagttaaattttgaaagtatttaacaatttgcagtgggaggtaaagtaaatgtctaattctgccgctttctctgtggttcagtgaagcatcttcttggtcattgccctaactgaatctgagctaggatgttccatcacattgaccttgttataattttgaaacaggaattccagtaggatagaattgttccattctgttgcccctctaaccactccaaggtttcttgatgtatctagctcatgacagaaaagacaaaaaaacaaaaattactctgaagacgaaaagtcagcttgggaaagttatgtatgtttcctttttaaaagccttttaacctttggacttgagaaatgctttttcttgtcttttaaaatgtgttaagtagtcacatcttgaaaaggaccagataaaatcatgtttttcaggccagacatggtagctcatcccagcagtttgagaggccgaggtgggtggatcacttgaggtcaggagttctagaccagcctggccaacatggtgaaaccccatctctactaaaaatacaaaaattagccgggcatggtggcaggcacctgtaatcccagctacttggaaggctgagacaggagaattgcttgaaccagggaggcggaggttgcagtgagcctagatcgtgccactgcactctagcctggtcaatagagtgagactctgtctcaaaaaaaaaaaaattgatttttcatgtgcctaagattaaatttagggctcatctaaaccccaagggactttttatgtatttcacttggattttggacaatagaaatgaataagttggaatagatcggatgttacatggtggactctacctatagaatgccaccaaccatctcctttatgtgttgtgaatgacccaagccagatcatgcaagtctccataggcatgcctcttcttgtcagatacttctaattgagtgtgatgattttcctgctgagccttggtgtagctttacaaccctactcaacacagctctgtgggcagcaaagccagtgggcaggaattattaagtgagctgaaactgcttctctaacctaggctagaccaaacaataggaagtcaaggtgatatctaggagttgtacatattttcaaatataaaaatatttcattcatttggaggaaggtaggatgaacaaggtagacagtactaatatgtcagctggtaagtaattattcagtgccatttttgctgggaatttacctggatacagatgggcctcctggaagaatgtggcatttcacctcctctgtacagggacttatgacttcactgcaagaaaatagttaatatataacataatcagtaagcgttaaaacactccataatatgacaaactttataaatattattccaaccctctcactcgaaatgaaagaagatttcatagacaagaaaggcttcttagagacgatagtatggttcatgtcacaaatgttaaatggatgcagaagcatttggaatgtagcgtgcgggatgctatgagttggtgtgtctaaaaatgttcaacaaaatcaattgtagactttacctcacaagaaagtcttgacttttgcaatggagaaaagtggtgttttatagaaatactttaaaaacaatttttttaaaaattacaggtatttcagaaaatgagagataactacagccaaataattcacattaaattgttgattgaattgacaaagtaatttaatgtgtttctattagatgcaaggcagtgtgctggatcattgaagtatataaaaatgtatctgcttgtaaaagcagataatctagagatgaatgtggtagctaatgaaattacaaattagtttatgatatgtgcaaatgtgggaaataaaatcacaaaaacaataagtaattctaatcaagatacctgtcaagttcaaaaaagcttctaagaactatggtaccttggaatctgatttaattctgaaaatccaccacattaattatgtctttcaaatttaaaaactaagtttctaaatgcatcaatggcccttagaataaaaactcagaacatttagaaacccctggtaatgacaggatcatgtctaagtttaaaataatacggtttattctcactagcctgcagaattgtttataatctcaagtcgtacttcagaacatagacaaaaggccatccctttttggggtttagatagaaatagctgatttcacctgaactcagcaaccttgtaaatagccgtttctatgaaatatatctgctcacttggataagagccaagtttcacaaattactaatgctggatctaagttgactagtgaaacttattcccaaaacaggcaatgtgataattcaatattttgctgttgatgtgtttcgagagccagcacacagtgtgcatttcccggttgctcccagcttattttgccacagacctacagagaccagacttcaagatgttcctgtggacaggaatttacacaaaaaaccaggtgaaatttacttttttggtggaaaaatatatatgtatgactggcttaaagtcgttaagtgaggtgatcttaatgataggaccaaatccattagaaaactactttgcaaatgaagtttaaaaaattttattttcaactagtttttaaaagacttcaattcagtaaggagcacattagaaagatctcagtttatctcaagtataggctatatctaaagaaacttgattatttattaagttttctttcttattaagatgtcttggctatacagcaagaagcataagtaactctccattgcatattggatcccacgttttgtggatatgaaagagttagttttagaagaaatgtcataaccaaaaatagaaccaaatacatagctatgactgaagtaaagttcttgctgtatggtaatgcttcttgcatttggtcaatctgaagatgcgtgacatcaagcctgacacagtcagtttagcatagtctccttaaggtttgactatggaatgtatgaattcgtaaatctgctttctctttattgaatatattcaaacgtatcacagctattgatggattccatgctttgtttacaagaggagcacatggaagtacacaacccaggagccatattttcctcttactgccaaaatcactcttcagatatgatttaggtgcttggatatttgcatctagttcactttacttactttttactgctttgctggggcaatgctttccaacaataagaaagaatgaatgaattctagaaaaggatgagcacatgaccagatccaagcttggaaaatttgagttcatgatccattcattgttggaatgttcagggtcaggaggtgaaacttcaagtcctaaattctaggtctatggctaggcaggacatcttccttttgccttccagatacccactccacccttctccactctgctgtgtgctctggaggttgacctataggctccacatcaatgcacctcccttgctttcagactttgagttaggtccaaccaacagggagcaccacctggagactgaaggaggcagtaagcaggcggtacctgcctgcatctctctccctttccctgatgttctggcaactgcttcctcctgttactcccacaggccgaggagtactaattgcacctcactgtccccatctccaaaatgctgctctgacccctccgcactttcctataatccctcaccttataaacagtccctgtatcacgcttttggcaaatttatcggctgcccactgactatctgatgcaatctgcaatcacggaactcatactatttggctaaagagttgatgacatttgttgtgttgtcatggagtttgaggtgctggtgcactactttgccagataatcagacaacgtatccccattgtgggataggggaagcaaaacaaatgtttaactgttcaagggtattaattcagtcatggttttaaagacagaattaaaaatttcaataaaaaacatagtcatggctgggtgtggtggcttatgcctgtaatcccagcactttgggaggctgaggtgggtggatcgcgaggtgaggagatcgagaccatcctggtcaacatggtgaaaccccatctctactaaaaatacaaaaaaaaaaaaaattagctgggtatggcggcttatgcctgtaatcccagcactttgggaggctcaggtgggtggatcacgaggtcaggagatcgagaccatcctggtcaacatggtgaaaccctatctctactaaaaatacaaaaaaaaaaaaaaattacctgggtgtggtggcttacgcctgtaatcccagctactctggaggctgaggcaggacaattgcttgaacctgggaggcagaggttgcagtgagcagagattgcaccactgcactccagcctggtgacagagctagactatgtctcaaaacaacaacaacaacaaacatgatcatatggtttcacatactatttatttacaattccaaaacatcataaatacatcctatatttcatggttcagtggagttcaggaaaagcaagtatttgagaaagcaacttgaatcaaagaagctgggatagttctgaagaaagggaaattaacatctcccccaaatgcagatgctttccatgcacctgtactatagaattgtggtatggagatatggaacacgcaaagtcattctacacaacatgatgatggagccattcttcattttttcactggtctggaaaagactttgagaaatagggctacacttaagcatcttagacatatttctagaattttggagtttgctgagaaccttgaaaatattaggcactggactggtttgacctgccgtgacgtacaaggcacttaggtttgttatgtttgatacaagaaagcctttatgagactgttcaacagaaaatcttgaattttttactgatacccattaaattgcataagacaaatacagactgacaaacacatagcacatatatgatatttctttttttgaatataatggaggaaaacactgtttttagtctagttatcattagacttttgttacagaaaataaacaaattcacccagctctttgtgcatttatggcactgttgcttctcagacaccaaatgaaaatttaacatcctgtgccctcctttttagattaaattctcctgtgttttcttttggaaatgggatggaagtgaaaacaaaatgttgttctaccatatatcaagatgagggctgatattctgtccagagcttaagtaagtagaattgatttgctgaaatgctgaaatgcttgcaactttacacatttttgaaattttctttctgtgggatggaggcagagatcttgacgatgctcgctctctggggcttctgtgtatcaccgggtgaaaatggtctttccttatctggaattccccttcccttcccaccattatgtaaccagctccagcatctccacatggcaaacccttctcaatgcccctgcacacagaatttgtcctttactccttggtctctgcatgtgccccgtgcttctgctgtggcatgtgccacactgtgctttttaacatgtccgtcttgatgatatgctctagattcatctgtgggactgaaccttgtctttgatcactagcgcaccttgtggaaactaatttgcaggcaacagtgttgaactattcatctctattctaattctcatttatttgtggagagaatagaacgggataacttattctgtggttgtgaaaacctgagaattcaactggaatcgagttctcttgtaaaatgtgagtttgagggaagaaacggtgtgcaacttgtatgtgatgatatccccagacaacggtgcatccattatgtatcaggtgctagtctgttttgcattgctgtaaaggagtacctgagcctgggcaatttacaaaggaaagaggtttatttggctcaaggtcttgcaggttatacaggaagcatggtgccagcatctgctcagcttctggtgaggcctcaggaagctttaactcatggtggaaggtgaaggggagcaagagagagaaccagagagatgaggaggtgccagactcttttaaacaaccagatcttgtcagaactgatggagggagaattcactcattaccgtggggagggcaccatgcctttcataggggatctgcccccgtgacccaaacacctcccaccaggccccacctccaacacgggggatcacagttcaacctgagatttggaggggacaaacatccaaactatatcacatcagtaaatatttattaactaatttaagaaaaaaaacaaaaaattgatgtctttatcatatatcttgcttcttcctgtaaaagccatcaaactttccatttaaaaaacccacaatttttagccattttctgatctgtactttcttttaagcttgtgaacatgtccccaagaatgagttcacctttctttcaatgtctttccctttttatattggaaagaaaaggaaagcaaaatgtatgcatgtgcatgtatatgtgtgtgtgtgtgtgtgtgtgtgtgtgtgtgtagtttatcagaaaggaaaagctcaccttccttgatcaccctgagtttgctgcaagctgctgacggcagctaatctgacatttgtctcattgaagtggaagagcagatgtgttgcactggagtcctcttgcaggtcttccgttctgaaggctgcactctgcgtcacagtgtcctagacttgctgcagcccttccagctggtgagctgctttttttcttccagtttaaatacttccttggtgcagcctgagggttggaaggctgggagtgggagagagtttgttctcaaatttatgagctgtgagtgcagggaacttaagtgcggcagctctccagtcgacattacagatatgggtaaaatagtaatctttcctatcaacccacagcccataaaacgaataccttttaatggtgtgggcataattatcagatgtattaagttaattggacagacactgatgcaaggtcttagtagtagccgactgtggctcggtgcatttccttaacattcatagatcatatttcaaatgactgttgctgagagaactcccaaatatattcttggtcaatgtgatttctttctttctttcttttttaaaagctcatcatctccactgagccttaacaatttacattaaaaatgccatttggagcctccccgtcattttccctttagccttactgaaaaatgcttgctttttcacaaggttgcgacacttagaatcaggaccaagggttatggctactaaattccaagttgtcttttatgtacttgcttcaaagcaggcttatattttcttagtatcttttcctagcatatcggccaccaataaaatgaaagagaataatcctgactaaattcatagccatttttacagcatatctgatcatgccttttattgacagagagtaatatgcattaaagtaatctcttgaaagccttttttcaaaaaaaatttgttttggtctttatctttcctttctaagtgtctggaccgtgtataataggaagcataaattccctttccagtgactgctatgttcatgcttctcattttattttattcattctgttttatggactttgcaaagctgacttttggttaaccttatgccctctgaggctaaacttttgatttaaaattatttgaagctctcggctccctgggttgtggagtgcatatagatccatctatggcgttaggtgactcagagctaggaagaacggttacagagtccatgccagcaaccagctgttggcctcacaggtgcaaaggaggcagcactaggtgactgggggttacagtcgcccctggagctcagcgatggtgccagaggattcctcctccaaggtcaacgatgatacagatgtggatgcaatagcatggagcccatttcaaccaccttagcatttggctaagccattcatcaaaggcctcacatcaagccaagcctttctctgtcctccccacactggtctgggcagcagcttcatgcactagggcagtacacccctgtaagctcttcattctctcacctttctaggtgcttgttcctttcatttccctctatccatggggcttctttgtgcttcccttccagactttgcaaccttagtttgacatttattgcaactgtcaccaacattgtagacttccttatctcaacctttgactgtgattgtcatgccactttaggaaaaataccccacttcacttccccatccatattctctgctattgcaccaagcttaagagacttgaaaaagttctagacctaggatgccttggacctgtctcttctctctacctcagtaatacacaatcctgcttcattgcaaagactgacattagctctgaaaactcagttctcccaacttgccctgaaatgtgtatctctaggccttagctttgctctgatcgctatcccctttactaaataaattgatgctctttttatcaatgtgtaccttcatgtccaccctcccttttaatacagtctgtataggtaggaggagcccactgtttgatgtcagaacgtttgagtttgggacctggctcaatttcctgccaattgtgtgacataaattgttgaaaggcaaataagagtatcagtattacatgtgttctcgtaatatttttgtaagtttttttctacctttttattctccctaccagtgctctaggtcaagtttattcatggaaataccagccatgtcttcttaaaatcctgctttgataaaccgctctccccaaattaaactcctaagtgtaatgtttcaagtaataacaaactacttagggaatttatacttcctattatacacgatccagacacttagaaaggaaagatacgaacagcttaaaggaaagatacagtttaactacaaacagcttactgttacttattcaaatatgtattttcagatcttcacttttcctctaaattctctgctctcttcagatcaaatatcttctgaagccaccaaaaaactgtcataacttcccactcccaccaccaaccaccttctccttgcctcttttattccaatatattattcacagcccatgattactaactaactaggtaatattgaccaccaatttcatttaacatctacttgacacaatcatactatctagtgtattgcctcattcatggtctagaagtctgagttgtcttattattatgttgatgactttgtaaccccctggttactgcttaaaaatgcatgcctaaggaagccttcattctctttgccttggtttgctaacacataaaatgaagaacggtgtatttttctactcataggtcttcatgggattttacaagttaattgaagcattctgaaagcttcttgaataaagattaataaagacacatatttaaatatttgatggccagtttcatttttctcattgttactcttattcatattaagctattattatctttttctcagctttgtaaaacaattctggccaggcgcggtggctcacgcctgtaatccaagctctttgggaagccgaggtgggcggatcacgagttcaggagatcgagaccatcctggctaacacggtgaaacgccatctctactaaaaatacaaaaaattagccgggcgcggtggcgggcgcctgtagtcccagctactcgggaggttgaggcaggagaatggcgtgaacccgggaggcggagcttgcagtgagccgagatcgcgccactgcactccagcctgggcgacagagcgagactccgtctcaaaaaaaaaattaaaaaaaaaaccaattcttaaatgaaaggtcgaattgtgacaagtggtcattgtagtacagatggagcaaaagaaacccatgcatgatacgtgattctttcctccacgagtgtttatgtgcgtttcttcaatataggacggaagcaaggaaaaagaaaaggagaaaaggaagcaaaggaaagaaattctacaaagcaaatgtttaagaatctgctaacacattttaatgaagctcattaactcaaacgttgactcaacgtagactatttcacaatagaaccatatatgcccccagaaataatttttttttaatttagagatctaattgtacctttaatactggaagtgagtggaaatagtgttgctgtcgtttctaagtggccccgagaggagaagtaacttgcaggcaagttacaacatccagtttttaaaatttattttaaatttttttcatataaggtgaagatcttttttttattattatactttaagttctagggtacatgtgcacaacgtgcaggtttgttacatatgtatacacgtgccatgttggtgtgctgcacccattaactcgtcatttacattaggtatatctcctaatgctatccctcccccctccctcccatcccacaacaggccccggtgtgtgatgttccccaccctgtgtccaagtgttctcattgttcaattcccacctatgagtgagaacatgcggtgtttggttttttgtccttgcaatactttgctgagaatgatggtttccagtttcatccatgtccctacaaaggacatgaactcgtcattttttatggctgcatagtattccatggtgtatatgtgccacattttcttaatccagtctatcattgctggacatttgggttggtttcaagtctttgctattgtgaatagtgccacaataaacatatgtgtgcatgtgtctttatagcagcatgatttataatcctttgggtatatacccagtaatgggatggctgggtcaaatggtatttttagttctagatccttgaggaatcaccacactgtcttccacaatggttgaactagtttacagtcccaccaacagtgtaaaagtgttcccatttctccacatcctctccagcacctgttgtttcctgactttttaatgatcaccattctaactgatgtgagatggtatctcattgtggttttgatttgcatttctctgatggccagtgatgatgaacattttttcatgtgtctgttggctgcataaatgtcttcttttgagaagtgtctgttcatatccttgggccacttgttgatggggttgtttcatttcttcttgtaaattagtttaagttctttatagattctggatattagccctttgtcagatgggtagattgcaaaaattttctcccattctgtaggttgtctgttcactctgatgatagttgcagaagctctttaatttaattagatcctatttgtctattttggcttttgttgccattgcttttggtgttttagtcatggagtcctgaatggtaaagcctaggtcttgaatggtattgcctagttttcttctggggcttttatggttttaggtctaacatttaagtctttaatccatcttgaattaatttttgtataagatgtaaggaagtgatccagtttcagctttgtacatatggctagccagttttcccagcaccatttattaaatagggaatcctttccccatttctgtttttgtcaggtttgtcagagatcagatggttgtagatgtgtggtattatttctgagggctctgttctgttccattggtctatatctctgttttggtaccagtaccatggtgttttggttactgtagtcttgtagtctagtttgaagtgaggtagcataatgcctccagctttgttcttttggcttaggattgatttggcaatgcgggctcttttttggttccatatgaactttaaagtagttttttccaattctgtgaagacagtcattggtagcttgatggggatggcattgaatctatcagttaacaaggtgaagatcttttctgtgtctgccaataagttttcttcatctagtgactgtaaaggagtttgacaattctcataaattgaaaagttattgggagatacaaagttacatataaatttcaaattgaaggcccatcaataggattatgtttgtttaaatacaaacagcttcagctttccaagactttctactctggctcttgtgttaattgtactaatggctggtactgtgtgacttcttcatctctttggttctctggttccttctggaggtaaagttctatgattctattcatagcagttcctagtctgattaggttaccaacatggataagaatctgataaaagttataaactgtattttcagtgaaaagcacaatttcctaaaacatatgtgtgtgtgtgatatggtttggctgtgtccccacccaaatctcctcttgaattgcaactcccacaatttctatgtgtccctgggaggaatctggtaggaagtaatagaatcatgggggtggatcttttcttggctgttcttgtgatagtgaataaatctcatgagatctgatggttttaaaaatgagagtttgcctgcacaagctctctctttgcctgccaccattcacgtaagatgtgacttggtcctccttgctttccaccatgattgtgaggcatccccagccatgtggaactgttaagtccaataaacctctttcatttgtaaatttcccagtcttggctatgtctttattagcagtgtgaaaacagactaatatagtaaattggtaccagtagagtgggtgctgctgaaaagatacctgaaaatgtggaggcaactttggaattgggtaacaggcagaggctgaaacagtttggagggctcagaagaagacaggaaaatgtggaagagtttggaactccctagagacttgttgaatggctttgaacatgatgctgataataatatggacaatgaaatctaggctgaggtggtctcagatggagatgaggaactttttgggaactggagcaaaggtgacacttgttatattttagcaaagagactggcagcattttgcccttgccctagagatttgtagaactttgaacttgagagtatctggcagaaggaatttctaagcagcaaagcatgtaagagatgacttgggtgctgttgaaagcattcagttttataagggaagcagagcataaaagtttggaaattttgcagcttgacaatgcaatagaaaagaaaatcccattttctgaggagaaattcaagccatctgcagaaatttgggtaagtaaccaggagccaaatgttaatcaccaagacaatggggaaaatgtctccagggtatgtcagaggtcttcatggcagccccttccatcacacccttgaagacctaggaggaaaaagtggtttcctgggccaggcccagggtctccatgctgtgtgcagcctagggacttggtgccctgcatcccaggcactccagccatggctgagaggggccaacgtagagcttgtgctgtgacttcagagggtgggagccccaagccttggcagtttccacatggtgttgagcctgcaagtgcacggaaattaagaattggggtttggaaacctccatctagatttcagaagatgtatggaaatgcctggatgtccaggcagaagtttgctgcaggggcagggccctcatggagaacctctgctaggacaatgcagaagggaaatgtggggttggagccccacacagagtccctactggggcaccacctagtggagctgtgagaagagggccatcatcctctggaccccagaatggtagatccactgacagcttgcactgtgcatctggaaaagctgcagacttccaatgccagcccatgaaagcagccaggaggtaggctatgccctgcaaagccacaggggtggagcttcccaagactaggtgaacccaccttttgcctcagcatgacctgggtgtgagacatggagtcaaagggggtcattttggagctttctgatttcacatccctgctggatttcagacttgcgtggggccaatggctcctttgttttggccaatttctcccatttggaatggctgttatttacccaatgactgtacccccattgtatctaggaagtaactaacttgcttttgattttacaggctcacaggtgaaagggacttgccttctctcagatgagactttggactgtggacttttgagttaatgctgaaatgagttaagactttgggggactgttgggaaggcatgatgggttttgaaatgtgaggacatgagatttgggaggggtcggggcctaatgatatgatttgtctgtgtccccacccaaatctcatcttgaattgtaactcccacaattcacatgtgtcattggaggaacctggtgggaggtaattgaatcatgggggctggtctttcctgtgctgttctcatgatagtgaataagtctcacgagatctgatgactttaaaaatgggagtttgactgcacaagctctctctttgcctgccaccatccatgtatgatgtggtttgccttctgccatgattgtgaggcatccccagccatgtggaactgtgagtccaataaacctctcttgtttgtaaattacccagttgtgggtattctttatcagcagcatgaaaacagactaatacaactaataatatataatatattatatataattatatttacattattacattaattatataaaattatattttccataattttattacattatatacattacatatatatttacattgtatatctattttcttttaagctgctcagtgtcaaactcattgcatgagttttagggacaatcaatcctcagcaccagcatggaacccagaatcggcagaggccaatttgcagtctgtgacctgcacagatagaatgctggcacgtggcttcatcctgcttagtcccaggtcttgaaaccagagttagtgttgcaaagaagtcggcacagcttagcatttattctccaggcatgagctggagcagcattcaaggttctaggccagcaacagctgtttccagtggtgaaatgccgtgtccgatagcagaggagtcttaaccagtcttgcctgtggtatcgttttcattattgttttgaatcgctggcctcccttggttttataactgatttctgggatacgtaatatatttccagtaaattcagtgaactatccaatgtattgttaaattcctttctcacatgaattcaccagaattagtttttgctgtttgcaaagaagaactctaacacacataaaggtaaggaaaacattccgcctatagcttcagtgtttcagtgttttgatgagccccttcagcccatcacagattctgcttgcctctctcaagctgatggggttggtggttttctgggctgtgagggtgagagagtatctgcaaggcctgtgtaaggacacctgctctaaaaaggcgtgaactggttgggcgcggtggctcacacctgtaatcccagcaatttgggaggccaaggcgggcagatcacttgaggtcaggagttcgagaccagcctggccaacatggtgaaaccctgtctctactaaaaatataaaaattagccgagtgcggtggtgggcacctgtaatcccaactacttgggaggctgaggcaggagaatcgcttgaacccaggaggtggatcttgcagtgagccaagatcgcgccactgcactccagcctgggtgacagagagagagagagactctgtttcaaaaaaaaaaaaaaaggtgtgaatctaattagttgtttaaaaaactaggtggtgcaaagcctcgattttctgatcgtgctaatacaaggtaaaagtcatgagctggtgcatatcaattctagaaagtgaaatttaattaaaaggataaaattttaatctcaattatttactttattttttcaaatttatttgcttctgtttttttttttaattattatttttaagatgaggtctcactctctatcacccagctggagtgcagaggcattatctcagcttactgcagcctcgacctcctgggctcaagccattcttccaccctagcctcccaggtagctgggactacaggtgcacaccaccatagctggttaatttttgtatttttaatagagctgaggtttcaccatgttgcctaggctagtctcaaacttctgagctcaagccatcttcctgcctcagcctcccaaaatgctgggatgacaagcatgggccactgtactcagcccaattagttactttaaaacttgctcttttcctcttatttttcaactaatgaacagggcaaatctctgtctccactacaaagtcaatccagcagcgtgcctgagaaactcctcttctattgtctgcgagggcttgcatatgagctttcaattcatctgaaatagcaattcccctactgtgagtgttttcataaagactttcagagcagaaatacagagtgctttactatgttagtgtttccacctagtatctgccacaaagacaagttataaaaatcagcttcagaatgtttaggaagtaacagagagcctccagttgagtgtctacattaacaaataacgcacctcctacatacatgcatggccagttacacgcaaacattgaatagattttgttaaaatatcaatgactgacacttaggctaagacgatgaatggccaaccagtgaaatagtgtgtgtgtatatgtgcctgtgtgtgtgtgtgtgtgtgtgtgtgtgtgtgtgtgtgtgtgtgtgttaagagagaaaactcttttcctccaaggtcattaaggtcttttttcaaggtcacgaagttctagtagaacttataacacacttcagaggcaatcattattactaaaattttaaacagaaagaaactacaagcaatgggaagaagaagaagaagtgagtagggcaggttatatgctttcagaaaatacagataaagggaagacaaatcccagttttcttgaagctcgtttttattttttttatttttttgagatagggtctttccctgttgcccaggctggattgagatggcgtctctccctgttgcccaggctggagagcagtggcacaatcttggctcactgcaacatctgcctcccaggctcaggtgatcctccgacctcagcctctcaagtagctgggattacaggcatgcaccaccacacctggctaatttttgtatttttctgtagaagcagagtcttcctgtgttgcccaagctgttgaactccttttatgctttctcttgttttgattatataatctctttctagacagttcaaataaagtttgaaagtaggtttttcttttcttctttagaagccaatttcctttgaaacatggagacaaaacgctatgtcgtttatttattaagatctgttgttttccctcatcttttgtagtagctaaccacagtatcacctctcccgtatttactatactctttgcctgtagccagcaaagtaacatccacagaggcagtgagagaatgcttcttatgtgagtcttagaattatttattctggatagaatttgtttttaatgtttatggaagtgtccaaagtagaatctattccccaggtaggcattaggtacagcagaaaagacacttccactcaggcaggtgctgaaagataatctccgtgacaaagtgattctccatgagaattgagtctttagtttctctgctgtcaggggagttgttgatggccatttacactttttgtataatgaggacacctgtttgctaataattgaactgaggatatcacaacacagggcgtttaaaaataacatgggaatacaattgcagattacatacacacatgaatagatgtttgctgttggtagcttaatgggccatggctacgtatttcctaagtagctaaatcgagttacagattttgtagtatttattgcatttcattttaataagcagttattatagttgaataattacttcatcacaggtgtaacagataccacaggggtgacatcagtgaaagtgctttatcactgcttttcctgtgccatggggtaataatcaaagacagagcttaaaagaaataaaaagttcccttagtgaagcagattgagatttcattttcagtgcgacccagtatgcttgattgctacatgaataaactggtgtaggctagaaaccatacctctatggaagtgaattgtgttgaatgagggactaaagggaagaagatcacctgaatctggggaccctgttgctcctggagtagtgcagcattgggatatgtttttcctctagctggttggcatataccatatagagaggttggcatataccgtatagagaggttggcatactgtatagagaggttggcctaccttatagagaggttggcatataccatatagagaggttggcatataccatatagagaggttgggataccgtatagagaggttggcataccgtatagagaggttggcatatactgtatagagaggttggcataccgtatagagaggttggcataccatatagagaaggcaaatgctttgttccacctgaatttgtgactgtggtgcagaggatttcatggctaaaaatagaaaacttctcacgttactataggtctaaatggaggtaatattttaaagactaaaatcgatgttgataattacagtagtttatgttatatcaaaacatcaaaaataaaagtaaccgaataatcaaaggacctaacacccaaattaccaactgcctttgatctatatatactatatataatatatgatctatatatattatatataatatatattatttttttcttagaagcaattggcagaatcatggaatattacaaacattaaaacttatagagggctttaagaatcactttatttatcctcctatttttgtaattaaaaaataaggccagagtgttgtattgacttggccagtttccatagttaatactgagggataacacttccttaaagtataatagtgatatttgcacacaacaatctttctacttctctactttaaaacttcctatttaacttcagttcactctgaaaaaaatgaattttggcttgctctcaattttacctctttatttaccaaaatagagggtatctgtatcactatgtcaggtaaaaatctaaatttttggaattcatctaccattagtgtatatattctaaccttcattacttgcaggtaaaaatgtgatcatgctaacagcgacacccaaatctacttatctccaaatctccaggcggcaactcaggccagatcctttcccaggtaatctcaggaatccccgaagtggcaatgacttcctcaggaatacggcttttaattttctttctttccctcaaattcttcttggaggtctattgcccctaagccctaagctgctgctttaagctgctgctgtcgtattagatggtgaagtagagaggctacctgtggcttctccctgtggttacttgggtcccagcacagtgcttcttaagctcagagtctcaaagcattttcatgagcttttactgaatccttgagatgcagtattcagataccatctaatacctcccatttttctactcttgccttttactccttcctagtccccaaaagcctcttcgtttttcaaaaaataataaaaggcagtcacagaggatagtcgcagaggagggctgttgttcatttgccaccttggaaaaagcattcatgttccatctttgcccagccaagataaccttttaggaatattttgacatgcattttactttctgggaactggcaccaaagattggtcatcattactctaattaatcgcttctatttgtaagggtgatgaggttttgtacggattggccaaaatagtcaccattaagaaatgctttctctgttcagctaaaaccctatgtctgaagccacacaggaacggatagctttagtctgtggttctaatgcctcattttctataaattccaaatggacctgcctttttctgggccagtgacacggaaaatgatagttggcagtcgatggtcattaaaaaaccttcttggaatgctgttacagcagtgggcagccgttactgtcatgttgagagtgataaaggtagaatcatgggatttcaaaaatcaaagggaacttagaaataattttgttcaactcccttgtcttatagataaaagtagtcatgtaactatctgtcattttatacccaatttaaaagcttgtgacatccttctacaaaatgaaaacatacaatcaaaccaggcactcttgcttgccaaggtcctacatttgggcctcacatgctcattccatttaaccattgcactggcgaatgcagcagtaattcccagccatgacggacaaaaatcccaggtgcatttttgactctagtcatgaagtcattgacacaacctcaaaaataattaacattttcatagacaattccacaaaatactttcaccacagggaatatttttcagcaaaagatgatggttaggtagatatagcagcttcccaaatagtgggattcttagagcacggataaaatcagttgaaagctgaaaaaatatcttgaatgggcaaggaagaaggaatccaatgtaggaaagcttactttatatttccatggataaatgcaataacacttacgtttctgaaaattctatcagcatgccaacttcatttccagtccaacggattgccttattgccctgaatcatgttaagccagtcttggaacttcgtggctcccagtggatctccagctccttactgttcctgagagccatctgttgtgtgtaggtttccactggacccggcataaatatttacatgtgagttcatcttgaggtgggattatgcctaataaacccctggaattctgtaccaccccacgcatggttactaattttatctttctctggtatgtttagctgaagctggcacattgttcttttttttttctaatcaattaaaattttaaaaatggtgatcaaagcactggtggtcagtgagagcctagacagtaagagctctttcctcaggggttgaaaaatctctatctaaacaaataaagtggtcatatggtttgaaaatatttatagaggggccggccatggtggctcacgcctgtaatcccagaacttcgggaggccaaggctggcagattgcttgaggccaggagtttgagaccagcctggccaaaatggtgaacccccatctttactaaaaatacaaaaattagccaagtgtggtggcgcatgcttgtagtctcagctactctggaggctgaggcactagtatagcttgaactcgggagatggcggttgcagtgagccgcggtcacccccgcactccagcctgggcgacagagcaagactctgtctcaaaaaaatgtatatatctatatatactgccgggcatggtgactcatgtctgtaatgccagcactttgggaggccaaggtgggtggttcacttgaggtcaggagctcgagaccagcctgaccaatatggcgaaaccccatctccactaaaaaatacaaaattagctgggcgtggtggtgcaagcctgtaatcccagcaactctggaggctgaggcaggagaattgcttgaactcgggaggtggtgaactgagtgaactgagattacgccactgcactccagcctgggcaacaagagcaaaactctgtctcaaaaaaaaaaaaagaaattatgtaatactttttccatgagtcaaattcaaatgatggcgatccactggcgtgattgtaatgacacagtttaatcaaaggccgtcaaggtacgtacaattgactagaaccaacttgatcatagttaactgaagaatgttgtggtggctgtgttctttgtcttccgaagttgacttatgaaatcaaaacagtattctcctggacatatttaataatgcattcaagcaggcattttgccaaatccctttgagaccatattaaatggaaagatattttaagcattcattttgatgaatggagcataggtaaagaccttgttcaatccacagggtctagtatacaatgaaagcattgaccaacagataatttattacagtgcggtggaattaatttttggtacattgaatatttattttcctcagtgtgttttaaatttcagttttagaaaatttttgtgtgattatgaaattaatacatgttcagtgtagaaaattaggagaatatagaagaaaagataagggaaaaatcaaaagaaaatccaattctcaaaaatacccactatttttattttggtataaatatgcatacaattaatattttatcactcttgtcaatcatttcaaagatgttattcaaagatatttctacaatgttatttgcagttgaataatctaaatgaccatcaacaggactttgatgtactggcatgaaaagaggttgacaagaacctgtcaagggaaaaaagcaagaactagaaaacttttataataaagcctcatttttttgtatcaaaaattttagaagtcatgtagaaaagtgtttctatattaacagtgtttacctctgaggaagctgataaacagagcaggtttttttttataaccagtattcattttgtaataaataaataaacaactctagcttatgcttgctttgttagaacacagcaatccatggcatatgcagattgggtcctggtcctgtgactattaagaattatttacagatttaattttcccatttgaagataattgtgaatcaatgcaaagattccaagagaaaaaaaggtgcagctaaattattaacaggtaaaacactgtatctgagtggaaaggtaaaggagtgtagattacttgttgaaagtaggatatttgggaacaatctaacaacaaatatgtattgactggctactctgtataatgccccacttggatggtactgaacagaaatcctagatccacagaaaattgtaaaaggtgcctataattaggtgtcaggatttgccgctgatctggaaggccgacctctgaatacatacagagaagagtaactggtctatatgtgagctgaggtgatatttaaaacatggaacgccctggacagcacaggtgtggaccaatcagaagggatactggctgtggtcctggggtagagtcctggagggtctattcataccaggcttaaattaacttttcggttgctacacaggggtgagcagggggtcacagggcaaaggcctgggttgggggcagctcagtgagctatactctaaatcctgataagaattctaggaggtaggtgcaactcttcaggatgagtgtttgtagtacttgttgctactattatttgcctcttctagaacacgggtccgcaacccccaggccatgaaccagtgtgggaaccaggcagcatgcaggaagtgattggcagatgagcaagcaaagcttcatctgtataacagctgctccccatccttcgcactgcgcctgggctctgcctctggtcagagcagaagcagcatcagattctcagaggagcacaaaacctattgtgaactgcagatgtgagggatctaagttgcatgctccttatgagaatctaatgcctgatgatctgtcactgtctccccacaacacccgtccatggaaacattgtcttccatgaaactgattcctggtgccaaaaaggttgtggattgctgttctagaaaatatcatgagagtttacttacgaaacgtgttaaattaaaagactatatattaaatgaaaacatttgtagatttcagtcatttaaattgctgttttctccttaggctgtttgcccctctctatctcccggtcatgtcagtacctttgtacctgttctttcacatcaaatggaatggctgagttagatgtctttcatttcagccctcttgacaccataaccatgtccttttttctgaagctactattatttccagaagttagtatttccttagatgataaaatagcaatagtaacttcaacaatatggtaaatttagagttgtcctctggggctagagatgaattttgttattgtaacttttaactttaagaatacctgaacatttttagttaatttaaaccaccaaaaattcaattaacaatggatatgtttataagtaagctatagaccatggtgggcccttcctagtaacatcttactttacatgtaacaattctcttgagatgcagtatttcatctacttattgtgacaatctttcaaagaaggcaatatcgttcaaattttgtaaacaaggaaacagagggttagagaaatcaaactgcttgtcttaaagtacacagctataagcagcatcatcagagccaaaattctgtgattttttttttttttggctataaatctaatgttttttctactactttccactgccctgtttttgttttcttatgttttagtgttgactacaaataacagttatagctagtttggttttaagggacacaatgtttgaaaggcctttatcaatttttaaaatactttgtctttcagaatgtaataaaaaactcccaattacataaatgttgattcgctaggttctataacattgaatcatagtctcgaatggcaaaaatgaattaacacagtttaattcccccattttacatctcattttcatcgagaaacttgaaatgtgtaatgtggttcaaattccttgatgcatttaacagcccattgggttttgtgtgtccaataactgccaccacccctcaacctacagaagcagataccttgtgaattataaatttgtgcataatggaagccaattgccacatgttcatttggattttaataattcagggataatctgctacaggtagagtgggacagatcccccttacgtggcaaaattggaaaaaaggtagacaaacaattaataatgaagggttgaaattagcatctaccaatgtcattaatgctttgtcattcttacctggatttcctttaggtaaaggcaaggatttatctattttctttctactaacagtaagacatagtctcttttgcagtatcttgtatatctaaagaatctaaaatgtcagttagaacataaaatgctttggactgtagatgtccttacttggtgtttgtgctgggctaaataatacacctccaaggatgtccacgttctaatcccaggaacttgtgaaccttaccttatgtgtcaaaagggaccttgctgatatctcactatgggaagatgacctgattgtcctggtgggctctaagcatcatcgcgagacccttgtgagagggaggcggaggcagaagtgacctcagaagagggtgacgtggtggcagagagacaggctatgctgccggctttgaagacggaaaaggagacacctgccaaggagtgcagcagcttctacgggtgggaaaaggcaggaaaacagttctccagagcctcggaaggaacccgtcctgctgacactttgccttcagccttgtgagactgattttggatttctgacctccagaacattaagacagtaaattagcactgttttaagcaatggaatttgtggcaatttactacagcagcaataggaaactaacacaagcagtggtaaagcccattctggacttagctctcctctcccctgataagacctctatgctgtgtgcctcttagagatttccccatggtgtctttgtttctggacattgcaaccccataattcagagaggtaatcatagaaaggcatgtggataagaaccaggcattggttctgggtcttgatgaaaatctttctctgttaaaacaacatcgagacactaccatacacctatcagaatgatgaaaatccagagcactgacgccaccaattgctggcaaaggtgtgaagcaacaggaactgtcatccgttgctggtgggaatgcagaatggcacagccactttggaagacagtttggcagcctcttctgaagcaaaacatgcttttacgataggagcctgaaattgctttccttggtattcacccaaatgagctgaaaatacatgtccacacaaaaatctgcaagtacatgcttatagcagctttactgataattgcccaaacttggaagcaacaaagatgtccagtaggtgaatgcgtcaataaattgtggtacatccagacaatggaatatttttaaagtgctaaaaaaaaaatgagccatcaaaccatgagaagacacagaagaaccttaaatgcatattactaagtaaataaaagaatccaatctgaaaagggtacatactgtacaactgaactctatgacactctggaaaagacacagcttggggacaatgaaaagataatggttgccagggtttttggggagggagggaggaataagcagaaaacaggatttttaggacggtggaactatttcgtaggatggtacagtggtgcacacgttgttatatatttgtcaaaacccgtagaatgtgcaacactgagagcaaaccctaatggaacgtggactctgggtgatggtgatatgacattgcaggtgcatcagttgtaacaaatgtcccactcgaataatggatgttgagagtggggtggctgtgtgtgcgggggtgggtgggggcttgtgggaaatctctgtatgttctgatcaattttgctgtaagcttaaaacttctctttaaagaagagtgtatttaccagtaaacatttacatatatatatatatgagatatacatatatctatatatatttaacttagagcctctggcaggggacagcaaccaaggatccatgtgtctggttggctctagggaagcctgaccttcacagttagacttgggggttcccctgggaatacacagtgggcagccacctttccaaaggatgggatgaccaggccggattttggtacctcttctctccccgtcaccctgcttcacaggatgagggaatggacagatgaacagataaaccaagaagagacaccacattctctggcagaggagctctacaaagtgcagtaaattcctgggatcatatgagtgatgaagcccagaaattgcccagggaaggaagttagcaaacttaagagtaagtcctttggcccaattttaacggacaaggtaaaaagaatagttggtgtaacatctgaagtttggaaacacatgctttgtttaccccccgccgcatcctcaggcctttcaaaatgagaggatgcccactgtgagccagccgctctcttggcaagccggctggccacaaagaggctcagtcataatcgggtggaaacatacactctcccctttttattggcggcttgaggcttggtgattggcctataaatctaaactgcaagcgcagagcctgtgtttggggtcgtgatccgtttgccacaggcacactggtcctggctcgatttaccggccgttctgcctccgccctttgaactgtaacccatttgaagggctctgggggtgactttgctgtgcctcaatgatttatagaaatttcaggattcaaggttttcacctttgatgcacaattctccttttccttggaaaggggaccgggaacaaactaaactgacacagtatccaagcaccatccatttttgaacctttcaaactgtgcccagtcagttcgtaatgctttaggatgcgttctttcttaacaggctccttggctgtttgttcaaatcaacctcggagaggctttctcctcagttccgtgcatcttccttcactgaaacaaagtgtttacatcctacttggttgaatttttttccaggacgactctcagcccgatggctatagacttctcttgggctctgacatcggcttaccaggtttgactagaaatacacacgttccaaccataggcacagagaggacacagtttatgatcaagttagagttttattgcatatataggaaagacaaatgcacaaaaaggactggaagcagcagctcctgccatgagtgctgaatttgatgtatgattaaggcagctcacgggcatggggtgctgtgggatcctgagaagaagggctctgaagcgcaagggggacacttctatgtaatctgcactcacgctgttttttcactcagtgccctgcttcttggcactggctgaatctccatctcctatcacacatctcctgccccttggtggagagagggggtgagcaggtgagagaaggcacaggagaaggggaatgaaggtggaaggacatctcaggaaagtcccttttataatataaagtgcaggcaattcaggttgtacccacactagagatgccagggataccctctctgtggttctttgggtcctgggggtttggaattattgccagtgattatcagtcaatatgtgccatgaactttgtcatcatttatagactgaataaatgatatatgtcatttatttgtgctactgcttttaaaatataacaaaatagaaatttatttttaaatgctaataagttcatatgaatgtattatttttttgtttttcatctgtccttaatataccataataaaagtaataatagtaccatgatgtgaacatctggaagaaaagaagattttttgtttctcaaattttgtaaaaataggagtagataaattctgacatcttagaaggaccaaatgttttgttggataagtggtactataacttccccaaatacaatagatattttatccacacaatatacactttcattggatggatttggtttattcacaaacatgtgcaactaggaattagcctattttatttctttgaaagttagttgttaatcatccataggtatgtttttaaaaattaaaacataaacatgcctttccttttagaaaaacagtatatatatagtatacaagtaaatacagtatacaagtaaattatctacatatacataaatgtatatgtatatgcaaaagagagagataaatttcacaattctaccactcaagataattgctatcaatatctaggtgtatatccttctagaacttttaaaatagacacgtttatatacattatttacaaaacacaatatctcattttaggctatgtttaaaacctgttgtcttttccatttaccaatttaggattattgtctttccatgagaagacgtgttgttgaagcttggaattccctactaactcattttcaaaggaatctgtgattgaggtaaatccagttttctagagagaaagaggaaatgtcttttgaagccatgcctgggaagtatgatcagcgaatgttactgcacagatttttttccatcacagcttcctcccatctaaataattatgatttcttcccttatgccacttgttattccacgctttttattcattgtctgtgattaaagcctctttaattaggagctagagaattcactctctaattgaggactcatttaaaattcatgggcctggacttaggattctggtctttcactgcttcggtccatgtactagggtgcctatagcaacacacagcttcctatttctaaggttctttcaattctatttaaaaagaccctaaggagtacagacatcaaatagaactctagtatttggaagaatttagtttaaatgagatagaaccatgcaaactaaatttttgtcaataaaaacataagcttgcgcctaggggtttgagcactggggcaccagtgaagtgggccatccccctgtcacatgtcctgcgaggaggataagggaattctctggttttaacttaatctgtaaaagaccttgctaagaggatgaaaaagaagccacagcaatggataaaacatttgtaaactacatatccaacaaaggaatattatgactgtttcaagatttgcagaactgaataggaacagctccggtctacagctcccagcgtgagcgacacagaagacaggtgagttctgcatttccatctgacgtaccgggttcatctcactagggagtgccagacagtgggcgcaggtcagtgggtgcgcgcaccgtgtgcgagccgaagcagggcgaggcattgcttcactcgggaagcgcaaggggtcagggagttccctttcctagttaaagaaaggggtgacagacggcacctggaaaatcgggtcactcccacccgaatactgcgcttttccgacgggcttaaaaaatgtcgcaccaggagattatatcccgcacctggctcggagggtcctacgcccatggagtctcactgattgctagcacagcagtctgagatcaaactgcaaggtggcagcgaggctgggggaggggtgcccgccattgcccaggcttgcttaggtaaacaaagcagccgggaagctcgaactgggtggagcccaccacagctcaaggaggcctgcctgcctctgtaggctccacctttgcaggcaggccacagacaaacaaaaagacagcagtaacctctgcagacttaaatgtccctgtctgacagctttgaggagagcagtggttctcccagcatgcagctggagatctgagaacgggcagactgcctcctcaagtgggtccctgagccctgacccctgagcagcctaactgggaggcaccccccagtaggggcagactgacacttcacacggctgggtactcctctgagacaaaacttccagaggaacgatcagacagcagcattcacagttcacgaaaaaccgctgttctgcaaacaccgctgctgatacccaggcaaacggtctggagtggacctctagcaaactccaaaagtcctccagctgagggtcctgtctgttagaaggaaaactaacaaacagaaaggacatctacaccaaaaacccatctgtacatcaccatcatcaaagaccaaaagtagagaaaaccacaaagatggcgaaaaaacagagcagaaaaactggaaactctaaaaaacagagcacctctcctcctccaaaggaacgcagttcctcaccagcaatggaacaaagctggacggagaatgactttgacgagttgagagaagaaggcttcagacgatcaaactacgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactacgtgaagaatgcaggagcctcaggagccgatgcaatcaactggaagaaagggtatcagcgatggaagatgaaatgaatgaaatgaagcgagaagggaagtttagagaaaaaagaaaaagaaatgaacaaagcctccaagaaatatgggactatgtgaaaagaccaaatctacgtctgattggtgtacctgaaagtgacagggagaatggaaccaagttggaaaacactctgcaggatattatccaggagaacttccccaatctagcaaggcaggccaacattcagattcaggaaatacagagaacaccacaaagatactcctcgagaagagcatctccaagacacataattgtcagattcaccaaagttgaaatgaaggaaaaaatgttaagggcagccagagagaaaggtcgggttacccacaaagggaagcccatcagactaacagtggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagatattttgtcaccatcaggcctgccctaaaagagctcctgaagaaagcactaaacatggaaaggaacaaccggtaccagccgctgcaaaatcatgccaaaatgtaaagaccatcgagactaggaagaaactgcatcaactaatgagcaaaatcaccagctaacatcataatgagaggatcaaattcacacataacaatattaactttaaatgtaagtggactaaatgctcccattaaaagacacagactggcaaattggataaagagtcaagacccaacagtgtgctgtattcaggaaacccatctcacatgcagaggcacacataggctcaaaataaaaggatggaggaagatctaccaagcaaatggaaaacaaaaaaaggcaagggttgcaatcctagtctatgataaaacagactttaaaccaacaaagatcaaaagagacaaagaaggccattacataatggtaaagggatcaattcaataagaagagctaactatcctaaatatatatgcacccaatgcaggagcaccaagattcataaagcaagtcctgagtgacctacaaagagacttagactcccacacattaataatgggagactttaacaccccactgtcaacattagacagatcaacgagacagaaagttaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaaactcactcaaaaccgctcaactacatggaaactgaacaacctgctcctgaatgactaccgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagagaagcaagagcaaacacattcaaaagctagcagaaggcaagaaataactaaaatcagagcagaactgaaggaagtagagacacaaaaaacccttcaaaaaattaataaatccaggagctggttttttgaaaggatcaacaaaattgatagaccactagcaagactaataaagaaaaaaagagagaagaatcaaatagacgcaataaaaattgataaaggggatatcaccaccaatcccacagaaatacaaactaccgtaagagattactacaaacacctctatggaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaagagtccaagaccagatggattcacagccgaattctaccagaggtacaaggaggaactggtaccattccttctgaaactattccaatcaatagaaaaagagggaatcctctctaactcattttttgaggccagcatcatcctgataccaaaaccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctgtgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcagaagacagggatgccctctctcaccactcctattcaacatagtgttggaagttctggccagggcaattaggcagaagaaggaaataaagggtattcaattaggaaaagaggaagtcaaattgtccctttttgcagacgacatgattgtatatctagaaaaccccactgtctcagcccaaaatctccttaagctgataagcaacttcagcgaagtctcaggacacaaaatcaatgtacaaaaatcacaagcattcttatacaccaacaacagacaaacagagagccaaatcatgagtgaactcccattcacaactgcttcaaagagaataaaatacctaggaatccaccttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatgatactggtaccaaaacagagatatagattaatggaacagaacagagccctcagaaataacgccatatatctacaactatctgatctttgacaaacctgagaaaaacaagcaatggggaaaggattccctatttaataaatggtgctgggaaaactggctagccatatgtagaaagctgaaactggatcctttccttacaccttatacaaaaatcaattcaagatggattaaagacttaaacgttagacctaaaaccataaaaaccctagaagaaaacctaggcattaccattcaggacataggcacaggcaaggacttcatgtctaaaaaccaaaagcaatggcaacaaaagccaaaattgacaaatgggatctaattaaactaaagagcttctgcacagcaaaagaaactaacatcagagtgaacaggcaacccacaaaatgggagaaaattttcacaacctactcatctgacaaagggctaatatccagaatctacaatgaactcaaacaaatttacaggaaaaaaaacaaacaaccccatcaaaaagttggcgaaggatatgaacagacacttctcagaagaagacatttatgcagccaaaaaacacatgaaaaaatgctcaccatcactggccatcagagaaatgcaaatcaaaacaacaatgagatgtcatctcacaccagttagaatggcaatcattaaaaagtcaggaaacaacaggtgctagagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagtcttggaaccaagccaaatgtccatcaatgatagactggattaagaaaatgtggcacatatacaccatggaatcctatgcagccataaaaaatgatgagttcatgtcctttgtagcgacatggatgaaattggaaatcatcattctcagtaaactattgcaagaacaaaaaactaaacaccgcatattctcactcataggtgaaaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataataatttaaaaaaaaagatttgcagaactgtctatttaacccatagactcatgagcaataataaattattattgctttaaccagtggaaaacaaaacaaaacaaaacataagcttgcaaattttatattctgtaatatttccatgggctatataaccgcaggaagggcaaactatatctttatagaataaattgtagactggaagagtaatgaaaaaaactgagaggagtgtaacaaaataattaaaggcttagaaaacaatatccatggagcaactaacagaatcgtattcatcgcctttggtgaaatggctgttagtgattacaaaccgtgattacaaaggaagacatgttctatattggggagtgacaagctgttaactgatgcagaaaaatcacaaaacaagacctgaaagctttaaaagaaatacttatctaatatccctaaatgagggtttcctttttttcttttgagatggagtcttgctctgtcacccaggctggagtgcagtggcgcgatcacggctcactgcaagctccgcctcccaggttcatgccattctcctgcctcagccccccaagtgtctgggattacaggtgcacagcaccacacctggctaatttttttgtatttttagtagagacagggtttcaccgtgttagccaggatggtctcgatctcctgacctcgtgatccacccgcctcggcctcccaaagtgctgggattacaggcgtgagccaccgcacccggcctaaatggggattttcaaaaagccaaagtcatttataagaaaggcagtgaatttgaatgaaaaatacattgaaccagttggaagtcagaaggtctgagttctctgtggacactgccgctgcctcacttgtgatccttcatgcatcctgttgcctccgcagatgagcgtttactcatcttcatagtgaaatagcggactaagagatcaccactactccatcagcatgacgtgcatcgtcatggtgagatccttcctacccagtatggcagggcctctgccagttgctttctccagcatatttctttccattccttcttagaaacaaatcctgataccttcagctgggcatttttcctggaataaaagacgacacttctgagttttcttgtggcatagtgtggtcatgtagctatggtctggtaagtgagatggaagcagacaagttgcataggactcttcggaaggtgacttaaagggagcttactcagcttcaggggtgcctttttgtcttactttttctccgttaggcccaaaagtcagatgtcctggcttaagctgctgaagccaccttggaccatgagtgatcttgagaatggaagccactgtctagatgttggaacaaagacaatggcctgggcctccctgatgacaccgcagagtcaccgtatgtgtcctggagtacttgctctctgcttctttttcatgagagataagtacatttttatcttctttaggccactgctatatttttcccgttaaacacagctatatccaatcctaactggttcaacctataaaatgtgattatttcttgttttaagataactatagctaccaattattttgcacttagtagctgccagacactgtactaagtgttttatgggtgtcaccttatctaatttgcacaacaagaatacttacaaggtaggtattattatctataatttacaaatgagaaaatggaggcttagaaagcttacatagtatctacagggtcatattgaaaaaagcagagttctaaaccaggttgggatgaccccaaaacttgttctaatcttaatcactgttatcagtgtaatgcagttattatcctctgtgggtaaaagatgctattcctgattcactcacggcaatacgaaatatacaaggagcacagtgttggctaatatttctagagactcttacggaattgtcaagatgtagacaactttatgtccaatctgctccctgaacaagattgacaacaaagacccggcttgccttctgtatcacagatgacaactatccccaaaccttacctaggttgtcaaacattcacctttataagagatttgcaaacagaaataacactgactgcaaaactgatggcggggattaaataagaggatatatgtaaaatgcatagaagaaaatcaggtacacagtaaatgcttgatgaatggtacctgacggcaccattatttaagggatccacagtgagactgtgaaaattttcaggagtcagaaatattaggttcaaccacaacctctgcaacttgctagttatgtgaacattgttcagtcatttaactttttggcttctaattttctgaggaatacattatttatataacagaactgtaattggggataaagcctttccagtccccatcccagtgcctgacgcattttagaatcccagccaatgaaattcttctcactattattctcacagaattctaatgaacatactaccaacagtgattttctccttggcccattaaccacacggaagggagtattcgctgtggagtgcctctgtagctgagggcccctggcgcgtggtttcatcagaggcagacagctgcgtgagtcactgtggtgggcagtgtgctgggccaccctgcgggtcctgccagagtgctgtggaattcaagtttgtcttctccagttttagtctctgcacgtgcgttggtctcctttctgcccctacagtgtggccaaggccattccagcctcaggagggcaagaggaggcctgttggatgcatcctgaaaacacaggccatcactgtgggtgagatctaccaggacagatgccattctgcaaagtgggtactttccatgagaatccatccatgtttttctcttattccttctcttggcagattttcactcttttcacaaccttgtttcatagacatcaaacaataacacagcacagaaggaaaacaagggtcttcttatacaaataccatgtatttaattctggcactcatgatttatttatatcagaaagtcatcttaaatttttaggagctcacaacattcaaaacctcacacaaatttctaaactagtagagatgtctctgcatctcccactactttcttctgcatgtcaagtttcactttaggttagaatagtcatatatacccgttgatgggtgcagcaaaccaccatggcacatgtatagctacgtaacaaacctgcacattccgcacatgtatcccagaacttaaagtaaaataaaaataaaaaaatcacaacattggaaagccaaaaaaaatagccatatataaactttttcatcttaaaatccattttactcctaactgtcaaggaaaaacagatggttctaaactcctccttctaggctcctagtggtaaagcaatttgcaggacaaccatggaagaaaggtgcccgccttctctaagctgacatggccccgctccctccctcagtctgtagcctcaggaggggactgctttgcctgtgagtgggagggagctaccgtgtgagtagttcccaacagaccatctgaagtcattttcccaggtggcaggagaaacacagagccagacgttacactgcttttcaaagaggtaagctctttttttttaactgctatttaaaactccaaacaaaaatgaagctgtggatgcatgcaagaatgaagcctaagcaaaaataactcttcaaaaaggaagcaggttttttggagagggtgtgtgtgtgagggcggggcgggggcgagtccttcaatgtggttttgaaattaaggtccatgttctgtgataataagctatgtatcaatgagaaaggctgagattatgacaagaggaaaaggagtaaaggatttggcggtttaatcacgtttctattcttttttatatctgcatcttctttgaatgcaagtatcaagttctgtttggcttttgtggaaagccatttccgaagacctgccttacttgactgtttctccctctctggctctcctgttaccaacgtcctagagttgcctctgctgccccagcgaggatggcgacacaaacagcggtggtgtcagcggacagcggtggtgtcagcggtgaccgaggcagggccgagactccagggcccttcgggttcaagctgtgccccctcgcgcagttcagcacctgccagcacttccaagtgtgtgattgtcacgcttgcctgattactccttcctttgggctcccatagcaatttgtacattactgtggaattgatcaaattgctttataactagctgtttatgtgtctttaatctgtgtcattttggatggcaggaaatgctctttcggtaatttttttgtccacactgactggaatactggttggcacatagtaggtattcaacagttttttatcgagggaatgaaagctctctaaaccacagcaatcatttgtagacaaagactcttagggtgtaatgtgatttaacatctgatttttggaaaatagttactgagatcattccgacaataatagagtgcaataccctaccttgaataaaggatattttactcctttagtgtgacatataggtgtttgttaagcccagagattaacttcctttacgacatggctgagctggcccagcggtccatgtcaggatgtggtgccctggtttactccaggttcatagcaaatcatttttcctctatgaaacctctttcagatgatctttggagcctgtatcatatgtgcagggtcaaaaaacgggctggatacagtgttccacttccagggagcatctctagtttgagcccagaccaccaacccccagcaaggccctaatccatacagttaaatccttggtagtgactttgtcagtttccacctctggatctttaaggaagcagcacttcctgaatgtggcattgctttgtggagacagtgactgagtaagttaggggtgatccttgctactgctggtgagccaggcacccagagagagtctaccacttgctgcgtgagcctggcctgtgctttgtccaccaagctggtctaagcggactcacagaaggcagaggtattgtggaagctctgatgactgccccatctctcctttaggacagaagcacttactccaccagcttcttggaatgttggcagctgaaggggtggcaagcctttgctgtagctacaccacaattcaactcctttgtctacccaatcccacttccttcagttctccatgggtattgatctggagagaaactctcaaactttcttcttgcaaatttaacctcagctccgtttcttggagaacctcacctaagacaggtggcaactctaaccctcctgcatacctaaacttactgatagatttagggaataagagagggagacagagaatgaagctgatatcatctagactcatgacaactagttctgcagactcatgttcatctggggcactgactctcccagttagcaggaggactctaacaccagcttttgcctaaaccctagcctcttataagctacaatcatttagtcacgaccatagggaacttcccggactgaggtctataaagcattcataaaaattcagatcttcaggaatcatagcaggatagtaaaaaggcaaaacttttacctttaaggaaactcagattcaaattcttgctcctgcaattatgagataataacaccaggttgcttatgttgtcatcccaatgttcagtgtcatctgtgaatgataacaaaagccacctcaaataactcttgtgaggtttaagagaaaattatgcgagacttaaaatacaatccgtgatatataagaacacactggattttttaaattgagagattctaaggtggggtgctgcggctcacgcctgtaattccagcactttgggaggccaaggcgggtggatcacctgaggtgaggagtttaagaccagcctggccaacatggagaaaccccatctctactaaaaacacacaaattagccaggcacagtggcgtgtgcctgtaatcccagctacacgggaggctgaggcaggagaatagcttgaatctgggagacagaggttgcagtgagctgagatcacaccactgcactccagcctgggtgacagagccagactctgtctcagaaaaaaaaaaaagagattcgaactcctggtttagtacttagcccttgtttaaagactgtgcaacaggcttaataacccccatttcaaattatttaattttcagaattttttatgatagaaaaccattctagcttaccaaacgtcttctgtaatagcttctgctcctttctgcttcatggctatccatgctttctatgatgttctactaactcactgaatatttttttaaatttagagttatgaagacttattccaatccttagtgaattaaccaaactctgaagagaatattttcatctctgttcagtgggttctgtctgatccaggaaaaaaaaaaaaaagttttctgatggaactcatcaagagcagcctttatccctgccttccctggctccgaatgttgtgttgcttttaaagcagtcaaacacatgaaaaccagacttttcttagagctctagaacttccttcgtggtactcaaggcttcctgggaattccttcgtcgttctcaaggctgtcctggagcttccttcatggtacccagggcttcctggagcttccttcgtggtacccagggccgtcccggggcttccttcatggttctcagggccgtcccggggcttccttcgtggggagcttccttcgtggtacccagggccgtcccggggcttccttcgtggttctcagggccgtcccggggcttccttcgtggttctcagggccgtactggggcttccttcatggggagcttccttcgtggtacccagggccgtcccgaggcttccttcgtggtacccagggccgtcccgggacttcttcgtggtactcaagactgtcctgggcacacggtttctgtgctcggacacccaatgcctgaactcagcatctgacacagttcctgggtttccaagtgagcaaacgctttctctttgctcttgggcatgaggtcacagccttctcctttcccgtcaggaccgcattcccaggttttctccatttctctttaaaggaaagtcgtccgcgttgcttcctgacctggagtgtttagccgcggaagacactggcctcctctggagtcgctgtgcagagctgcgtcttcttccccctgcacagcgacagcgcagacttgcttccccccattcccaacaggcaccttttctctttcaaaggtcccacatatacgacttacaaggcagtaaaagggtaatatgtgtgccagtacctttcaggtgaagtggcaaataggagggcgataagggttaaatacttacctgcggcggaacgctgcagtttttattcgtttacataaacgaatacaatgtatatattagctcctgcatacgcggggaaaagtgagggaagaggagcgggagaggtggcggctgtgggagcggagcgagcaggttcccgggaggctgcagcacagaggccccacgcaggcgggctccccgcgctcggctcccgcctcctcccggccgttctctgttcttgcacttggccgcgcacggacgcgcatctctcctcgctgccggtggccatgcagaaagctggcttagtctccatcctaggtccgcatctcagtttttttgtttgtttttgtcttttttttttttttgtcacaaaccgaagtggggaaaacatttgttggagttcgttttttttcacaaggtcagtgtgtgcccattacccactgggaggaggacaatttgagcacacgatcacattgaatgagaagacgaaagacgtggccgggcgcgatgggtcacgcctgtaatcccagcactatgggagtctgaggcaggaggatcacgaggtcaagagaaggagaccatcctggccaacatgatgaaaccctgtctctactaaaagcacaaaaattatctgggtatggtggtgcgagcctgtagtcccagctgcttgggaggctgaggtgggagaatcacttgaacctggagggcggaggttgcagtgagccgagatagctccactgcactccagcctgggctacagagccggactccatttctaaaaaaaaaaaaaaaaaaaaaaaaaaaacagaaaagaaaaagaaaacgaaaacgaaagacataatgtcgtaatgatgatggacaattccagtaattaaaattattttagaaaagcattgatttcttttaaattaaaatatgcccagaagcttatattttatatgtatattcaaataactttttggttattcagtcttctttgttttaaaacacttgtgagctgacttttctatttatacaggaggatgttctatatctcagaacaataattgcgaatgccatataaatactttaaatttacaagagtatctctcactagctaacctacaattcctttagtgcaatagctggggaaaagagtaggattctagggaaaacagttcttggttttaacttcattatgttctgcagctttattatcattgaaattctccaaattaaaatgcaaaagctcagcttcttggctgggctgcttacttaaccttaataaaatataagggtctgtttcattaatcagaaatgcaccagacacagtgcataaattttatcttccactttgtcctttgtatttcagaatgataataataataataaaatcttgggtttggcaggacaatcatgttctctttgtttctatcatgtttctatgtaaaatagatttctcagacagactaaatgccttaaggggtaaaaattcctatgatcctgttctctggaaatctttaaaaatagaataaactttcctttgtctgggtgtggtttaagcacaggccatgtttggcagaaggattgtttaactgacctgctgatgttgctttaagctgcatgatcacttggatgaattttcccttaatccttgccagatttaatttatcacaacaatacttgttttatagatgttgtaaaacaaaagtcgggtgcaatcttctttttcattgtaaagtaatacaacagtttatttctcaaattggagaaagtaaaattaaatcaggaacatgtatgatgtgttttccttcctcagatgtctcctgaaggaaagtgaaatgtgctaaatagcatgccatttaagacaatatcttttcagacaactggaccaaatcagcaaaacagaaccatgtgttccatcagggccgccttcacgttgtgccgtgcatctgaggctgggcatctggacggagggaggagactgaccacgcggaagtgtgctggtgggcgctggggggacagccagtgggacggggtggagaagtggtttcacaggtgtgcttaccccgtgtcagtacagcccccgttgtgcatgcgtcattctatcctcttcccagacgtgccgtccagtccccctgcctggagtgatgtgttatgaaagtcttcactttcctaagaagccccaaagaaaagcataaggttatcattcagcacatcaatcactagcacacacgcgcccatgcacacacagagagaaggcgtaacaatgggtcaggtttttaaaaccagatttcatgtatagttaaattcaaagtcatattttcaagcattgaccaattcttttttctcttaagagagactccaaagtttctttttaacagttaagctttattggggtattgttcatttacctgaaaatacactcgttataggcatctaaatcaatgctttttagtgactttatagaattatataaccatcactaccatcccattgtataatgtttccatcactccaggaagttccctgggcccatttgcggtcaatttcctctcctctcctcagttccaggcgagcactaactgctttctgctctatactttttctaaacattttacataaaaatcacaccatgcaatataaggtctttgcgaatacgttgtttccttactctatactttttctaaacattttacataaaaatcacaccatgcaatataaggtctttgcgaatacgttgtttccttactctatactttttctaaacattttacataaaaatcacaccatgcaatataaggtctttgcgaatacattgtttccttactctatactttttctaaacattttacataaaaatcacaccatgcaatataaggtctttgcgaatgcgttgtttccttactctatactttttctaaacattttacataaaaatcacaccatgcaatataaggtctttgcgaatgcgttgtttccttactctatactttttctaaacattttacataaaaatcacaccatgcaatataaggtctttgcgaatgcgttgtttccttactctatactttttctaaacattttacataaaaatcacaccatgcaatataaggtctttgcgaatacgttgtttccttgctctatactttttctaaacattttacataaaaatcacaccatgcaatataaggtctttgcgaatacgttgtttccttactctatactttttctaaacattttacataaaaatcacaccatgcaatataaggtctttgcgaatacgttgtttccttagcataatggtttgaggttcatctgtgttgaagcctgtgtctgtggttggtgcctttttattgcctagtagtgtttcaaaatatgagtatatactttttttcccaaaataattttctggttgatagacatttggcttgtttctacttttggctattatgtacatgctgtttgtgaatatacacatacaggtctttgagtaaacataggttctcatttcttttgggtaggcaggtactcaagaatggaattcctgtgtcatatgctaagtttgtgtgtaacttctttttaagaaacagatattgttttccaaaacaactgtatcacttgacatctcatcagcaacatatgagagtttcagtttctccacatccttgctaacacttgttattgtctgaaattttttttctttttttcttttttttttttgagacacagtttcactccattgcccaggccagagtgcagtggctcggtcttggctcactgcaacctctgcctcccgggttcaagcgattctactgcctcagcctcctgagtagctgggattacaggcacgtgccaccacacctggctaatttttgtatttttagtacagatggggtttcaccatgttggtcagactggtctcaaactcctgagctcaagtgatctgcccgcctcgggctctcaaagtgctgaggttacaggtgtgagccatggcgcctggcccattgtctgaatttttattatcatcatcctagagggaatgaagtggatgtaattggatttacaatcacgcaatgatttttcatgttgagcatcttttctttctttctttctttctttcttttttttttttgagatggagtctcgctctgtcactcaggctgaagtacagtggctggatcttggctcactgcgacctctgcctcctgggttgaagcaattctcctgcctcagtctcctaagtagctgggactacaggcatgcaccaccatgccaggctaatttttatgtttttagtagagatggggtttctccatgttggccaagatggtcttgaactcctgacctcaagtgatctacccatctcggcctcccaaagtactggggttacaggcatgagccacccgcctggacattgagcatcttttcatgtactaatagtgcatttgggtatcatctttggataaatgtctattcaaattatttgcctattttaatttttattcttttttattttaaaattgatacataatagatgtacatattttgggggatacatataatattttggtacatctaaataaaccatagaaagatcaagccatataatatataaagatcaagtcagggttctttacctatttttaattttttaaaacattattgagttgtagaagttcttaatatatcctggatacaaattttttatgagatacatattttaaaatattttccattagtccgtggcttgtcttttaattttaatgatgtctcttgaaaagcaaaagttttaacattttcatgaagcccaatttatcaatttatcagtttttcctttatagattatgattttagggccacatctaagaaatctttcctgacccaatgtcacagatattttctcttatcttgccacaagaatttgtatagtttcagctctcatatttaggacaaggatccattttgagttgatttctagtgtgagatggtataagataaggatgtaaaattgttgctatttttgcctatgaatatccaattgttctagaacaatgtattgaaaaaattatcatttgtccactgaattattttgtctctgtgtcaaaaatcaattgaacataactataagggtttgattctggactttctattcagctccactgatctatgtgtctatctttgggtcagtcatttttgccttgattactgtagctttatagcaagttttgagactgagaagtgaaggttctcctactttgctgttcttttgtgagtgaagccaaatcattatattagtactactcctctcactataagcaatggtttaatttccacgcctgaaaaaaaaatgacgagaaaggggatcatctgcaaaagtgtttgggtctttttattgctgcctgtataagttagctgttgctatgtaaaaaaccacctcaaaactagtggcttaaaagaacaaccattgatttagatcccaactccccgggtcagcaatttgggatgtgcttagccaagcaattctccccgcctcagtcacgtggctgaggtccgtgcccagtcaccctggcagccctgctcctggggttgactggatgtcagccgggccatggggtcgctgggccatgtgtttcacattgccgtcagacgagcctgagcttgtttccgtggcagcagggtgccaagaacagcaagagggaagactttcccgtctctgtgtctcttctgctaaggtccttttggtgaaagcaagtgatgaggccaagaccagggtcaacttgggagggccttccaaaggcgaatacagggacacatgaactcactgaaggcattgctgggatccatggaccactgcttttaccaacttgcaggagctgctttgagagaaccaggtttctgggcatgagccaaatcaaagtttaaaccaaagtttaacaaacccactacttcaaagtggtactcagttttggtggttggtacttagtttggcgcagattgcccatagacagatccctgcatctctactgatggctagccctagtcatcaaggacatgggaaaataaaatggtttcttaccattttcctgaggatcacaaaactttgaggaaaccagaagacccaaaagtatatcctcaataaaaccaatctgggacccccaactccattctatcctcaataaaaccaatctgggacccccaactccatcccttcctaactaacatgattcacctttagaatgagacgatcttagggattttaggagttcatggaggctcaatatggctgctgtaccttagagctacatggaaggggtggtgccctcaccacgactatgactaggcagcagggcattcctggcattaagaagtactgctcatctgtaaataactcaaccacacaaacttgttttttcctggaaaaaaaaaatacaagcaggtgctaggtttttaatgagagacaaagctttatttccaaattcacagtcttcatacttcattattgccttttcgccatgtgatgtgggtcacacacaatgaacaactggcaattgttcacacttttttatattctggcaatgagtgccaaaaatattcctttctcttagtagatctttttaatcaaaaatctatagtaagtaatgctttattttgaactaaatcatttcaataggcaaggtgacagaactgtggctgaaatctgcaccatcaaattgacaatcaaatgtctatttttttgtggtgagctttgtctcacatcattgtatgatgtgctgccactgctgtaatgaaaatacctggactatttaagcagatgagtgggtgtggaagtagaagagaggaaggaagcagagttgtctgggcactgccctgtaagtacagttgacctggtctggagggcagcgctttggtgagcagtcctagttccttagcccagaacttaggggttaaaaagactctgggccagccaggaacaccaacctccatttacatataaattgggaaaaatcactgagcaaatagttttacaaatacaattcatttgtaaattggggttaatctgacatgtttatttcaggatatatagataagagctggatttatatgaaaactgacagactttttagctaaactaagcaattaattcaattccatgcagagagtacaataggcttcttgtttttctctttgatctgacaagtgtgttagttgagatgattattttgcagcattatgttgggatcatggataaggaattggaccagaagaattgaagttattgcaagtccaaattacttcaggcatcaagcgagagactagtttctcttcctttctttctttccttctttctttctttctttctcccttccttccttccctccctccctcccttcctccttccttccttcctctcctctcctcctctctttttcttttctttctttctttcttctctttctctttcttcctttctttcttcctcccttccttccttccttcctctcctcctctctttctttccttcctttcttccttccttccttccttccttcctcttatataaatttaaggtatacaagtgcaattttgttccatggatatattacacagtggtaaagtcttggcttttaatgtaaccaccacctgaatagtagacattgtacccattaagtgatttctcatctttttgggggcgggggacaaggtctccctctgtctcccaggctggagtacagtggtattatcgtagctcactgcagccttgaactcctgagctcaagcgacactcccacctcaggctcccgaatagctaggactataggtgtgtgccactgcacccggctaatttttattttttatttattttttttgatagaggctgggtctctctatattgccccaggctgatcttgaactcctgggatctggtgatcctcccacatcagccttccaaagtgttgagattacaggcgtgagccactgcgcctggtccttgcagctgccagtatataaaggagcttctgagaaatgtccttggtcagagacaggcgcagcagctgccttctggaatggtgttttaagtgaggcacatgcaggcttcgggttctgtttcatttgtggatgaagcaagaaagctgctgcctgacaaggatgagtggcttcgttaattaaattagcagtggaaattttactggctttaattagtgtaaaataagccacagaaataaagatagtgattaaagcatgctaatctgattagaatcacagtgtgcgtggttataggcaacttgatattagagaatcacagactaaggccaggaagaggcagagtcctgttttaaagaagaggatggttgcagatggcacaaaaacttggagctgctgcgggattgccaaattgcttggggaggattatgtgtgataaacgccatgaaaatcacggggcatcgttgaaagagccatgttcctaggaggaagggctttccgaccattcacagtgaaaggagctgaatccaacttcattgctttcctcagcagaggaagactttaccagctgagtttcagcctctcaaaatttcaaacatatggaaaatcgacagattagaaagattctaagatgtttgtactttctctttcctgacccatacaatgaaagcagtgttcatttaagacagtgagacacaggatattcaagtgtctgctgtatgagagaaatgctgtcttattaaattcaatgcaatacaaatcacatctttaaattattgcataaatcctttccaatgctcagttccttggtctaagttatcatagaactgattttagcttgagtgtggttacgtggaaactgtctattttactcccaccagttcccagccttctctcatttcccggtttgtaaaatttccatttgccccaaagtctgaatgttaaaacaggtagtctgtctttgtcattttctgtgtgtatatacagtgcattgtttataagactgttataatacttagatattcataaaccaatagaaacataacaaaatttgctattaaaacagaaaccaaagttttcggaagacacaaattctgaattaaataaaaacagtagcttatattgacttaggtttctagcatttggcattgactattttacatttttatttcttcagtatgggtttattgtaagaatagattttccttcagttttgcaaatgatgagatgtaatgagacattcactttggggccagtattatgacagaaggttatggctgtttcaaatcaaattagtcagaaaatagacattttattgtcaatttgatggtatagatttcagccacaattctgtcaccttgcctattgaaatgatttagttcaaaataaggcattactatagattttttattataaagatctactaagagaaaagaactttttggcactcattgctagaatataaaaaagtgtgaacgattgccaaaatacagctggatagaatttattcattcagttgtttatatggatctaatacattaattataaatcacaatacagtttatgcccctcacaaaatactatgtgaagttcaatttcagtggaagtgccacgtaagtggcaacagaaatagacttttttcagccaacgagtagttgttgagtagcccagaagatgcattatttgttctgtgtattagttttttataggaatatatatgatcctgtaaatagatagactatttgtctgtcttagatttttaagagacatattaataatgctacttgaagatttagacactaactaggtagaacatgaagtctctctgtaagttcagactctttctcttcctccctcgtcctcaacctgaaaaccactgaaagccactaggtgggctgagccaggcatctgcgaggtgggaccagtggcacagtgcaggtgcagctgcctgaacagacccagatggcctctgtgcaggctgcggggctgttgaagccctgggggcaagcagggtttttgcacagagagaggctggcgggatgcctatggatgttccatggatgggtgttgagtcggagcaggtgaagggccctccttgcaggaggcaggggtcggggtacagtgatgggcgtggaaggctgactggaagaggggaagtccataggttggggagggatgactgtgacctggcctggaaaggggtactggaacctaagagagagaacaaggttgtttgagtaagggtgttggtggagtgaccctccacggggtatgaacctgagaatggggtgaggagggcatcttgggtggaacaaagatgatggcatggcagccctgcatggacattggagtgcaagcaatgggaggaggcactggccctgggagcacagtggagaggccagaaagggtgaagagagcatcccagtgaagactgggggtggggacgcattacgcactggggcagtgaagataaagagagccgggtttctcactgttggaaataggaaaagggaaaaaactggagtgagccctgtggtattagatgggaattgcaggtgttggtttaaactcatggttttcagtgtagaactatagacaggtacctatggaaataactattgctgaagatgcatgtgtgggtacatatatatgtggagtgtgtgcatgcatttacatgcagagattcaccagctctgtccgatgagagggtctgagagcggtgacacaggcactcacacttagtctatttagcatccacatattggtatccaaaatccaggcatcagtctaagaaccaagacccctaggagaaatcgttattctagggatggatcagggaccttacaaaagaaacacgaggtatcttattgtgctaaaaataaggaggtactcaaagaatgatgaggacatttcaaaaggatatggaaaccaggtagccaaactggggacaattttagcatcaatacaaatgagaagaaaccttttccttactgtagaagactagctgactaatgtataaggaaggagaaaatcatttgtcagccatcacaataataatcaggcaagaaacatcaatgaatgctaaaactagtggcaggaagtttggtgaggaatgggatactgtctgaaagtatctctacaaagggataaagagtaactttacatctaagaaaccgacagacattaacttaatcaaatgatcaaggtgaaaattaccaaataggacaaatcaaaactatctaacacctgtttgggtaccatgaaaacacaacatcatatttgtaatatttctgccccaaatgcataacctgaatgcaatcatgagaaaacatcagacaagccagagtgaaggaaattctttaaagtaactggcctgtaattctccaaagtgtcaatgtcatggaagccaaggaaaccagcaatgccaaggaaaccagcaatcaaggagtcattgctggaaatggaagattaaagagacagagtcacctagtagagtcctggattacaccctttgctgaaatgcataatcttgacccattggtgaaacgcgagtggtgtaagtgaatcagagggtagtaatacattaatactaagttgtctagtttgattattgtactggggctttagaggaattttttttgtaggagatgcattctaaaatatttatgggtaatgatgcaatggaacagcaaaactgttagtgaaagtttgaaaccatttcaagagagaaaagaaaaaacatcaggaatccaaaacatctgttttctagagctggctctgctgtgagctggttatttgaaggacgacaaatcactccatctctttatgtctccatttcttcatctcttaatgttccatggaggttagttaattaattaatactgcatgtgtcatcgggcatttataatctagcctaatcctgggagactaagataaaataccaaagcaaggttaacataagtgccataatacaactcaatgtaatgcaagatcctagatttgatgatgaatcagagaaaattttgctataaagaacatgattggggctgggcacggtggctcatgcctgtaatccagcactttgggaggctgaggcaggtggatcacctgaggccaaaagttcaagacctacctgaacaacatggcgaaaccccgtctctactaaaaacacaaaattggccgggcttggtggcgcatgcctgtaatcccagctactcgggaggctgaggaaggagaatcccttgaacctgagaggtggagtttgcagtgagccgagatctcactattgcattccagcctgggcaacaagagcaaaacaccgtctcagaaattaaaaaaaaaaaaaaaaaaaaaaaaaaaaaaaaaaaaaaaaaagaacatggttggaaaaactgtactgtcttcatgccaaatttaccaaatatgatcattgtattgtgcttatttagggcaatattcttctcttagaaaaatatgctaaaatatttggggtcattactctcaaatgactcagcctatacatacatacatatatatatatatatatatatatatatatatatatatagcaaatgtaaaaaaagttaacaattaatggaagtagaatatgggtattcttttatgatttttacagtttttctgaaggtttgaaacttttcaaattaaaatagttagaaaacatagtaagtgggatagtagtgtatatacagtgctacaagaatgcaaggtaattatattcaagataatgtatctaattttatatgtctgaggccccacatataagctgtattggtgccaagcgcccacagattctgaagaacggcactggccacacacctccacaggagacataagaggtggcccagaccagattcagttcattagccccttgcaacccacgggagaaagagggaagattattctgaggcacagagtggttaggtaacttgtccagagtcacacagcgagtagcagagccaaggagtggaaaatcacacttttcccagtgcactttctctgtttaactgctcctctacgcgtcctgaataatgatgtgttgaactcagtttgaatgtttcatgttagattgttttgatttttttctatttttaaagtttcatttggaataaaaatgtccaaagaaacccaaatatatttggataattagtagtgaaatagccaaattgaaactttgctgatctgattacttctgctgccataattattgtgatttgtactccgtaatgattataaacgctttgtctggtcaatgattttgaagactctcagagcaatcagatctattatgctgcaacttggatggttaaacaaattttaagttttagaacacataaaacatacatcttaaaagaaacaaaacccattcatgcataattagtaggtctgagattaaaaaatgaaaaaaatggtgttgagcacactttctccaagtcctcctccaagtggcttttctcacgggaacaacatcacaagaaagacagcagatccacctgaggcatgacgagacagttccttttgagattagggcaatatatgtgttttagaagatattcaaaaataaaatcataaatattatctttctaagaaagataagggacagtcactgagttagacaaaaatattttgggaagaaaatggtgaaaactgaagtacctttataaaaatactgtaaaatgtgagtgttttgttattagaagaaagaggaaactgcataggtggagagaagctgggctctccacgtgaagtaatggtgctcttctggattctgccatttcgggtaaaccagtcttgcgtttttcctctgatatttacctcttctcactgtgaagattcagccttcaaagcagaacctgacaggttgtgctctgttaatccggccttctggggggctgtcaatagcagttgaataatagcaacgactctgtgagctcaggctgccctctgctctcattcgtctcaggcaagtggcagcagagaatgcgcatgagccattcagaacatttcacaaataacttacactcggagtcttgaataatgctactttttttttaagttttattatgttcatcatgaagctttaaaaagtcttttgcatttgagaggaaaaattatcatgtgaaaaatgtccagttctgcatctcgattatttaaatggtaatccaaagaagctccttctcagaagcaatattattttacacgtgccctgccagaggccactgtgcattgtcccaatcaaaaatcttgaagggattagtgtagcgaagagtgtgcaattaactatttctatttgatatgttcattttgatatttataatgtttgcttcactttctaattgtgtgtgtgtgtgtgtgtgtgttttgagacggagtttttgttcttgttgcccaggctggagtgcagtggcgcggtctcagctcactgcagcctctgtctcccgggttcaagtgattttcctgcctcagcctcccaagtagctgggattacaggtacctgccaccatgcctggctaatttttttgtatttttagtacagacggggtttcaccatgttgcccaggctggtcttgaactcctgacctcaggtgtctacatgcctcggcctcccaaagtgctggaattacaggcatgagctactgcgcccggcctcactttctaatcgttacttctcagttgtgaggcgtgttagggcctccacagacaggtaaaggaaaaacgggtacagatggaatcggggctaatgggattctccttgaggagtgccgtctgtacctgggaaaggctgatgttttgtacaacagtgtccgggagcagtggaaaccctggatacaaccgtggtagtgttgctgtcccagaggttaacctgttgagtaggacacggaagcagaaagtcactagacaggcgtaaagatgtggttagagaatgttatcttcttaattgcggggagatctgccatgaagtgaggccccagctggccgcgggagggtggagggaatatttccagcccttgaggctggaggtttgtaaatgcttactggatttggggtcaagataaacaggctacatttcagggtaaaatcccagtcccagtggcagaaataggttctcttgggaatacaaggaaaaggccagtcctcaggacaaaaagggtatgaccgggctttgctttacgcataagcggacactggattgtagatactgggttcaggacaggaaataaatccccttgtcctccgcggtagtcctgggatgcactgtcagctgggactggatcagggctttggttagactagattttcaggttgaggacgctgggtaccaggcacagcagcagcaggcaggagctgatacacggtaagatttcaagggtcagtgaattacctatttctgtctcagcccccagagcctcacacagcattagcacaaagtggatgctccaaatgggtactgagttgacatcagtgcatcggacagcacgtttccctaagtatacctaagtaaatagtgcaaatccatgtctagaatgcccatattgcctgtttaggatggttataggatctactcaaactcaataccttatttcttctcctagttttgagaatggtctttgaaaatattttcttttagtgttccactgaatgcactcaaataataacattaatttactttaaaattgaattaaaccccatacacatttctctacacctgtagattggttatcaagaataaaattgtggtgaagtttgccacactgaaatattagcattatggaaacaatatccaacacattcagagttagaccctgctcttattattgaaatgagatatttttgatgtatacaaatgatgctactgaaaacgattggaagacatgctccttgaacattaataggaagatttgtcccacgtaactcatgttccctcaactcctctgccttgtgaatgctgcctgtgcttacagatagtgatgaattgtgtcattaagggatactatgtttctttccacttgcccacatacaacaattcacaattcattataaccaagaatatgtatcttccatggcattccatgtttcttcttgcataagggttctgttaactaggatttcatttgcaaaatttgcactttctaaaaatttcttagtaattgtgaagtttaacccactcttatcgcatatttgaaaaccaaaattcagagaactggagtaactttgcctgaggtcaaacagttgctattgtgtgggtcttgagattctatttttcagactagcttttttcaccttttgtatcatctacctcggatttgcaaaccatggataaaatattttttgacaacatataacttactctttataagtataatttaagataaatataataacttaataagtataatataatttatattatattgtaaatattagaaatatattataaatatataaaataaatattactctacaggtgtagaataatttataaaccctaaggcaatataatttatgaaaccttaaggcaatataattccttgaggcattattaatgatataaacttgaattcaattcacatgacaatgatgaccattttaaaatacctttcgaagagatgcctgaacagggccaattgccggctgtgttgtcacacaaaatatggcttaaataaagctaacctgagttttcagaatatttgagtatgctaacataatgtctccaaaggaaaactatatatatttgacaaaatacatatatttttcctataaaatgtattatagataatatgtatatctgaaacaaatagatttgcatgatccctactgtgtacttttccccctttttgaccgtttagttatctaagtccactgtcaatttatataacagcaacctaactatctgaaatactctgcaacaagataagtcccaatgaaattaaatactgaaaggaaatattttttaaaagtagccaaatagcagatgtcttcttaatttccacatttgtggcattctgtggagaaattctccagataaatgtttacaatgtttaatcctcacatgaaggtaactttgacgtagacacttcccatattcgtccatataagaaactgaaagattaatgccaccactccagaaatactgatttaatcaacatttttattaaataaaattgattaaaactggtcttctttctcatgacctcatctcttacaatgtaactacattaacatgtataggggcatagtgttctcaatgctatcttcagatctatatcgtcaattacttactgaccattaagctcactattaatttaataccaacaaatagaagagatataattatcaagcattatcaattaatatgtacctagggccacagaatcatcaatttatagatctctgtttatctgtcattttcctttggagacattatattaacatactcaaatattctgaaaactcaggttagctttatttaaaaccatattttgtgtgacaacacagccggcaattggccctgttcaggcatctctttgaaagtatgttaaaatggtcataattgtcatgtgaattgaattcaagtttatgtccttaataatgcctcaaggaattatattgccttagggttttataaattactcttataaagataagaagaaattagctgaaaataactgagcctatactatggcatactaaacaatatctagcttatcagatagttaatttgtgcatataaaatgaatgtagaattatgtatgaggttaattcaactatctgtgtctgtagccattcatctacatattctagctcttgttcacatatccaatacatatttattgagcacctacttgactccaggcacattgctgggacagggaatatgacatgaatgaaacagacaaggcgtctgccctcaaaggtcctgttcagtgagaggggtgttgctgactccagttcctgctcccttgggaggcatcattcatcagtggagatatccttgccccagagcttgggtctcctcaaatgttgtgctctttgacaggtccaagaatgaacaaaactggcctgggaattaaaataatttgccttccctgggtgtatatttacatgtatacgtagtggctaataaattaggtgtttcaacctagacacccaggcacaattgataacaataatcaaagtaaagtttgacacagaccacaaaaagaagattattacaaatctgaacttttaacttcaaaactggttgcatgacttttgggtctctttgcaggattccttcaccaaagatcaaaatgcaaaaggtggaggaagactggaaaggaagttgtgaggaatgcagagaggatgtggagaggaatgaagggtgatgttccgcttagggagtcatagcacctccacccgaggccactgaggggggctttcaaggatgccttggcaaatttgcaggtaaagggccacagggcactgatgccacaatcatgcctgagaaagccgcaggggcttatgcggaagagagctctgtacccatgcaagttaataggagtgtgactactcagctcagagataatcatactggttccacttaaaaatgaattgtggccaggtgcagtggcccatgcctctaatcccaacactttgggaggcacaagtgggatgagtgcttgaggccaggagtttaagaccagcctgggcaacatagcaagactccatttcttgaaaaaatataaaaacaagcccaggatggtggcgtgcacctgtagtctcagctacttgggaggctgaggcaggaggatcactggagcccaggagagcaaggctacggagagccaggatcatgcctctgaactccaacctgaatgacagagtgagagtgtatctctaaaaactaactaaatcaaactagtaaaaatgaatcttgcctaaggggttttgcttccagggtaagggaacccctgtgatcacaggctggcaggatcatcatgaacagaagctggaataggattggaagcttcaggctcaaggaaaggcactgcccgtggcacaggagttgcaattgtgaggcttagtagaggcgcctttaaataactcacaaagcgtctgtgcaagaaagtcagctcgcaaacctctgccaggtctggaaagcagggcatctacttgtgaccgtcacgatcatgtaagaagcacaaacagtcatctggccactttgatatccaaccttccccaacctcagctgatggaagcaggaaggacacttccccctagccctcctaagtataggctgagggcagggactaagatttaacttcaaatcaagttagcgctttctaacatcatctggaaaaggaaattttacattactggagatcgtatttgctacttgaaggtttcatgggcctttctattatctaagagtgatccaaaaagtagtggcaattgtctgcattggcacttaagggcagggactggaccgcaagtattgaatgggtttcatgggacagtgggaagcaaaaatagaagtgcttatatcattcattcattcatattagcgtgcacttattgaagactcactgtgtgccaggcactgttctaggtactggatgtttgcctatgggaaaaaatatgtagaaacatccccagattcacagcatgttatagcagggagtgtgtgttcaacgtcctgaagatcatgttcacacacagatggatagacggtagacgacggagtgagtaactcacacaatctattcatttctctatcacctctctcaagttttcatggaagctaggctggtggaactacaggaaatgtgattctggttctctctgtagattatagtgaggttgtctatgtcctatgctggtcttcacttaaatcgtcagattcttgtatcatgatttctaagtaaattgcagaacttttacaaagttccactttaaaaatactgctcttccagcacaatttgccattgcaaaaatatggaaccaacctaaatgtccaccaaccaacaagtggataaagaaaatgtggcatttatacatcacggaatactactcagccataaaaagaaatgaaataatggcattcgcagtaacttggatggagctggaggccattattctaagtgaagtaactcaggaatagaaaaccaaatatagtgtgttctcacttataagtgggagctaagctatgaggatgcaaaggcataagaatgatgtaatgggcttcagggacttggagggaagggtgggagtgggctagaaataagagactaaacattgtgcaaggtgtacactgcttgggtgatgggtacaccaaaatctcagaaatcaccactaaagaacttttccatgtaaccaacaccacctctcctccaaatgctattgaaataaaaattctaaaagcaggaaaacatcctaaaaatgtttcaaaatcctttctctttactatgcactaattggcatagtaattggcactccctatccaaacactaggtcaaactctgaaagttattttgtcaattttctatatatacatacttcttaaataaaaatgtaatttacaaaataaaataaaatactgcttttcttcaattatgtgtataaccaaactgtagttttcctaatttacttttgaatatgttttgctacaagtttctgcttaaaattgtttctgcagggtttattacataaacatgtgccattttcttgctctttcataggcaagaccattgagaagatatttggaccctggtggcagttttttatgggttcctcagcagggatgaattagcgcaatttgtgttacatgcaatacaagcaggttctgggtgggtgatttcctttgatcactttccttcccccacctctcctgctccccgcaaatactcatacacagcctgccttgcaggtcctattagcacagaaatggaaggaagagctctgacttgtgggaaaatgttcatgtggaatgctctacgaccacatgaaagctctgaactctagtgtatagccgtctgtctgaaaaatttgccagaaaattactttatcttcatttatgtgtggcagaacaaatgtaaaactaatggaatccaaattttaaagtaggaaaatgtgatcatttagtagaaggaaagtgaaagcattttttatttaaacattaaaatatgattgattgacagttaaaatgatacatttataaaatatagaaaacttacaattctgctgctacgtatttgcttattaaaaacttgaaaaggatcatgtctgttttgtactcataacattgttgctgtcactcagtttcaattccagaagcttcattctattgatgttctttacactgatatttgaaatgcgtgttttagttcttacgtgtaagataaatgttttagtttatgcaatttcaatgttttagtttatgcaatttagccattattaaaaaacaatttggttgaacagtgtttattacatattcaaccacttttacttcagaatattgatagctaacctctatcaatttaagccagttcagcaaaaatactattgctttcttacgacagaccagatacagtactagtttttgtgttagctaaaaaatagtactgcctctgaggagcttgtcatccaacatgttgtaaggaaagagagatgtaaatttttaatttacacttttataatgcatagtgtatacatttataacttcagtaaaatgtgtaaggtctgtggcaaacatggacagattgttacttatctcttcctagtttctaatctatatccaatttctattaataacagagagagcacttggacatgagacaagaggctatgataagaggtatgcataaaaatgatggtggggtgttagaaggattgtaaatgctgatggtacacatgtggactgtgaagtgaagatgtgaagcttcaggaaagatgcgttaataaacaacatgtattaaaatactgattaaaatcatctgattaatccaacagtaaatgctctagaggcattaagttgaaactctcagaattattatctacttgaatcttgttaatttctcaaatacttctaatatattatttactacttgttagtttttaaaatcacaagagtaatgttatttgcacatttatatatatatacagctaaagccaaactaacgaaataataaatcttttcttcttccaacaatctgtcctctcttcctgaccttacttgattgttaatgatgatgcagaagtaattctcaggagagactgcaatagtacagtgcctggttttgaagtgcatattcagacaaaattccctttgctcaccactcggagctaggattctgagaatcacacacatcaaacacatatttcaggaaaagagactatgtcagccagccacgatagaagacacgtatgtagtgaagggagtccacactctcaaagccgaagcactcaggaaaatagaaacttatctgttatggggccaggaaatttaagaacataaaatatccacagaacttggcttcatgtaagcatcaacattatataaaagacaataatacatgtcatcagtttcaggagtaaaattaagagagttttgattggatgagcccacagcgattgaaatcaaccgacccataggcttttgaaggccagaatgatttcctatccagagagcataagtaaatcagaaatttgcagttgtgtgtgtgagccagcatttcaatataaataacattaaattaggcatggctactctactacatattgccatatcttcgtctcaccttccgttttctatttctttcttccctccaggtaaacaagatagaatcagggaatcttaagacacgtgtgtgtctgcgtggaggtgaggtcacaggcagagaaggcagtggagtgtccgactgggtgtaagagtcccggtgagagtccgaggaacccatagagacgatgggaaggtggaattacactccttttacacatcacatttcacactcgttttcgagttctaatttttaggagctccatggcattttttgaatatgactataatttgcttctcagaagcattaaggcaaatattttgagggatgttctatgtgtagctttttttgtgacttttcattcttgggcagaggtttctacaatcgccagctggttggctatctatgcatctctcagtcattgttgtcactttcccaatgacaggaaagtatgatgctatgtgacagcccattgttctgatcttccttcaacctttctttacaagatatttcctcatataatttattaatctaaagttgaatacactctatggaacagttcctaatacttttagacaaagtgtatcatatcaatttcatacctctacttatctgaacctaaaatattttctttaagcctcttgtcagcagttccttattctaggtaatatttgggtaaaaagctataagaatgaaatgtggaaatcattgtagaggtaaaggcttttactgtaggtcatagtgggttgggagtttgggtattccaggataattctacaggtagaattctgttagatggcatcaaatatgttgcaaatagaacactacccttagagatatgccagctttatatagaaaagtggctaatttatgtagagatccagttctgtctctaatttcagtaaatttagacagagaatctgtagcgtatatacacaaataagcttgctattggaacactgttctaatagtgagaccatctggaaatatctttggaacgtataaacattaattccttctagagaaaaatgttcattttccatgtctatttaattcctttttttaaaaaaaaaattttaggccttctgaatatgtgagatgttagctaaaaatgtaaattatgttctaggatatttggaatttacttgcctttaaaacaccataaccacttcaaaagaggtacttcttgtctcgtttgtaattctgtgatgtaaattctgaagtttcacacattgacaatgatggttattacagtattaacatcgccatacatctctttggttagtttaccagctcaattaatcatgcttcattttcttttgggctctcatatcagcttctcttatttttgaatgaaatgacttctgaaagagaacatcctctgaggacacactaattctcccacctttacggaaattccttctcagaaggggcagatttgctcagcactgaagccacgtcccagaagcctggggctccgtgtggagggtgaatgctgatgggagcctggggacctcagcttctaaagcctgtttctgccgctcaccgcggggcctgcagggctgagcttcatctttctgtgcttcatttcactgtcagtggaaagagcataatatttttatccccagtttcttgtaagtcgtttatttttcaatttctataacgaactctttgttcatattgaagcaaacctgtattattaataaatgatcccgtcacaatgaaacattcccctggctctgcagagagccgagggacagttctgtccccggtcaccagcgctcccctttcttaactggatgagccttacttacactgtcccctaaaagtcagtacgcagaggatttgctgactcagtctgaaaggacaaagtcccagagtttcaatctacccatttgaaacagtcattctctagtccttagtagaaataacacctgggagcctttagggaagaataaaatcttaattttgctgagagccagaagttttatccataatacctgtcttattattcaataagccatccagagccacaggagattggaagtaagtcactggctcccagatgttctcacagccatagtcttcactgcctgcgaacaactcaagaaatgagtctttcttctgttgctgtttgttcatacagaacaagatgagacgcaagcctcctgcttaattggagtattgaatttttgaaaatgtctggtcattttgttctttctcttgtttccatctagtgttgccactctaattagggaatggcagtgctaaaaatacagatgttaacaccaaatcagtccatcctaattatcactcaaaaatcaaacattttttagggaggcaaaaactgtcatgagaactacaatttgatttggagactatttcacttatacagtttcttcacatgatgaccagccttctttctttagtaatggttattactatggccattgctgttaattctgtgacttatcacttcccatatagacccaagcactgagctaagtgtttcacaggcattatcgcatggagggcactcaacaacgctatcagctggccattgttatcatcctcattttataggtgaggggttaaagaacacttccaagatctcatcgctggtcattggtagcaacagggtttaaaaccagatttgtccaacttcagaactgtgatctctctcatttgcaaccctgtctgctaagtaacatgatacagaattggttaaatactttccatatgaatgtctgcaggtttaggatttaaatcattctctaaaacggatttttgatataataaaaatgaccaatgtattctgtaaattgtattgcctaagtgtgggaagaagggctggaagcaacgcagtcattgattctgtgggaaaggatggacgtgagagacgcagccggtcaatatagtctgttattaatttcgaatacccaaatattagtcagatattgtttgtgtttctcaaaagtgtcatctaatttttattatttttttaaataatttttttattttcacttaagtaatgcatacatatagtaaatacttcaacaataaaaaacaaaggacgtaaaatgggaaatgcctaccttccctgtgttctgcctccccctactctctggttttctgtccaaagtcaaacacattcaattcctttagctcattccactggtagtaagcctccatattgctaaataatatgctcattagtctattgtctgactttttaattgctgacattatttttatctttattttaaagtataatatgaatataattatctcacagttttgacaatgtcaacatagtacaatatagttcatagtattctagaaaggcacacactcttgtattttttaaatatgtaaatttcttccctcttctgtctctgcaaggcctatctctaatttctctagtggtggggtttgttctcactcagtgtggagatctgggtctcttttttttttttttttttgagatggagtctcactctgtcgcccaggctggagtgcaatggtgcgatctcggctcactacaacctccgctcgtgggttcaagtgattctcctgcctcagcctcccgagtagctgggattacaggtgcccaccacaacacccagctaatttttatatttttagtaggacggggtttcgccatgttggccaggctggtcttgaactcctgatctcaagtggtccgcccacctcagactccaaaagttctgggattacaggcgtgagccactgagcccaggcgagacctgtgtctcttattgtatgcttattgtgttctgtttcgcttttgcgtctctttctgcattccagattttctttcaatgattcactctttcactataaacttcctttcaagaacaaggcatgagataccgtggaggagctcgagttgttacgagcacccttgttatttggtggagttgcgacagcacagttgggtttaatttagcttttcccctgggcacctccaaatgtcagtgtctggaggtctcaacaagagaaagttgaggatctcacagttctgtttccgtatttcactgaatcccccattttctacctattgctcaccccagctctccactatgtactgtgtccccaagtctacagcatctgttcatccacaaaacagcttccagcatcctgaggtggtgaggggtgtggttgagaaggtcatcggttttgctggtgaggggcaggagttgaccactctaatcacaggcattcaagcgagtcctgtggataaagtccggcacctgaagcctgcctcctgccagacccagcacctccagctctggagcatcttggggttctaggggcacctccagctccggagcatcttggggttctaggggcacctccagctccggagcatcttggggttctaggggcacctccagctccggagcatcttggggttctaggggcacctccagctccggagcatcttggggttccagggacacctccagctccggagcatcttggggttctcggggcacccagctcctgcttcactggatttgccgactcaggtcatggggtgtaaatgaccctgctctgcttcagctgctctttgtcctccaaatatttgggttttctatctgcacttttctcttttctcgttgtctttgctctaggtgttaacaacttttacattttattattttcatttaaaaacatttgaagatagaagagatttgtgtgagagagtagagtttgttttttaacaagaagcaaatttatccattatttatttggttaggagactttaatacacattttaactcattacagatcatcacttaggatgtgaaaagttttgtgggacttatagggaatttttatgctcccttaacggaacaattcaaatacataacatcgagccctataaatcgcatggcttttcaagtaaccataagatatttatataatgtttccatactcaggaacacagacaaaacttcaatgttttctgaaacagaaatagcatacactactcctctaaacatgatgaaaacaatctataaccaaaagaaaaacattacctgaattcttattatttgtatgaatgacaatgaaaaaaatagtaagaaacatagagaaaataaaataattattggagtagctttgggtgaactaacgcaaacgtaaaagttgataaaatggatgattttcatgaaaaacatcaattagaataataaaataaatatattcaattttgaccaaattcaaacactacaaataaaagctcttttccactaaaatcaagtccagtttccctctttttaataataaaatattactaatttaatggtttcttcaatgatttatagactatatgtaacatttaattcctaatatttttataataaactgtggtccatgtttctttagtgggatggctgccggttgtagagccctggtgagcaggctcagcatcatatgggaagttgttagaaataaattcttgggctctacccatgacctactactgaatcagaaactctgggacagggggtcagaaatctgatgcacttttggccaggcatggtggatcacgcctgtaatcccagcacattggatgctgaggagggcgggtcacttgaggtcaggaattcgagaccagcctggtcagcatggtgaaaccccatctctactaaagaggcggggctatttcttaagctgtgtgccactgggaaaataactggtgctctctgctcctcaattttcttatcagtaaaacagggattagagtgtgtgatcagctggcctcctaggcttctgaacattagtgatgaaatgcagaaacaagcttaaagtacagtgatgcctccagaaattggttctaccaagtgttagaaatgccagagcctgcaacattctccctcctgtcttcctttggatgacctcaaggcaacaaagactggccctgtcttttcctccctgttctaccgtctctggtcagtcactgctcttgggctgcatttcatcagaccttgccaagaaaatggagaccagggaagccgtcctactgggtggagcttctcttttggaggagtgacccgatcctaggatggctgtgttgtggtgccctattaggaagaagggatgtgtctggaagcactagtccggacaaaacaatagtctctctcttccagccaattctcagcatcctctgcagggcaagcttgtcacccagctgtgtcatgatggctaaaagtatgggggggcagacaacacagcctcaagcacaaccacctggcactaatttgaaaaccccagggctgtctgggggaaatgctgtgatatttcccattaggcgaaaggcagcttaacattcataatttgattgagaaaaatggagctattttataggccagtaggctccaaattgttattctactcagatctttattgcttggcctttcttaatttaataagcaacctgtatctctcgtactgaagacaaatagattctataagtgaagatctaaaatctgaagtgttaataacagaactaaaaatatagttttgtttatttttctccatgtcagattctgttttctgtacaagcaaaccaatatgttcttgctctgagggacatacttgaaatgacagaatcatggggtctccattcatggcactgccatagtaacagattgggaccacgatgatttaacattaccaggagttactgttggaacaggtcaacacaacgtgaaacctctgctacacatcccacacacacttggccccaagacgttgcttctactttggaaaaatcacttttccaaaatgacatttaatttaaaaaatctgtcccagtaaacaactttacactgaacaatatctgcattaataagagttaaggccctgaagaacaactctttggcattcttttctttgacaaggtctctgggaaccatgccaggaaaatataataaaatttactagcccaaaagttgtgtcctttcttcccttctctgtgtatccattgtctatgcgatgcttctttttcgtctttactttcttactagaaatttgagagccttgctttagtttatttgaaaccagccttatatttgcagtgttctgcttctgtttcaatgataggagaccataatctctttgtacaagcatcatcttctctttcaagttgattccacacattttcattgatctggatttcccaggtactgatgcaaacccttcatcaatacacttcacagcgctcttgtccatactctggtttgcatggtctcttcctctccctgaatcataagttacgaggaggcagggccatttccaaaatcaattcctggcagaagagaaagtgcctccatgcatcaggaaaccatttcaaacgttaacagttgatccaagggcattaattaaacttctttcataaataaaggctcactgctgccaaacggtggagtgcatgaagagacaattccaaggctataacttccctcacaaaaaagaaatgaagctctttgcagacaaagcctattaagcatattcactttcagattgttagacagaacaaatgagagggagcggcagaggcagtggagaagcccttcattcaaggaacaaagaatgcctcctgtactctttgccattgtgatcttgtctcaggaaaattcaaagaggctgaagatggggataattaagcaaatgattgataccaaatcaaagatgacttttgaggttcatttgatatcagtttcctctagggagagtatctgtttattccttttagtgcggctccccacgtgaaagattaaaaatgacagaacctttgttaaacagtttaaaagaattagagagttttctttcctaggctttgactgaagagattctttgccaattaataaaagaggaaaagtggaaaaattatagaatgagctctcacagtcactttagttatggaattttcctatttgggttggctatcaggtcttaacaaaatattctcaagggaaagaaaaccaacagcctgacttttgttgtcacacgggtactaagccatattgagaggaagtgcaggctgtagaaaaccataagggaatgtcaggctaacagagacacagagccgtttacccacttccgagactgtggagtttcacatatttctaagatgttaagtgagaaccatgtcacagatgacgtagaatgtgcatgatgcagaaaaatacagaagcttaaaatatatttaatacaaatggaaaagatgtttcatttaagcaatatatatttttgtcttgaaattattcaatctaattttaggtgcagatctgagagctgttaaattttccaaaggataattgacagtcaggataaagtgcagtcaatccccaagcttcagactttccgtcttcatttggaactctttccaggcatccattttcaatgtctatccgttttccacattctccctggacctgtcttctccctctctcagtggctcataccccttgaagagacaactggtttggagagcaaaacagaagcagcaaacatgatggttagtttcaaggcggatggtgccagggccaccaggcctgaatgtgagccaagggaggacagggaaggcgctgaaccctggtcaggtcggtgatggcatctcacagaatttgggctcagaggcagagctaggggctgaggtgcagaggagtcaggaagagacaggacactgcatctgggactcagcaacttgcttttctttccaccctgagtatgttttctaattgagatgagattggtttaaagggtcagaactagggtggactgaacattttgctatgtttagtcacacaccatccaattcttctcctcagtacaagaggacattaggagtatatgtagggcatgacactacagtagtgggaagcagcggtttggagactaataagggaaatcaaaaatcagggagaaggtgaggctgcagggtgcacaggttgccagggttcccaagccagagagaggctggaactcaccaaacaaaaggaacatgttgtagatactcaggggtcagatgaggggtctgaggatccagcgctggaatccataaaaataaaagtctcagaaaacaaatgaatcctgacgattgtgatcaagagaagaaggaagacacgaatacataatattgtgaatgaaaaggggcccacactaaacacagaagtaaaaaagatgatgaaaactataccaagaactatgttattgaaataaacaaattgtagggaaaatattgcttgtagaaatgatttaaagagaaataaaaagctcaaattgttctataactattaaagaaattaaattagtgcttcaaatcttccttcaaataaaacagcagaaccagatggctatatagatgagttctctcaagtgttcaaaataaagagtactctttttttgctttttacaaactcttttaatggttagagcagagagagtgtctggcctgttctacaagagaagcagaaaccccaatataaaaatccaaagaagacacataaaagaaataaaaattgcaggtcaatttcactcatgcaaaaatcattgaagaaaatcaaatgcaatgtgtgttaaaataagagaatacaccaagacaaagttggatttatcttaggtatgcaaagatgatttgatattaaaaaataaatgtagttcatactaataaatatttagacagtgaataaaattcacattgaaaatagcatagtagaagctcagagaaaacttgcaatacaaaacctattgaaatctgctcatcttggatttttccaagacttacttgcatactgaactcattaaaacttatcctaagaataacttaaaaacatatttgctcttaagtatttgaaaggggcaacaaacaatgtatgagtctctcaagattgattctacatatttaatttctcttttagaatagtgtgctgcggtatactggaagtcaccctgagacagggtccatgagctacgatttgtagccttcatgctgccactaataagctaagtgacctttctacttatctgtattctagctttctaaaattcaaaatgaagaagtgtggtcatacaatctgtataattgcttttccctcctcagagttttgagtttttctaggttagagaaatataattttttatacttatatgcatggttttgtgtttttgtactataataaatctgccaaacgagagatcttctaccattttgataaatttgtgtggcatcagttgtctaacaaaatatagtttcaacacttttaagcctctaccagccatgatccggagtccaagaggacctggaaggcagtccattctgagcaggcaacactctggcaaggtcattctgctgtgtctaccttcacatgcaggttttgacactagggtcattaggacagtgctttttcaatgcagtacacattttgaaatgcacactaatttcgtgataaaacataacacaccatcagccctttcattcataagtatcaccgatttctgtatgtaacatacagcctccttcgaacctgcatcctgagctctaaactcttctgagccatgctctatcccctcaggatcaaaatgccttacagctagaaaagttcctaacaaatagtggacactgaataagtgattcttaaaggattgaggggatgatcgttagaattttacattctatactgacttcccacactcacttttgaggaaagaactctttttatgattttttcaactgtggtgcccctagggctcaaaacagatctacatccatagtgaatgaattaataaagtattaatgcagtcaataagtgaataacaaaggctgttcaatctaacacaaaggacatttaataaacacataccatgtgttaccatatgatgtgtatatgcattttagataaaatcatgaatatagggataatgcaaacgataaaaataattgaggacataggaaaataggaagtgtttataaggaaataaaacagacagcttctaaagtggcttcaatgatcttacctcttggtattcatgccattgtgaaatttcctccccttgtacgtaagctgaaccaatggactttcttctaaagaatagaataagtaaatcaataaatgggattcaccacataaacagaattaaaaacaaaagccatatgatcatctcaatagatgtagaaaaaagaatttgataaaatgcaacaccctttcatgataaaaagccttaaactaagcattaaagaaacataactcaaaataataaggaccatctatgacgaacccacagcgaacatcatactgaatggacaaaagctggaagcattcctctggagaaccagaacaagactaggatgcgccctctcaccactcctattcaacatggtactggaagagctggccagagcaatcaggcaggagaaagaaataaaaggcatccaaagaggtaaaaacaaagtcaaattgtctctttctgctgatgatatgattctatatttagaaaaccctaaagattatacccaaagacgccttgacctgataaatgacttcagtaaagtttcaggacacaaaatcaatgtacaaaaatagtagcatttctttttttatgtctttttttttgtcttcaacttttattttaagttccagggcacatatgcaggatgttcaggtttgttacatagctaaatgtgtgccacagtgttttgctagacagatcaatccatcatctaggtattaagccaagtatccattagctgttcttcctgatgctctcccttctcacatgcaccaacaggccccagaatgtggacacgtgttccccccatatgtccatgagttctcattgttcagctcccacttgtaagagagaacatgtggcatttgtttttctgttcccgcaatagtttactgaggataatggctcctatctccatccatgtctctgtaaaggacatgatctcattcctttttatgactgcatagtattccatggtgtatatgtaccacattttctttatgtagtatatcattgaagggcatctgggttgattccatgtctttgctgttgtgaatagtgctgcaatgaacatgcatgtgcatgtatctttataatagaatgatttatattcctttgggtatatatatataaattggataaataaatgcagtacatatacaccatggaatactacagagcaataaagaagaacaaaattgtggcttttgcaacaatatggatgcaactggaggccttatcctgtgttaattaatgcagaaacagaaaacccaataccacatgttctcttttctaagtgggagctaaatgaacacttggtacacacggacacaagacgagaacgataaatactgggggttccacgaagcggcagagagacagaggggcaaggctggaaaaactaccccttgggtcctgtgttcactgtttgggcgacagcctcagctgaagcccgaacctcagtatcaagcactatatgcacatgaaaaaccgacacatgtaccccctgaatccgaataaaaggaagactcctttttagcgatgggatgggatgttggaatgtcacgctgagatcaggctgcacaaaggcagggatttgcacccagcccactctgcagtgcttttcacttgcctgttcggtctgccatgttgagagctgccccagggaaaggcccattaggcaaggacctgagggagacccttgtccaaaaatcagaaactcgagatcccagcctaatagcttgagaaacactgaatcctgccaatgaccccatgaatgagcttggaaatgaatcctccctttgtcaaggcttcagttgagaacacggacctgaccgaaatttgactgtgatcttgtgacataccttgggcagaggccccgggctaagctgcccccacagaaactgtgagataataaatggtggttactttgaagccctcatgttttgagtaatttgttatgctgcaatagacaacgaatactgtcaggaataaaattagcacatcaaacttatattggtattgtgtggtgggtacacaattgctagaagcaagtccaaatctcacctctaggtctggctttctctaaagagctaagcaaagagagacactgccatgcccaagaaacagtgtccataagatagatgcaactgaactgttgaggagaatcagggcttttctccattttggagctggaagagatgtttcccattagttttcttaaagtgatcccaggtgatggattaggtgatgtctaacaccaccacaagaatgaataaatgcatatccagggctcactctcaatggataacatctctcagtattagtcattgccagaataaagcttgagtgtttttacaataggctacaaaaactataaacacacatcattctaatggtcaagcttgactttaaggtaaaatttagaatatgcagagaggcatatggatgaatggatgaattctaaccctattcttaataagaattggtgagtataaacttcaaggctgtaaccaaaggcaaaactcagaagtaaagatattttgtgttgcaatttgaaaagagctccataaattttaaaatcaaaatcattttattaaattaggtacaatattagatgctcagctcgcacaccgatctagacaagatgccacatcaggaagtaattttagaaagtggggaagaggtgagcatccccattctccagcccagggctccagccaatgtcaacaactagtgatgtcctgtctgtcattgaactacaggcaggcccacagacctctagtgaaggtgtggagtctgtggtttcagttgtagtgagttctctccttgcaactgctcattgtatcccaaactggaaaatgactataagatgttcagaaatgaatagtattaggttatttttttttttacctacctgaagcacatgtgccctcaggacaatttttacttcttccaacccaaatgaccttgaaacaggaacgtttatttcacgtgctgctaatgacaaggtaataactgttcaattaaaaagtgttatgaaatctctcttttccttttaaatcccttaaattttctgcaaatgtgatttttttctgtcatacctgtctcattgacatagctgatctcctggagtagttcagaaacaaactttctgtttacacagcctatcaggagcacaaaacctcgttttctgccctgacttttccctgatatgaccaaagggagcacgaaattgtggggatttgtggagagcgatttgtcagccttttcttatttacttggactgtgagatataaattgaatttggggctctctcttcaagaataagttatttgttatcaaataggataacattagtggatcggacgtggataagttgtttctcttataacctcgttaggtgtgtgagggtgctctgagttctagaataatggtttgcttttctgtgtacacttggctttcatttatgactatctcatttgaacacccttggtctgctggatagtgaatgtctttccacataaaatggaacagactgaagacagcagaactacttattacagccattttaacagacatggcaggttttcacatggtttcctcagctattgggattattactgattgaacatacagtctatgagaactgattaacaatgtcacggctactagattgcttggtgaactcacttgaccttagtggtaactgtggcacgatggtgcttgagaaatcatcaaaacttaaaagaaaaatgagaagataatggttaaaatatgaattggtaaatgctaatataaatcagctgctattcaaattccttagttgacttgttccctatttaggtagtgactccgtcagatatggaaatgttgaggcatctgacattacctccaatgtggaaaagcatccacacatatggaacaaagaattgccccaaataacaaaaatgcagctgcaattacagaacaaacacgttgcctcctatatctcagcacagttgtttctgttttatggtacttatttatgtagtgactaatctgggatattcagtaatttgcagtggggcctttcatcattagtgcgagttaacaaaatggttctgttgtccttagtaattaatttggtaggaaatgaggaagatacaacacattctgagggctgctcaatacctttatcttcctttactgtctgttagctaaatatggaattttaatttcctccctaattatcaaagagtcttttgctaaatgggcatgtccctgaggcccaattgcttacttttactctctagattttcacctcactttttggaaatgcattcttatgaacttgcaagtcgttcacaaacatttctatggtaaaaagttaaacactaaccaacattaaacagctccagagtgtgttgagccttctgccagccccttcactgatgtcatttcatttgttcctccgggtaacccttcaagggtggcaatgaagggatgtggtttgcaagaagaaaactggcttgttgaagcttcttcctcaacatcctgttatctaggtggagaaactgagattcaaacttagttttgttttgaagcccacagtgtggttggtctggctctagagcccacattcgctgtgaaaaggtaacattactgtacttatcctgagttggtttagctttggcatctcatcagtgctgctgctcagttactgcttgtcatatgatgcctaacagttttctgagttttaccttggcatggaagattggagatatgcaaacttgcatgcctttatttcctctagactttgccgattctatggaaaccaaaacgattttttatatcaaagtcgattagcatttttcagaacaagtagaacacctgaaatttaagttaaaactgtagctaccatttgtgtctgcattcacatcattctaacaatctagatgatgccttgccatagttaaatatctacattgccaacatgataatgatgatgacagtaacaacagcagctactctttactcattgtgaaatacattctaggctgggtagttaacgattatcgaagtttttcaaatgagaaaaatatggtatagcacagttaagaaatttactcagggtcttacagctagtaagtggcagtgttaaaccaatattttaaaatttgctcataattggttaacatttttctgttttcttggtattagttatatgtacagagtgagtatcctttgaaatgtttggaatcagaagtgttttggatttttttattttggaacattttgcatatacataataagatatctaggggattggatccaagtccaaacatgatattgatttaagtcttaaatacaccttgaaaacacagactgaaagtgatcttacacaatattttaaataatgtgcatgaaacaaagttggtgtacattgagccatcagaaaacaaaaatgccacgacctgagccacccatgtggataatctgtggttgtttggcatcaccgtctttcatgactgaatttatgtgctacctataagcaattttgtgtatgctgattcacacatcagtacttcacagtcacaaatatgacatactgttaatatagtgtaaaaacaatgtgtgcaggctagctaagcagcacagaagcatcaccagatacctgtatcagctgctaaccaacagcaacaacaaacaatggcaggtgtctgttcttcagctacaatgctgtgcttgattaagcacaccgtacagtaactcccttgggaactgtgaataaacggtgtgttgtgcacctgtgttttgactgctacccatcacatgaggtcagctgtgaaattcccgcttgtggtgtgatgttggcatgaattttggagcattctgaattttagattttctgattaggaatgcgtaatctgtagtattctgttctaatgttggtctttggtgttgcaattattgtgttaagattttgtttggtctatcaaaagtcataatgatgactactgaaatgattttgaaatcagtagttattctttgtaaaaggaggattttgaagatccaatgtcttttatcaaacatctcaccagtaaattaagaagatctaaatcttgccacacacacacaaacacacacacacacacacacacccttatgctttaaaatctatctttccaatgtggttcccactgcacatcttgaggggatcttctctggatttccacataagcattgttcagaaaatgcttttcaggcagagctttgtcctccagaaattccatagactagcaggttgtaggtaccattcacgtggataaccagctctgagggcaatgatatgaatttagattaaaacaaatgaaaataccatctgttttgtggttaggctattcatctcactataatggtagaccatctatagtcatctatgcttggctttggaaggataaccctgatcaacacaagtattaaataatgacaagcccctaaatagttaaagcttaatccaaattgccaattacctttccaaaattttgaaaagagaactttatagaaaagcttattaaatatggctaaaaagaatgtttttggtacagaaggtgcttttatccagtagttttcaagaacttcaagtacacgtttcaattcatacatttcattcatgcattacacaaatacagaaagtaaaaattataaagttaaatctattcttccagcattcctaatgaattcttctgtgatacctccttgctggattttcacattccaacacagagaccgttggttaatccaaacttttgccttcacaaattagcccacatggcttaaatttaagaacataatttgtttttttgtttgtttgtttgttttagttctaatcttagcatgttagggaaactgtggggtttctctagaaaagttacaaataaaagataagcctcttattttacaaattcctcaaggtgtgatacaaacttgatcggagcaaacacttccctatcaatgcaatggattccccatataactcccatggactgtgtgtgaggctcttgtcagagagatgatccagtcagaagtcagaaaaaagaaaggcatttgaatggtatttctttgccaattcatattcaccgcctctaaaccctatactcttattttctgctggaagtatgaaaagggagggaataaatgtaggaagaaaggaaactgcgaaaatagggaggaaaagaacagagaagaggagagagtggaatggaaacaggaacaggacatttctgaagggtattatccactcttggctaaggtgaagtagcagctaattaggctatggggagacccagagcaccctcttttcttttagcaaacccccacgagcttatggcttttcccccagctgggcaggtttcctattgaaatctgtctcctggaggactctggagcacgtctctatctgaaaagcctcgtaactgtgaccttgacaaacatcccttgcaggaccttgagagatggtagaaaatttagagttttgtgatttacatgctgcagaatagatacctattgatcttttttttccttctaagaaaatgttcctttgatacattctggctgaagaattggaaaatatgggttttattttgtttcgatttgatttggtttttccaaaggagagataatcggtgaattccactggggatgggtggttgtttagccaagtgtaatgttccataaattatctgggccttgaactattgccatgtatgatacatgagtgatacacacaacccaaaaaggatttattctttattttcccacccagtttcagagggagaaaataaccaggagccaggaaatagtgataataaacttcactataccttaaaaaccaatgttattctcattttcattaaaggacaatgaagctcatgaaaataatccacatactgatactattcatcatcttcctcatcacaaattaaaaatgatgctaattaaaaaggtattcatatatgtaaagctgttgtttttagtctttttaaaaaagctcataccatatatatgtatatacgttttttcagctttactgaggcataattgccattttatgtatttaatgtatacaacatgatattttgatgtatgtatagattgtgaaataattacacaatcaagccaactaacatattcatcacctcacacagttgcctttttctggtgtagtgagaacacttgagatctactttcttagcaatgtaagtgtacaatacattattactaactatagtgaccatgctatacagtagatctccagaacttactcatgtgataactcaaagtatgtatctttgtcttagccttttttttttagtggttgaaaagaaataatcaaaagttagtttttttctgccttttaaaatttactgtttttaaagcagcacaaatataatatttgataaatgttacttttatatatgtgatttctggcatatgaaaataatctcttgttagctgtttttaaatgtcttttttcttgatgctagttgagatttaaaggagaatttaaatgtaaaaaatctagaacagttatctcaagaaaagtgcctccagcctcttaagccattatttacatgaggaattgccaggagcagcagccattgaatgcgaagcaagaggctgctctatgtgtatgttttatagttcccctttgaacctgtctaattccagtgtgaaaataatgtttggctctttattagctaatttgaatctactttgtggtttatataaaatacattctcctaggagtttataatccaggaaatgttcttgatactttgaaactcttttggggagacatgtggttacttcattgaggactgcacttcttcgaaggagaatgtgaccaagttcgctgctctacaagtgctagggagagcgtggaggcgcactcagtgaaatgacaggaaacatacaatacccgtggcattttactttaatcccagattttcctaaaacagtcgttataaccaccttgaaaataaatcgtttaacattctttcccctattcatgaagtagggtacaatattatttaatttatagcacaagaattttgtgagacctggaaatattgataatacaaattaggaagaaaataaaaactctggcttatgtcttagaccttcaaaagttagaatttgtggaaaattaagtagcaaattaatttgtagcttgttttatttctctgtttttattacatggggatttgtggttataaaataattataaacttttagaactggaaagatcttagaaataatctattttacgaatgaggaaattaaaatcaatatacgtacaatgatgtgcccacatctgcacagctctggaaagttctcttcctgttgaatgtatccttttttagctttcagggaagatcgaaaatcataattatgcaccctgcctcctctgttcaaatcccactccaaccttacttatgacttggagtttggcaaaaacttccatgttccaacaggaccttgcctccctggcagtagtagattaactagggatactgatggcgcagtaattccagggatgatcaagagagccaacaatgttgagtgcttcccataagccatagtctttgaaatccttaatatgtgtgagtttgtttaaccctcacgacgatatgctttgggatagataccactatcatctctattttccaaatgaagagcctgaaatggaagtaagtactttactgaagcccacacatatggtaggggcagggctgtaattcagtgtggctccagcatctgtgcactacatagcaggcatacagttaggacaatctgaggacaattattggcccaaagttgggcacgggacataagccaggccaacaggagctatttcctggaatttttcaaacagaatctagagaatgaagtatgtttctgatgggcagggtgagagatgtccaccacaattctgtcaggccatatttcctgctaggctgaggaagctcgtcagagagaaggaagctaacacatgtgaggagtagagattggagaaggcgagagtgtcgtgggatgggcacctggctgcatacctgctgttccctgcaaagcttttagtcgattaaatgtttctcccttttcttttttatatgtaaatcagaggagattgcctaattaaagtaattattgataagagcgaatccctgcttagctcttactatgagttaggcatggttataagtgctttttatctcatttatatcacttaatccttaagataatctaacgcaataagttctactttcaattcccattttataaaggagaaaacaggggcacagagaagtcacttgcccaaaggtatatggttaataccgtgactacctgctgtagtcaaactgaacatgggactgtttgactctgaacttggttcttagctccatgccccgtattccccacatgacctagaacccactgcatggagatctccattaacagtgaaaaccaaaaatctttcccaagtgattcaaaaatactaccagagacagtttttatatctcctctatggggctgacaagatttaggagtgacagtttgctgatgatattaccacagtaaatacttgtaatatcaatagtgatcacatatattttaaacattagccatttattaataataatgatggtgactattttttctaaagtgcaatgcaccttaaaaaatttaagaaaataaatgattctgatttattttcctcaaattgtgtaagaacatttttatggataagaaaatgataacttagaaacaattaaaacttgaaataattattaaataaattggacatgggtttcactgaaataacagttctggaagttcaacctaggcttttcactctcagtcacatgtgctttctcacaaggcactggaaaagcgtcatgcaaatacaaattagtctcatcctaaaaggcaaagtaaacagcaaaacatgtacccagtgaatgtaatgagcagtcacactgaagctcaggcttaagctacgggaaaactctttttatcctttagcaataaatcctgttttgactgaattatagtatttggataattgatccaattctcttcacatgcgcatttattattagtgttctatgtggtctagctaaaccccagtgattcatgaagagcaatcataaccacagaaataaggctccaagatgtacttccaaagcacaggccaagcatttgaataagctgcagcctgcctgtaccattaatcttgcatgctgctttgcaagtgtgttctattggattatattcaaggccatttcgccatgtgttcaactagactgcaaattctttaaaggatggacctcaaaggggtatcatgaaggaaaacatgcaatattacaaagtgcttagctctttataactcttctcttgcttttattcattcaacaactatccactgaccacctccttggtgccaggcctgaggttctggagatataagcagtgagcaagaagtggacgtgggccccatcccaacagagcttacattctcagggagggaagcagcccataagcacactagcaagcaagcaagcaagtaagtatgcaacagtaattagtgctcggagggaaagtgtggcatgcagtgcctgagatccatccttggagaggagatgtggaggctgaagcttaaatgctgagacaagctggccttatgaggatctgggcaggaatgttctgggtcccaggagcagttggggcaaaagcattgtggttgaaaagcacttgcttcatttaagaagcagaaaggatgtccatgtggctgtggaaccgtgagtgagcttgaagaagagtgggaaaaatgggaatggaaaggtagaagagttttagaaaggggccacatggtttatgtcctaaatcagaggtagacacactttctctctaaagagccagaaagcagatgttttggacttggtggactgtgtggtcgccatggtgactactcagttctgcagctgtgatgcaaaagcagccacaggcgacgtggaaatgaatgggcatggtgtctgcgaacacagcctaatttattggaacaataaactgggaattttatttttaaattttaatattaaatctctttaaaagataacccggcctttatggaaatatgatgatgatatgataaccgtgaagagtgcacattccctgtgcagttcaggcagagctctcagtgcggggtcaagttcaaagaaacgccaacctcacaccacaacgtccttgtaaagttgttgtaaatctgtatggaggtacctcaaaaaaatgccaacaaaggctcccattcataataaacaagccttcctgaaatacttgtttattacgtttttcacttatttcacatacagacagagctgtcgcctagctcttttcttcagttttaacttatttgttattgatatgtgatattgattgatatcaatgtattaatatattaatatacaatatattgtattaaaatatcacatgtactccaaaaatatgtataatcatacacaatacaatgtataatgatcgaatcagggtaattaggatctccatcacctcaaacattgatctttcccttgtgttggtaacattcaaaatccttccttttagctatttaaaaatatacaaaaaattaccataatttccctcctgtactattgaatattagaactgatttcctctatctctttgtatttttgtgcccattaatcatatctctttatctgctccactccacaccctttccagtctctggtagccatccgtctactctctagctccgtgagattattatttttttagctcctccacgagtaagagcatgtgatatttatttttctgcacttggcttatttcacttaatataatgacctctagttccatccatgctgctgtacattataagacttcattcttttttatggctgaatagtactccattgtgtatatgtatcacattttctttgtccattcatctgttgatggctactgaggtagattccatttcttggctattgtgaatagtgttgcatgtcgcctagatcttgcttcctctctccaaacttccccacactcaccaaatccagcccaggtggactttaattattgtacccattaagtctttggaatctattgtttccctttataccaggagttttcagtgttcactgagtccactgctttttgaatgatgcccagtcctcaacatgtcccctttttctccttccctattttagtttacatgaaccatacatacagttaattgttttcaaacacccaaacctcccttgccactttctcaatgtcattttcgccagcaaaatacgtaacttggtcaaacccaactgtctgtgtattaatcgtggctggagaacaacgcacgccctggctggctgcattctgtctaaaaccatccataagtctccagtggcagtttccatgaccctacaatccagacatctttgcctgtacagtttaacttgctcactttttgatacaattttctgccctttttttttcagatatttccaatggtttaaaatttcagcgaattatcttgtcacatatgtaattgagagaatggaagttctcagaatgaaactttctctttgttcaccatcaaatctgtctaaatacttctacttctacccacacactttgtcttctcttctgtgatggtggatgaggatccccggctcccatcaaaggcagttcctggctggtgctccgtatgttgcccttctccacttctagggactttgactcagcaaataatgctcccttttctgcatctcagtttcccatcctcttctgaattattattttcagcttgttctgtagattcctggcttaagaaaactctcccttgagcacactgacccatgtcttcctatagctactggcccatttctccaattctttgcttcacattttctttacaacccacagtgtctgagcttccattacaccactccactgaaactgctcttgtccaggtcaccagtggtaccaaagatgccaaaggcacctgtggtgttggccaatccaaggatcacttctctctcctggtcatactttgcctctcagacgcatttgacatcaattcaattccaaagattcttttccaccacattgcaattctatgctttccttttctgtacttcactgatcactgcattcttctaagtcaaattgttgtcacctctttttgtgctgagcacctaaatatttgggtctcagagtttagttctaggtcctgtagtcttcagtatccaaactctctcactaggatagctcatccaatatggagctcttaatactatgtatatgctaataatgttaatatttataccctcagcctaacccattcaaactcatgtggctgcctgcctatttgacactgttgcttagatgtctaatagacagctcagttaacttgcgcaaaaggaaactcttgtcgattttttaaaatccctaaattgattactcctcctgtctttctatccacccagttattaaagactaaaatctagaaaccatccttgatctcttttaccctcagattccacatctaacccaacgttgagtcttgctaattctatcaccaagatgtatctggtattggtctacttttcatctctatggcaacctccatactccatgtcatcatcatcaccacatggaatgcaaaagcttcctaatcagtgccttgtttccactctcgctcccattaatctgctttatcttctattttgtttttgcaagctagcataatgcttttaaatagcctgaagcagatcacattatgttatttctctgctcaaaatctttcaacggcttctagtgccttttgattcaaatgaatcaaactgaaatccttcatcagagcatacaggaccttgttttctctccatctttgtctctactattgtcagtcttggtcactgcaatctaactagtaggtactagttgacttggatcatttccgtatcacctccctgccaaggcatccacagaccactcaatttaaagtaattcaatcctagtcaagttttaatattattattctgaattattttaatattattaataagactattctgtattatcttaatattatttttctgtattatagacttctagtctttagtcataactgaaattattttatttacacaagtacacaagagtggagacctcatctgtttaggtcctctgtggtattccagcacctagaactatgtctagaacaggatagagagtcagtaaatgttagatcaatgtatgatcccttttactttcctagattctccaactctgcatctcttacctttacatttaacctgcacattaaaggcccaaggattggttgagcagagacagacgtctcctctgcacacagaaggtaaaacatggccatgactgtattaatattttactctagtaattaataaagccataatttatggagttttttcatgtgcttttatccactctctaatttaccctgtcaaccaccttggaatgtgtattactggaaatctagtttttgctgtatgttttccccttcgtaaggggactgccctttcctgattctgtgcagctctctggcacctccaggtctggtggaattgatcttgcttccctggaccaaatgctggacccaccagctggacagtcagggttcgccttctgcctggaaaccattaattggttcagggatggtcacatgatccaaatatgactaattgttcctctttggaaagcttgttggaaagagcagggaaattgcaatgtttttttctgacaggttcatgtttaaataggacctcacatattacggcctctgcctggaaatgaagctcatcccgggaaaagaggcgtgagtgatggagagcgggcgtgagcgttggagagcgggcgtgagtgatggagagcaccctcgtctgagctcacggacaccgcctgagtgaaccggtgctatctttggcacttttcacgaagctgtggtaataagcctttttgtacctaaactaatttgaattgcattccacaaacccttgactaattcgattactattcttattttataattggggaaaatgaaaagtgtcttaaagttaagacacttgccagggaggaaatatttgagcaagcctttctttggtaaatagcataggtctaatatggactagcgttttaattattttgatgatatttaaattttttccactttaaaaacattttattagatttttttttctcttagtgtatatacaaaattcacgcaggaaaaaaccatattactttaagataatgctttggattatgtattttttttctcaaagctcattatttagtcaatggaatgaagttcagtaaattaagaattgacagaaattggaaattatgtaaaattatacgggtgtcaagagaaggattaatgaaatttagtagttgatactcacaattaaagtaaatgtgcaaaattgggtactttaccacgagagagcactagctttcaggaaagtaaaacaaaaaatgtatctcctctatattggctgcattctaaattacaaagattgaacatgaaagacaaacggacttatgggttaataaaaaagaaaaatacgcccattctcactttacactattggtaaatattcgagtgtacaaataagcaaaaggaacattagttaattcagaaatgagagcgaactaactgaaatgttctgtgattgatgggagaggctgatagaattcacaggttattggaatactaattgcaccacattggcggcctcgtcaaataccattttgctttttatagatggttatactgttcactcacttaatcaaatcagaaaacttggtcatcttagattccccactccttttgttcaccttccctgtctttaccatttcaaattggctctcttgtcttagagcttatgtctctaaaacaaccatggctgaacgctgccctggcacagtgtgtcttccttgtccaatctcagggtctcatcttcgtgcatcaggctctgtctattatagtccagcctacatagagctgcaaagggttatttaaaagaacacactgaattgcaccacgtttatgcttaatactcttgaaatatctgttacctgaagaataaagttcaaaaatagggtccttagagaagtatttatttgttaggcattatagatatttgttaggtactatagggtacaaggaaagatgaaatatgggccttcctgtaaggaatttgcataaggttgtgtgattgggagggtggggtgatatccaaaggcagccatcttcacggaaagcttattacagataaggaccagtacaacgaagctcaaagggatagaacttagcattgcctctgttttcagaaaggcttcctggaggaaagatgccaagttgaggctcaaaaagtcacctaggctcagaagaaaaagaagtgtagattattatccaggcagttataaaagcaggaaaaaaggtacataaagtttctcaataacggcaaacagttcagtattatgaaaacataaacaatgacgtaggaagctgaagctcagagggatggagaaggaagtaggattgaagggttcatgaagccctttaacctctactgattgagtactctgctgaggatacagaataaaccagaaaagaagctcacccagcttctctggagttagcaatctatagtttaagggccaaatacataaaagcagtgcaagttctgataatgctatgaaggaaaatgtaagttattgatataaaaagtgagaggatagatctattttaaatgtgatggccagggatgggctctctgggtgggtctcatttgaaaacgagaagaaactagcacatgcaaaaattggagaaggttctattgcaagggccctgtgctaagaaagagcttgacttcttgaagaagcaaaggaagaccactgtgcctatcaaagcaagtgggggtgggggaagcagctagaaatgagattgatgagctgatgagggaccatccttgcaaggccctggagatcatggtaaattatatggatttcatttcaagttcagtgagaaacctttcaatgatcttaaacaagctaaacaagcaagcatacaccatggtatggagtttgtatatcttgagtaatggggaatcaataacaggttttaatcagggaagttcataatcacatctaatttgattcactgtagaggttggatgaagagtgttataaatgtgaaataagagtggggtaaaatgtattgatcgggaggacattgtagttatgcaggcaacagatgttgagctggtatttgtacagagaaaaggatacaattaaaaaacattttaggctgggtgcagtggctcatgcctgtaatcccagcactttgggaggctgaggcgggcagatcacctgaggtcgagagtttgagaccagcctgaccaacatgcagaaacctgtttctactaaaaaaatacaaaattggccgggcatggttgcacatgcctgtaattccagctactcaggaggctgaagcaggagaatcacttgaacctgggaggtggaggttgcagtgagccgagattgcaccattgcactccagcctgggcagcaagggtgaaactccatctcaaaaaaaacaaaacaaaacaaaaaaaatgttagagataaaatcaccaaatgttgtgattaattatctgaaagagtgaatctaataaaagagagaaagtagtttagaagaagagttgttttttatgacatggtgaataataataccatgagctggtattagataacacaagaaaagggaagatttggaggagatcattacactatcccttgaattctgagagtttgagatattgtggaataggcaagtggttatgggtagatggaagttggatgtagaaatctaaaattcagagaagagcaagctagagagacaaatgtgaaagacatcatcatatatatatttggcagttcaaatcatgagtgaatataaaattactcatgaaaagaatatagaaagagaagaaaagtagaacaagagctgaattttgaaagacatcaacattaaatggcaggtagaggagggtctgtgttccgagacagagaatgagtggtaaatgagggaagtgaacgcatgggaagccagggaagtggaaaggacccagaaggagaacacgcatgacacgcaaatgcaacaggagatccactgagataaggatgcaaaagggtcccagggaactggcaataacagggtcagtgatgtttgtcagagcagggagaatataatggtgggacagaatcgggactgcagtgggattaggcaggaggaagggagatgaagtaattctaggaacatggatcagtcttcatgaagggaagggtagaaaagaaagcatggtggctggtgaggggcacccatgtgtttagttcttttaattatgtaagacatttcaagctttttttagactaaagggaaaacatgagaaaaaaggagagattgatgataaaggagataattcatcaagtatgatcccagagaacaagcaaagagcttggaatcagggtccctgaggagagtagcagagaacaccgatctggaagtagggtcaatcacagaggaactttgagggactgacaggtcagctcttcagcacagagccaggagtactcacactctgccccagtctatcttaaagcctcttcccaccactctcttctccacggattctcagtcctttccacacctacacgttctgctttaactaccagagagccaagtctccaaggaacaccacacactttcatccttgtgttatgccatggtatccatcttcttcccttttaactcccctccccaaatctactctcttgccctaattcttagtccctttgggctgcataacaagatatctgagactgggtaattaatgaagaaaatagatttattgtctatagctctggtggctgggaaacccaagatcaaagcaccagcagatacagtgtctgatgtgggcctgttcctcagaaatggcatcatcttgcagtgtccttccagggtggaagaggtaaggatgccccccctcccaccagaagggaactaatctcatttgtgaggttgggaccttcacgacttaatctcttccaaatggctcacctcttaataccattgtatcaagtattaggttacaacatacagactttgggggccaccagcatttggaccataccatctaactttggcctaacatacatccctccagccaaagttaacatggggaaatattttcattatacttcagatcttataaaaatgttttctcctcctagtcatctagatgcacacataaaaacaatacttcctttcccacgttcccatggatttgtttgaaacctagctagaatgggacctctgtgaggccaggagttgtgctctatttatctctcatctttggtgtctggcacaatgccaggcgtatgcctgacattgtattgaaggacaggacgcatatctacagacttcatgttaaagatggaagccgtgatgtctccccttaaaattattcctctaataacttacataccttctgtagcttagaaacttaaaaaacatgcttagtaatatgcagaaccccttgtaactctacttgatggattctctcctcttttgcatcttcctattacctcataacatgaagctgaataacagccgtctatgtgtaattaataaaatatgcaaatattttgtatcattatcttcagcttacaaatcagaatgaaaaattgttgtatttaatgtgtttggttgtgcagctttcttcaaatgcctctcctctccatgacccttactgtgaaaattaattgggtatctcctctgactgctccattcattcatcaaacatttattgccaggcacacagataacagtaagaatagatcttccttccaaggaatgcacagtctaattgacagcagtaggaaataatgacaaaattgttttcttttagtagaatttttatctacagagcaaagaatcacaactctagatcattgccctggaatttctctgttggagatcatccccagatggttaggactctgtctgaaggtttcctgattctgcctttggttgttgtgtgcaaggcatgtgagatggtcttaggtgaactatcctggatgggagctgatgccttcctctgcttcagcagagtattctaggtgcagggtgagagaataggcctgcattttccagcactcaacaatcctgcaagggacgaggtgaggttcctgctcctgtatctactactttccttgtttttctctgagtgaatggaatactaacctaattggctcagaagaagaagactgcagtagaagactggctacatttacttactaaataagtaagtctcattggcttcctacttcatgggacaggctcggaaagaaagccagcaggtatctgtccttgctctcttcttttctttacatgtgaatgctggctgctttcattttgttgtcatcttgtggtaagattcgttcttgggagaaggattagattattaggtctaatctaagcaacctgttccagtttgatttacaaatagttagaatttggggtctagcccaattaataatgaactggcatttggatttacctttcatctgtatcccttaggcattccattagagaagggtggctgtgccaagacaagatttgggtgtctgttagaattctgcacaaaacaacatcttactgcttttgaagccactctttaaagccttaaatgctttcctatcaatggggccaacaacaaaaatatacgttggttatagttttatatatatagatgtaattataattgatgtataattgatataattatagaaccaaaaaaactagactgacacacaattcattaaatttttcatctgtcgaattatttcatgttatatgtgactgatttaacgatgattagttatttatatgggattctttctcctaccccatcgcaagagactaacaggcatgacccagttgaatggagtctctgcttggaggccaggccgtgattggagacctaccctcacacttataagaataaacacttcattggaagacttctaagtcgttcagagaatggaaaccaattatttctcttctgggagaaactggtaaaaattggactttaaaaaaattacatgtaataggagctcttgaatagagatattgttagactttaggggtaattatcaaggaaaatgctcagcttctttcattaaagactggtaaaaactatcatggttagacagagtttttcctgaaataaagagaataacttttataaattttgtgtttctttccaataccatgatactatgccatattaatatttctatgactgcatttggtaccatctttactatgaaaaaatatagtttaaaaaatctttttttaatcaaatatatgtggtaatgaaagtttgtagtctagttttccttccctggtacagttaatgatggtttcattacccaaagaactcaataaaccaactgtttcattatgctgacaaacaacttgatcaataaaactgctaacttcacaaaatgcaaaggtttctaagtgaggggagagaaaatgtgattctacacatttgaatctttccatatcgattaagaaaaatccttacagccccatgcatgtctccaggaaaaattatgtgtgtgcgtgtgtgtgtgtgtgtgtgtgtgtgtgtgtgtgtttgaggagctaaaggataagggtcattaacttccataagtcactcatactatatagaaaataagacgtcaatatgattctgtataatacaaatacatacaactatctttattttcttggagaataacttactttagttatttctttaatctttgaagtgcttcttttcaagtagttaataacattttatgattgtatgatggttggcaaatttgcaggtagctgttacaaattgtactttttatttccactctcaacctaaaataatatataatttattggatgattattattctgcaatttaacattttctaaagattggctgttttacaactgtatcgatacttaatacagtgatgaaaagttctcagtatgttagataagaatacaaatagcaataacacaaccttttggcctctgagcctaagttgattttatgaagtccttctatgttcatgaacaaagcactcttgtccctatcaaagactcacttgactttttccatattctctttagcaaaaatgaaccagtaatcattgtggcaggtaggagcagtagccctctgtgcagtagaaagtcgacctatgggccgggccccatggctcacgcctgtaatcccagcactttgggaggccaaggcaggtggatcacctgaggtcaggagtttgagaccagcctggctaacatggtgaaaccctgtctctaccaaaactacaaaaattagcagggcatggtggtgtgagcctgtaatcccagctactcaggaggctaaagcagaataatcacttgaacccaggaggtggaggttgcagtgagccgagatcatgccactgccctctagcctgggtgacagagcaagattccatctcaagaaaaaataaaaaagtccgcatatgacttttaacttcttaaaaactttactactcatagcccactgttgactggaagccttatcaatgatataaacagtaaattaacacatattttgtatgttatatgtgttatatatggcattattacaataaagtaagctagagaaaagaaaatgttatttaaaaaatcataaggaagagaaaatatattcactattcattaagtggaagtggatcatcataaggtctgtatccttgtcttcatgttgagtagactaagtagaaggaggaagaggaggggtttgtcttgctgtctcagcgtggcagaggcagaagaaaatttgcttataagggcacctgtgcaggtcaaacctgcattgttcaagggtcaaccgtatagcgaaaagtcgtggagaacaaggagcatgctggatattcatttaatccaggatattcatttactcgcccattccagatgtttgtatgtctgctatcatacgtgctagatatccatcttatacttaatgtgatattgcccacatataaagttttaagcctttcagtgtactatagtagtcaatatgagtgctaaataaatacgaatagttcatatatttatacatgaacatgatatgtttatgaaatgataagagaatgtggagactgtggatctgatgatcaggcttagagacagtgaagtgatttaagataataacatctttcctaacacaatgaaaatggaaagatttacccaaacccagacgaagtatttagaatgttggaaggaaacaaaaggtcatttgttttcttacacttgtactctatccacttcaagatcggaaacaaaaatgataaagagatattgctatgttgggtcatggagtctaaccccaaattacacactatctttgtcctgaacatgattcccttgttacggaactaaattcctaccggaagccaaatcacccttcagtagtaaattaagcactgaggaatacacatattttgttttacatcctggaagaatcccatgcccattgtgtgtatcgggggtgtgtttacatagtgggcttcaagcaaactctacaagattctgctcagctctgctccagatccttaccagacacccgagacccaacctgaagagctgcccgcatggtaggcctcaggccatacccacggcctctctagttttactcctgcagtgctgagcgaaccttactaatctaactggcactgagctttgtgccagacctgggggtagtaacaaggctgttagtgtcttgaggagcttttctaagtcatgatcataaacaagttctaaagcttgggtctccaaaaatcaaagaacaagatgtatgttcttttccaaagagaaaatttgtttcctgtgctgcagagttgctgccaatagacacttttggaggactacacgaggctgcgcatttggattaaaatcagagatattcatttaatcacccattccagatgtttacatatccgctctcatgtaggcttctccaaaagtgaggttttaataaggaagagagtgtttagacagcactcacctttttctccatgacttttctctatacagctgacccttgaacaacgcaggtttgaaccgcacaggtgaccttatatgcaaattttcctcttcccctgccacccctgagacagcaagaccaacccctctccttcctcctcctcagtctacttaacatgaagatgacaaggatgaaaactttatgttgatccacttccacttaatgaacagtgaatacattttctcttccttatgatttttaaaataacattttcttttctctagcttgctttattataataatgctgtatacaacacatataacatataaaatatgtgttaattgactgtttatatcgttgataaggcttccagtcaacagtgggctatgagtaactaaggttttaaggtgttaaaagtcatatgtggactttctaccacacagggggctggtgctcctaccctggcacctccccaccattgttcaagagtcaactatacatggaagtttagtgggtttggggctaaagaactatagagagcgctatgaagattctgactgtggtagcatttaatagcatatatcaactgccaaatactgttttacttagattgaaaaatctcagcctaacatcctgtggtctctgcctttcctcatttccttctacctcctactctcccccagcctggagaccttcccacagtagaattactccacttgacattaaggattttatttggtttcaagaatgcttctctttttttcctttttccttcccttgtcactccctctgtttctctttttcctgtcttcctttttatgtgtctttattttaatattcacaggagcaggaagcaagttctcctagccgcacgtggaatgcaaatgtccaaatgttgcgcgtgggaaataaatcgaatttctgagggttaaacgaaggtcagtttgaacatttaaaatgtctgaaaataaaatgcaccaatcaattctattcggatgtgtgtgtgtgttaaacatcattttagcatcccatctaagcctatttgctcggtttttctgctttgttttttcttgcacctcagggtgatggcttcaatagctcgtttgcaccaagtagtaacaggccacagcgggcgaatcaaccttttgtctgcctcatcagactctttgccccattgtcccccctcagatcccatcagtatggggaaggaggcccggccaatgctggtgaaaacagaatcattcctgtaacagagagggccgttcctgcactcagggtgtccctgtgacttctggcttctctggacccacggtagcatttgctggcgatagaaaagcggttcttgttgggttattctcactggtgcctgcagagtcatgaaagcagggaggacagcgccgtccacctcctgcacacagaagtctcagctggaagtggcggtccccgagagcctgcgctccgcagcttgttttagccttcagaaaaaacgctttctttctgtagcttaactgcttggcccacagggcagccagctgttgtatgctgcttgagcagaggtcgtggaggggtgagtgagcacagggaaaccttttaatacatattttatatacttcagatcactaatgggagctacacaaacagatccatttgaatatctaccccctggggctatatttctgtttcgagttttctggtaacagcaaggatcaaaaactaagatggttcttttaaacacacctgattgaccagaaatatgcataaataagtattctgcactactgttgtatattttattattcttattatgtttcctttttgaattcttttttaagctttattgaggtataattgacaaataaaaatgtatttaacgtgtgcaacgtgatattttgatatatgtatacattgtaaaataatcaccacaatcaagctaattagcattaaattgattttacatacttttgattccatatattttaaattagacaaaaaattagccttggttttgataaaagaaaaacttcagctggattaactttaaaggcgtctaattgagtgatgaacaatttgtgaatcgggcggccttctcagccatggtaagctcagagaccccagcgcagccatgcgggggaagatttatggaaaaaggaacatgaggaacagaaaacagaagtgaggtacagaaacagctggatgggtggcagctcggcgtttgccttctgcgaacacggtttcaacggctggctacatttgattggccgaaactcggtgactggcacaggtgtcggctacggtcggttacgcctccacctgttatcgttcacgaggtgcagaaaagcctttaggccgaacttaaatgtgtaaggaggcagctcagggctaaccttgatttaacagtttcacacatgtcaacaaaagtgtaaacaacatgatttaagcaatagagatgagaggtcatctcagaagagaaatggcatttataagaaccacttggcattaactatatttttgtagaagatggcttttcttatggtattattttaaaagtgttcaaatgatatcaaagctgccattgttaaaagtaaaaaaatcctaatgtggatacttacaaatgtctaatatcctaatacttcaataatgtcccagtactttactgtgtaccccaaatgttatgtgtcgttttataaaatgattatataatcttgctggggtgttcttgtcactcaccattacggaagagaaagccgactcggagaggagtggccatttgtccttcttcacagcattaataaatagtagacccaggaccgagagggctgtttttatatccctgcaatgtttcgtatgtttgaaatgtgttgattgaaaatgttcttcctctttgatgaagaagagccacagtgaccgccaaagaaaccgatttagaacagtttcttctaaagctttccgcttggacttgaccgtgggtgtgtctgaatgtttctgagccagctccacaccaagcctgaatgagcccaagcaggtcacgaaattgaaaggactataaagcaccgtatcagaaaaggaggagaaacccaaggcgtatccgttagtggctgcatatgccaatacgcaccagtccacgcttttctgagcctgccagcatccgcagcctctcctgctcgcagaggttgtcagacaccccgggcttggctcagtcctgctgcccagttggaatcaaatctcaagagagagacaaacactgtaaggagtatgaccttctccagcaagacagcaaaggtgcaaaggagagaaggatgctacatagcccgtgtgttttaaagaaatgcaaatattaaacgagaaaaaaggagtattagtttttttaaaaaatgggagtgtacagatatgcaacaacatgagaaaacaacacaacacaaaacaactttgctggttcttcaattaaaatgtacacaatggctctaatgcaaatgattgccatattgaattggtcacggagttgaaattaaaactcatgactagtgatttatacattttgcttaaatcaccaaatacaagcaactctttgaattgaactgttttatcccttctactataaattcctaaattatacaaattccttcatttccttcttccttcccttcctttctcttttccttcctcccttctttcccccctccctccctctctctctctctttctttctttccttccttccttccttctttcttttgtctctctctctctccttctccctctttccacttagccatgctataaatagtaagaggtaaaagaaataaaaacagaaataattacaggcccaaatgtattattatcttcaaaggaaattacaaagagaagaaacaagagggatttccctccatcgtgtttctatacacgcacgatattctaactaaagcatgttacaagtgatctatgttatttttacaaaccaagtgagtggtttaaagaaaatggaaagatgtgtcctctaagaaaaccacagttacgtgagtggtaaatggaaacaacgagactcttaccttctaagctatggggtctgttagctctgcatcctgtatctcagtgactcagggcaggtcactaagcctccttgagaaccttgttttcagtattcatggaaaaggagggaagtgacccaggcaagggtgtcgactgtgaggcatattgcttatgtgcagttctattattcttggtgttagaaatctgaactctcatgtttcagtaaccggaaaatcttcagaaaagacatccccggcgccatggttgtcaacatgctcaaacacctcgttatagcattcttgccccttactggtgcaacttcttgctactttcctgtagttcagtgacagaagttgggggttattcttggtaccttcttgcaggtaattcccaaaagtcactggtgctctaagggacccactcatcctcacctgataacccttcaccaggaagcagcaaatgctaacaactctctatacttgcactcactctcacgacctgcccctgctgggcctgtggtcacccgagagggctttgctcccaggccatgggagggcacctgctacatgactcactaacttccctgtctggcacaatctgagtcttggtgcagacccttttccacaatccagactctagatagcagacatttcccagagcccatcctatttggttcccttgccgtgtgtattcctaaacaaaaatcatttcagtgcaaatatgagacactttttgatgtgtgtgtgtgtgtgtgtgacataagaaatgtaaaaagtgaatggtcatatttttaaaaagcaatgaaaatgggccgtatgcggtggctcatgcctgtaatcctagcactatgggaggccaaggtggacagatcacgaggtcaggagatagagaacatcttggccaacatagtgaaaccccgtctctgctacaaatacaaaaattagctggggatggtggcgtgtccctgtaatcccagctactcaggaggctgaggcaggagaatcacttgaaccagggaggcggaggttgcagtgaaccgagatcatgccactgcactgcagcctgggcgacagagcgagactccgtctgaaaaaaaaaaaaaatcaacaaaaatgaagagagtatattaagatctggttagacgtattaattagacctacagaggaaattcctaaagagccgtgcaggcccgttcttggagccctggaaatgcacgcatttcttgatgcctctgaggatgcccctctcactctctgattgtacttgacctggcagctgctgactccgtcctaccccggttacacagggttagaggaatgttaattacccgaggatgctgtgtcatccgcacagtatccgggagaaaataacaaggacaactcccttcatctgagaaatacagacatttagcgatataagtgccacgctcaaaggtactggtgttgtgtgggcacatatttgggcaggaatgtagatcctcttatcctactactatatgggcatctgatacatagatgcacccagccagagagtgctaaccctgtgccctactgcaggaggggtctcagcaagcatctgttcttgtcgcaggtaaggactctgagacctggaaagggttacatcatttacgtagtttaacacagacagtaaaatttaattggggatcaaaaaaaaagttctaaatgtttactttatggagtattgttccttaaaaaatttggatttttatgctttcttacaacattaaagtacattcaccactttttcttgttttctcagaatctgcgacatggataaaattctatctctgcatcttacaggtattaaaatccagttccctgcgtgcatgctccagtttaagtggatggctgattctatcccgtcatcctgaactttgtagcttcctttaagagatgataaattagggaacaaaaggatcttcctttccgtgacagcagcactttcgggaggctgagcatgtacctctgactcaaggctgagttattataagaaaaacagaaaaggaaggaagaaggttttaatttcccactgttgaagacagtttgtcaggatgagagacagacagacagagcgtgcacagacctgcacttctcttcggggatgaatagggcaagtgtttcattcatgacgtcttcaaagcgttgcccggaatgcaaaatgacatggtttttctggaatactagtctgtttgaaaggccaaggaaaggtgatacattttgaatgcacatttgggtgacttcagggtctccttctataaccagaatggagatgtccctgaaaggctgtcaacagagaaaaaaagaattctggttaaaattccattattccagttttttttttgttgttgttgttttttttttttgcctgcgttgtgtaattgaagatgtcttccaagcagaaacagacccttgtttcatgtggaaaaaaaaatacatagactaatagactacagagaaatagaggtaaaaagaagattgctgccacttcccagttaaggaatgcgttgctttcacccaccgtggtccctgctgcctgtgactccaacacaagaatcaatccatctgtctttctgccaccacagacatctccctaaattgatctaatcttgtgtctattcttaaaattcttcggattgcttcttgttaatagataattgaagttcagtagtacagtctttccatctccctttccttcctgattgtcaaatcactttgacccaataaatctcacttaattttttaattgtatgggaatttaaaaatggcacatgttttatcatatgcctgggctgctctacccaacttttcaaagttctttccatccttcaaagtctagctcagcacctacatcttcaaacggtaaaacttctctaatttttttgcatgaaataaatgtgcctatccaatcaggatgagccactcagatgtgtgactgatgtcacacagggcttcaagctcagaagagcccaccggatgaatggtttatttctctgctgttgtcatcttgaaatttgaagaaggggcccagcattttcattttgcactggactcacaaacgatatagccagtcctgcctccagtactcctaaagttaacaatttcatatctctgctccaataattctcatccacattgttgttttgaagttacctttgtaactcccactagattgggagctctaggaagccacagatcttatttgttgagtttctacaagtgtggggaagagtagtgtgcacagattaaagctgccaatgggaaggtaagaatactatcagagttcatcagaacagaactgaaaacagccaacatctcctgagaatagcagtgctatgttctgagtgtttgtgtccccccaaaattcatgtgctgaaatctaattcccaacatgttggtattaagaggtggggaatttgagaggtgagtaggtcatgagggtggagccctcatgggtaggattagtgttcttatgaaagaggcctgacagagcatatgcccttttaccacatagaaggtgccatctatgaagaactagctctcagtagacaccaaatcttctggcaccttgatcttggacttcccagcctccagaactgtgagcaataagtttctgttgtatataaattacccagtcaaaggtattttgttacagccgccagaatgcattaagacaaatagtaaaaagaacaaagaagttttgcacacgtagtatgcaccaagcactgtgctttgcactgcgcgagaaaatccaacctggttctcacaacatgaagcataggtactatattatggcttcagtttccagaggaagaaactaaggcttagagagggaaggtgtcacacactaagcagcagtagcaggagtcgctgtcagttctggctcctaggaaatcaatgagtctgtattcataaatcatagaaaattgtgacattttcatgcaataaaaaacctaagaatgttctttatatatatacatatatttttattatacttcgagttctagggtacatgtgcgcaacgtgcaggtttgttacatatgtgtacataacattaggtatatctcctaatgctatcccttccccctccccccaccccacaacaggccccagagtgtgatgttccccttcctgtgtccaagtgttctcattgttcaattcccaccaagagtgagaatatgcagtgtttgtttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgagtagtgccgcaataaacatacgtgtgtatgtgtatttgtaacagcatgatttatattcctttggtacacaaagtaacaggatggctgggtcaaatggtatttctagttctagatccctgaggaatcgccacactgtcttccacaatggttgaactagtttacagtcccaccaacagtgtaaaagcgttcctatttctccacatcctctccagcacctgtggtttcctgactttttaatgatcgccattctaactggtgtgagatgatatctcattgtggttttgatttgcatttctctgatggccagtgatgttgaacattttttcatgtgtcttttggctgcataaatgtcttcttttgagaagtgtctgttcatatccttcgcccacttgttgatggggttgtttttttcttgtaaatttgtttgagttctttgtagattctggatattagccctttgtcagatgatggaagaacattccatactcatggacaggaaaaaacctaagaatgttgtcactgtaaccaagcccaagggagcaaaattcttttctcttgcagtcccaaccctgagtttacaaaatctgtccacacatacccagacttttgagttgtcaaataagtttctaataagaaaactttttttagtttatgccaacattttactaagcccacctgcagctccctaagccactcctttaacaaaaatactatctttttactttctagttttttaagcaaaaaattttatatatttggagaaaagtgtttcatagacaagccagaaaatctagggagaaagagatattacagaatctgctgagcaagaggattgggtggaagtcaaacccatgttagcactccatatgggagctccaatatagtcatgaagaaggcccccatttcccattagcttctgagcacttgtaaggcatcaaattcaaggagacgactaccagggattaacatcaaaggacattttactgagttgagttcatcagcagtttctacttattaatttattgttaaaattatatgcttcatttccgttgcaggccttctttttttactgcttaacccaaatatgtaccatgggcaagatacatacagtgctttaaatatgttactataagaatttgcattccaaatcaagacatcattctaaatcattcccatcaagatattgccaaaagcatcacacataggctatagccctcaatatatattattgtctttcatacagagagactgttcaataaaaaacctcattgtgtctgtccttcatgtttttaagctaattaagtgttccaaagcttaggtcttttatgattgtgaataaggattgttattcacctcagtagttttcaggaaaagataatgcttctgttctctctttctcagggaccactattacctgagtttcctggagctttgagtttttttcaaaattgttttcttaaatctttaaatgaattgcatttctctctcctctaatgagcaaaatatgaagaaatgaatgactggatattctatttggacacaaaaaaggactgatatagcatctgttcacttcagcaaggttgctccagcctacctacatgtatacctattttccacccatgagaatcgaagttcccttcagatataaatttccttctttccttctttctttctttctttttgtttctttctttctttctttctttctttctttctttctaccctccctccctccctctttccttccttccttccttccttccttccttccttccttccttccttccttccttccttccttccttctttgcagaattttgctgtcagccaggctggagtgcagtggcacgatcttggctcactgcaacctctgcctcccaggtttaagcaattctcatggctcatcctcctgagtagctgggattacagatgcgcgccaccatgcctggctgattttttgtgttttagtagagatggggtttcaccatgttggtcaagctggtctcgaactcctgagctcaggcaatctgcctgccttggcctcccaaagtgctgggattacaggcgttgagccaccgcaccttgtccagttagggatttctaagtaatgctaatgacaagctgctccagggtctgatgttcccatgtggtccctgttggatacatttttaatcctaattttggaaacttaacaccaggtatataatgactgagaacggctgcaacttatcaagacacaattcttacatcacatatatgtgatgcagtaggagaatgtataagaaatgtcaaatctcattctttccaaaatcttgtgttaggtaatttatggtttttatgactaaccaattattctggacataaagacttttaaaattataataatgaaatttacttggacttctagttgaggtaattacaggtcatgaggaacacagtaaaagctgccatattaaagaacagttataattgctgtaaatgattttgttagtgcggaaccagttgtaatccaattacatccacatttgaaaatgacaagaaaatgttgagagacatgtttcccaaccagaccattcacctgtcaccttgccagtgtatcatttgaaggaaatcttttgtagcaaataagaatatacccggcctcctttagatccagaattgaaaaaaattagaactaaacaacaacaaaaccatcagttattttgtaagaactgtataagaaaagagagaggagaattctcattttagtcaacgttcacctagtactgttctaggtgtcgtaggtattaaccagtttaaccttcacagaactaaatggcagggattcttatttctttttgcagttagagaaactgaggctgaaattaagttacttgcccaagataaggcagcaaatctggtttacctaattccaaagcttaagtttaacttattaccataccatggtaagaatcattttgatcttaaaattacttcagatgtcttagtatgttgatgtttaccctcataagtaaatgagaagtaggagattctatatgtgttcatacctaaatgacaaataatgaaaggtatttgtttacatatacattatttaatgaaaaaatgttgcattaataatttggacataatatggaatatttatgtaaatgagaagtaggagattctatatgtgttcatacctaaatgacaaataatgaaaagtatttatttgcatatacattatttaatgaaaaaaatgttgcattaataatttggacataatgtggaatatttcctcacaaaaattcagacaacaatttttcttccacttttatactctttatctatagctatatttaaatcaaagttatcagcagatcatactgggaatcagtttgtgccacaaggcaaaataaattgacagtattagaagaaaggttaatagtccctttgctaatcccaacttttgcactaggtttattattacccttgaaatagaacctacacgatcaatttcaaatatcaaagcataacacacactctacagggaacccataaaagaaagcagaggaggcaatagctttacagttaggaaaaaccacgattttgattgtgcgtggaaaacatcaaattaaacttggtacttgctattgactcagcatcctgcttctcccagcattccagcggaagtctagtctgctagctccccagagtgagacctttactcctgtggcattacttgctggcaatacagaattgaacaggttctggccttgggggaagcttatgattattttcttcaatgtgcaaagtaatgcttaaaggaaatagtctcttaagcagcccaaaatgtgaaaaaaacaagataaatgaggtttgcaaaatttcttcttttcctactaatttatttctggttcagtgaaaaattcattttagaagggttttattcctcctatgtcccaagcttggtcttcagtccccagttacagagttgttcacatcgtcttcttcatgccttttatttctgcacaaatccatgttagtcatgcccaatccccacaggccacctgagtgctctacagcacgttgctcccgctgcacccaggctaagggcatgagagatttctctctgcatgtagaaagactggaggcatgacagcaactaacgttgactaattaatgctgaaagggttaaagttgtcaagttcccaacttatttaccattgacacaccccagatttgttctgggatgccaggagatagtatcattgcacaggtgtgaagaaatagggcattctgaccacaaggataggccagaaatttgggggtcattatttcatcatgtacttagtgccaggaatttatattttaggtggataaggttgtcattgttccacaacatctgaggacagcagacttgttgaatgaatgaatgaatgaatgagaaagctctatcagctccatagacaaatgccgacttctacagattacttggagataatcttttaataaaatgaaaaaagctcaacaaacctgagcaactaagaggagctaacatttcctaactgcctacggcaccatgccaggtacttcacgtacactatttgtttaagtacagacaacctcctacttagtatctacgatagacagactcaaaggtggctcccagggatctccttcccctggtatttgtgccttgatatagtcgcctctcacagtgaatagggctgacctctctcacctgtaggattttgtagaaatgatggcacgtggcctccaatgccaggtcataaaagccgtcatggcttttgccttgctttcccttggataactctcagagcgaggccaggtgccatgtcactagggcccgcaagcagttccgtgaagaagaccgcatgttgaggaatcaaggcttcctgtccaccacccgcactaacgtgccaagcagtgagggagccacccggaagcaaatcctccatccccaggcaagccttcatgtgacttcagcttaccgctttcctcaaggcaatgtcaaagagagaacctgacaagtagatcctggaaccatccagctaagccactcccagattccagacccatagaaacaatgtgaaataataagtttttttttttttttaatcattgaagcctctgtattttggaggcatttgttacatggcagtagattgctataaaaaccattattactctcattttatggatgaagaaataaaggccatgagacccacaggtacaaaatgctaatagctttccctcattgatcaccttctaaagaagacttggaccaccgaggatggctgaagccaagaagaagagcagccagtagtgggtaaagaggcagaggcgcctactcatttcttcaacaaataactcttgggcatctgtggtgtgccagtcagtgttttaggacatgaatttgcatcagtggccaccatagataagttacctgtgtttttaaggcttacaggctagtgtgatgattgataatgaacaaacacatgaaaagatctattacgaagtacaatagaaggcaagggagaaacaggttcagggaagagcgagactgcgaaagggcagcctgccacctcttccttcccacacagagcatctgcagggcacaccccttcatccaaggctgcctgaatgtgttgctctgtcctgaaacatgaaacttattagacaggggccattcttctcttttgtacactcacatacatcccaggtgcctaaagctaagcctggtacataatttgtgtttagtacatatttatggcagtgtcttaaattctcagatggataaaatttttagtggatttacctgcctaaggagtttgacatttttcagctgttttaaggttagcacgttatttaagacagagtaaattctgctggtgtaactccttttgtattaccaaaagaacaaaactcattgtgtaataaatatgattttcttcccaatagccatgctagaaattcatttatgtaagcaagatattaagccccaaaaccaatgtactaaaaatgcaataagtgctccagaatactctaagaatcaaaatctgagatattgttatgagatccccaaagaaatgtccatgatccaaagaagaaatcagtctcgtcacttacacataaataaacccaggtttcttgagtctgtttagttccgccatgcagctgtgcggctccaagagcaccacaccaggaggaccagaggcttctcacttcacgatcacagccactgcagcctctttgggggaacgtgagagtctcttttaaagccctgtagtctcaaaaaataaattgtaagtttatgaaaggcagaaattaggtagttattacttgctgatcaaagtggtttattacattttaaaatgttagtactaaagggaacttcaaatattagggggctcaatccttctgctcccaaagagaagcccaaagaggtgaaatgatcatcctgggaggcaagagcaggaggagttgctcatgccagcctttttaaaaactcctcccctggaaaccatcattcttagcaaactatcgcaaggacaaaaaaccaaacactgcatgttctcactcataggtgggaattgaacaatgagaacacatggacacaggaaggggaacatcacataccagggcctgttgtggggtggggggaggggggagggatagcattaggagatacacctaatgctaaatgatgagttaacgggtgcagcacaccagcatggcacatgtatacatatgtaaaaaacctgcatgttgggcacatgtaccctagaacttaaaataaaaaaaaaaaactcctccccaaacacattgtgtttctttgaataatccagatactgtcacctattatgactcaagaaagtttggctgattatttccaatgggactgtaattaagatgccattggaggcagtgttgcatagcaattttagaatctgggttctgaaatctgagatcaggcctcaaatactatctccatcattttttagctgggcaaattaatctaattctgttttttcacctttaatctagagataaacacagcacatatctcgtggagttttgtgaggatcggacaagatgtcatgggtcggttttaggaatacttcttagtgcgtgtagaactgctcatgtatcctaaactactgctattgttgtaatcattatttcattatcttcagaatgtcttgaagtctgagagttaagatccagtgagagttaagatcatggtggaccaaaaagactaaaaagagtttaggctatttcttggtgcctggggcttatgatggtagaaggaagcagagacagtgaaggagagagggctgctgaagggccctggcctctttcccaagccactgcagattatctacatgacaaccgtgtgcttgtcactgcagcttcaaagcaggtccctaagccccttttcctatcaacttgtcatttccaagcttctcaaaagtagaaattctaactggtcttcagtgggaaggtcagggtaagtgatggaatatttagctggtgatattttatagttcaaaccaggcattcacaatagggaattgtattcatggggagtagaaccctcattctggagctgcttagttttagaatcaaatgaatctcatgcccaggaagaagaggggacaagacgtcaatcataagaggccatcagatcccactatgcagaggctgatgggacatgagagtctcagaatgcaaaccaaccatgaatgaggatgcgtggtgtgtacacatgtggcagagaggagagttcctggactttgaaatgagggtatagccataaccttcttatcagaattgaaatgtggatgtagccataactttcttatcggaattgaaatgtgagtgtagccataaccttcttatcagtgttgaaatgcgggtctagccataaccttcttatcaaaatcaggcatcacagggattagaagggcttcagcccaggaaacaacatggaagtggattctgtggcagcaactgaaagctaaatccctggaaatcaggatgaaaaagcgttctctccctcagccacgatggaccagagacctgattaggtgtgtagatgtgtgtctgtaagtgggtttgtgtgtacacactatgatggtctacgtttgctttttggaagagggtttgctggtcagcccctcatgtggagtaaggcagaaactggggcagtgagcagcagagttgtgtatataacacctgactggttttattagagctcaatatccctttatatctattataaaaagtgatgttcatttgcataccataggtgatgcaggtgctcaaatacagcaacaatcgctgatctttaaatacgttccatctgtgggtaaaaataattaccttctgaatctctgttttacagttgcattcaagtggggtgtatctgtgcatgtttgtggttggcagaacaatggcctcccaaaagtatccgtgtcctaatccccacaacctgggaattaaagtagcagatgaaattaaatttgctaaccgacttactttaaacatgcagattatcctggattatctaggtgggcaaaccgtagtggcaaatcttttaaatgaggaagaagaaggcgtcagaagaggaagagatagacagaagagtcagcatcagaagaagacggtgtgagaaggactgacagctgttgctggctttgaagatggaaggagtgggtgagccaaggaggaagagctgccctagaggctggaaaggcaaggagatgggctgtgccctaaagccccaggaaagaaggaaagcctgctggctccttgattttcaccctgtatgacctgtttcagagttctgatgctgtattctttaaaccactaatttcatgctaattttttatagcagcaatagaaaaccaatatcatggtatatgcatttttaaattttataacacaaatagtttcaaaaagtgagaaattcagatgtttgagctcattttctgagaagttccatctggaagtcagatcacaggagcagtccttctgactctgttccacatcgtaataaataatacttatgttatctcccgtatactctgacgccttgcaaagctacacaccatgccatagatttcctaaacagcaacatttagagcaatcgtttccatgtaagtggtactttctacaaccatttgtttcttttttcttcctttaatgcattttaattaaaggtaagaagagaataaaagagagttggaggaagtacagcagctgtgatgtgtgggtataggagagcacagtctgcagacttatgctccatttgaaggtagaaaaacagtgattatagatatattgctaaatgagattctacataaatccagactttgaacatgagacttgatgtaagtaaaaaaagacactgattcctcatggctgcatgctgggttttcttgatgtttaattaattctaatgatgaagtctgagtcataagtgctcattcaacagagaaacggaccctattttaaaaatataagcctttacacaaataattgttggctaaatgcttgcagttatcaatagcggttccgattttgaatgtaatgtttagtgcacagaattcctcgccctggccaagcagaaagaaaaagtgcaaaatcaaacagtcaacgcgagaatttaaaactatacaaaagagagtcaatttttttatgaggaggtgatcacatctgtggtttttctgggaaaaaaaataatactggcttccttcgtggactctctcctgtatttagatcgactggaatgtgctctaagaaagcacactcattttgacatcagcataagcaaaacaaatctgcctcaaaacatttgattgtaaaacacctccagctcacccactgctctagggatgtgtcggcttcttcaggaatcgtgggtgatcataacacctggtaggcacatcactagtgaagtgtggaaggcaatagcaaagctagaatcaacaatatctcgtttcctacatcatttaggctcaaggaaaagactttgtgggaattgtggtaactgctgttgtgtattattgttatgcattattaatagaaataattttcttgccatatcactcgtaggtagccttgtattttaaaatataagaagatccacggctccctatctacctaatatacaagtctatgattgtatggtgttcctttattctttctactataaattctacttacagttttcaatatctttatggaaattaatatcttaccgaatagagtcgagggagtttcaaaaaatgtatacaatcaatttgtacacatatgaaggtgaagcaaacatacccatgtcagtaaaattactgaatggccaaaaggggaaataacccatgaatttcatattaagagtgaaactgtttagagtgaaagaaactggaattttcatcttgctccactcctaactagtcatatgctccaggactacttactcgtcatgtttaaaccttattttttttgaatattttctttttctaaaggttaaaatccccactgagcttgtgggtttgttgcgagtactgcataagttaacctaagttagatacagtaactgcctaccccaaaccatcttgcccctcgtcctctcctttcctgccagaactctgatttactccaagtgctttgatcttaggctaagtgagaccagcacctgttccgcaggtatgttctataggtgggcgtggcctttgttgggcaatgagatataggggaaagtcttctaggggctgctggaaagttttgtctccctacaaagagggaaggagcaagaaaacacttcttccatgccattgcgtgcttcgtgcctctgaactctgtccactgagaagatgatgcttgggattgcctcgccagtcttgggatggggaaggcaatgcctggagaaataccagcaactgcttatttccagaattactgttttgtggtgggaaaatccctctggttttaagactgttgactgctggtaagactttctagtatttgaaccttgaccttgttaggaatgcagggattgttaatgactgtttttaatgttgttttactatattatagtgtatcacaagtggcactgataggccggtttgataagttcccagatgagagagagaattccaattgcaaaagtcatggtaaacttcatagaggagggatccatcccactggacttgatgggtttcagtctttgagcatggagaggctggaaagggtgtgtgggggagttccgttctgagctagtagacccttccacaggtatgaataatatttcaagactcagtgtaatgaggacaaaggagaagtgtggaaatggagagcttttcactcaaatctgcaggcccaccttctcttgcaaagctcttctagtctatgtattatctttgggttatctatggacttagagtaagtgcaatatagatttagtttggctttgttttgaacactatcttgactgactctaatagttttagaataaatatagctttacttctacttacattatttttgggatttttttttaaagaaaaaatacattcgtttagtttaagaattggtaaaacatatatattgaccaggttttatttttcatccagcaaagtatcacgatttgttgcaatgtgcacagccagcttaaaaaaaaaaaaagagctgttcttagggcttatactacctaatttcagcagcaccactaagagaaacaaggtgtagctctaacagaaggtgaatggggaaaacaggcacagagaagaagtgggtacaggcagccgcctggcctctccttattgcacaggacaggcagggcagggccgctctctgtggccaggcttcagcaactcaggcaccccagtgccagaatcagccccaccacacaacacgtacaggttagctggaaactgtttaggacacacagagtttctccaagtagcaagaaacatatcaaaggaccatcagacccaggaatagagtgaaaatgagtgacagcacatttgttcttgattcccttatatttcctggttgggccagaacaaaataagaaacagaaaaggtgagacttgctgaatgtcacatggcatttcatcattatgttatctattttggaacatttcaactcattttcaaccttttccaaaatgtttactttttcaggtttttccagtcagtgtttctagtattgtccccaccattttttgtagcagtctatttttgaaacgcacatctttggctaccttgaataattggaaataaaaacaatgttgaaaagaagtcacagagtacctaagaatagacaaggactgtggcagttattaaatattattacattaggaagtatcatgattttgttaggtaggtgttttgagacaataatattaggtctaattgttttgcaagtgggtaatttgctcagttacatgtgattaagaggggaagttagggtgtagcttagctgtgcctttttccaagatgctgccctgttctcagtgtcttgcaattctactgcagctcaatacccatcacattcagtggggtatagagagaagaaacacagaaaaagcaaaacagacaaaagaacaaaggaatttagttcaatttcaatcaaatatctgattttgatttttaatcaaaggggatcaaaagtggtcaatacagaggggccatttgagtcttgtcaaaataattataatttttgtttttcttaggactgcattttaaacacttagtgaagaagtttggtagtatgctggcatgaaaacagaaaatgtgcccttgttaacctatccatctttaaacaaaacaacaacgacagaatgcagcaattattggttgcgtgtcctattaacccagttcgttgtgacatgtgaggatagactgagaacttgccttgacttgagtatgttatgtccatacattgtaaagtataatttttcacagcattttgcaataagtgaaataggtattaatttaagaatagaaaatatatatttgggaccaattctcactttgcaatactgacaattatggtagaagataattaatgactatagaagaataatcaatgtttagtttaaaagggttttcaaacaaagactattttaggctttaaaattactgttgtttaaatttttaaaattaaatatatatgatatttaaaacagtatgaatttccttttagtttttggattgcattatttttgaatggtctcattaaccaaaaatcttaaatgattttaaatatttaccacaatttcaagagcattcagtaaaatggaaattgtctgtttttaattgtatagctttcgggatgcagtgtacacctaaattgtattcaatcatgatttactacataaatttgattaacttaaatgcatggtaagctctttcctgttaatataaatggaacaaattagtgttctaaatagaataggaaagacaggaagcaacgcaaatattccagattatctgggctgtttttaaatgctttttttcttctctttacttagttaaatctcccttctataattaaattaaaatgattgtgcctggatgattaaatttttcccaatatgtatgtttcattggtaatatctaaatgttacagtataatacatattgtccaagtggggtacgaaagtctattaaaagaaataattttgtacatttaatctctctcctgcaccctatcaaatttagttgtaacaatatgaaaatgtaatttgagcttattctcatttttttacactatgcttttctcagtcctggaggatgaaattatattatctttgttttctgtattttgtactctctgaactttttaaacatcaaaatgtacatattatttataatcagaaaaaaagaaagctgtcttattttgaaaaccatcattttattgttaaaagcttatcagaacgagggagaagccttgccctgtttactgttgtagacacactgttcattaaggatgacttgtttggaaaaatccactcccaagacctcttgacctctagggctaagcatggcatagcactgggtgggttggggataagatcataagactgtggcgtgggagtgcttgagttcggatcccagctctgtggcttattactctttgaccttgggcaaattactttgtgccttttctctttagtttattctcccataagtgttgataaaaaagtactagctatctcacaaagacttaagacgttaataaacacaaagactttggaacaatgcctagcagaggtgaccattctataacttgatgttaggtgtgactatgagctacgtaatatgaaacacttccaaaaaattaagttaaaaaagaatgatatgcaaatattcaaaaataatctgaaacatccagtggcattttccccaggtccttgtctctgtgggactatactgctccagacaagagggcaattgagcatttgccccgtgaattgaggtaaaaaatgccagcagattcatgggcactggacacaacagataattcagagaaaaggaaatacagatagccaattagcaatgaaaagttttcaacctcagtgctaatcaagaacttgcaaattcagataagggtaacatgtggttcatttatcaaattagcaaagattataaaataaaggctaaaatccaagacatgaagggtcagacacacattcttatacactgctgattggagtagaaattagtcaaaccctctgaaagcaatttagcaatgtccagagaaaacatacaaatcctcaagagctttgagttagtaactttttccggggagttatcctaaggaaataaagataaagacattcatggcagcagtatttataacattcacaaatgaaaataatctaactttctaacaataggcaattagttcaataaatgagagtacaactagatgctagatattgtataatattgcagtaatattggtaagtagagatattaatgagttttgaccttaagtcaaaactacttatgactgaaggttggaccatgtaaccagcactgtttcctctgggtgtaggggagtgcataggtgtgatccctggctatactctgccctgtcaccatgctttcctggtatgatgggtaaatttgggatggataactgaacatgatctactctaccctttttcctttggaaatctagctgcttgtagggagcatctgtcctcttctcctgggtgatagaatctttctccagaggcatgttttttcctcccatatcggaaagattgttccaactagcattgaccaagagaggggctaatgctgcctacttctgagattcaactgggaggattatttggctatcacactaagccacatacttcagcatggcctttatcaataaaagtgatacattgattttccatctcccagcattcttttatttgtatttttcaaacacttggtgggaaagaaaagcattatactttaaaagactccacaggtacttcaacattagaaactgaccattaataaaaactacataacaacttagtcccaaatgtcagttatttgacatcaatacacttttattatctcatagtttgtgagggtcaggaatccaggcatggcttagctgaatgcaactacctcaagttctctcataggttgcgatcaagtttcggctagagctgtggtctcatctgaaggcttgatagagggagaacttgtttccaacctcgctcatgttgttgtggcagaattgagtttcttgctggctattggcctccagcctttctcagccccttgctgtgtggattgtctcctagtgcagctcacaacatggcaactggctttcctcagagcgagtgactgagagtgcaagggagcatgcacaaggcagaaggcactgtggttttgtaaccacatctcagaagtgacattcctattacttttgctatattctatttcctagcagagagtcactaggtccagcacacactcaaagggaggagattatataagaacatgaataccaggaggctaggatcactgggcaccattttaatggctacacacccccaaaactaacatccaccacaagacaggctcatagctaatctcatttaatcttaataacaagccaaggagtcagttaataggattatctgattttaaaaatgaagatgtggaggctcgaaaatgttaagtgtctggtttgaaagctcacaaaatagtaaagggactgatcagggattggaaccatgacagtccactcgcagattgtgtctccttagctacttggaaaatattaaggaaaaactggaattgcagataggcaaatacattttatgaccttatttttgttaaaaatatatttaaaagaggaagaggacatattaaaatattttagaaaaattttaaacctttcagtgaaggaattacgagtgggtatattttcccctattctttacatgttcatatatatttttcaaaatgctgattatgggttttttatttatctaatatggggcaagctatgaacacaacagaaaaagtctgttctcataggccttacaacaccaggccaccaatggtgtgtgagccatctttcctgagtgcaagcagtcaggtgcactgtctccaaaaggtaacatataaatagagacctaaataaattgagaaaacatgtactgttttcataatcacaaaaatatagagaaaatttaaagcttgggtgtcccactgtagcttaaaatttgaaagttttaaaaattttcccattcattcattttatattcagtcctttattcactcagttatgcatttttattgagtgcctattaggtgccaagcactgtgctaagtactgggaatttagcagctagttaaacatatctcctttctcacattcattttagaatagagtggagaatacagttgttcatcaacaaatgactgagatatataattgcaaactgtgatatgtattatgaagaaaatacacaggctatcaagacagcagaaaccagcagtgcaggtcagtgaagagtcagccacagaggtcattggaattgtagtcaccagtagcatccatttgggaaaggttatatgtaaaaagagaattgggtaagaaaagaaccttgaaaaattcccaaagctaatggtgaaagaaagaggatgagctgcaaggaaaattgagaggtaggaggaaagtccagtggaagccaagggaagaaagctctcctggaggaggagagtgggcagccctgctgcatgaagaaggagagggctgagaagtgagaaacaccttcggtgtttagtgacacggtgtgagtaagcctaggagcagccttggcagattaaagtgggttgtaacttgatgggaggagaagaaacagggaccatgtatattaatagcttttaaagcatatttggctataaagaagaaacatataggtttgtaggtgaagggaaaagtggaaccaaagaagggttttagattatcttttcttttgaaatatgggagagactgtagttactgaaatagtgaagattttgatctcatagagaggatagatgttggctgagggtggggaccattagaaaaaaggtgactggttcctgagaagttgagtttgggggaagaatccagagaagaatagaagaaaatgaatctccttcaccatcctgttgaatgtcctactcttgtcatctttctctttctttcaaggaagcaaaggaatctttaaaatgttttcaaatgtagatgcttagaatttgggagcataaatgcaaacatcacacctaaggatattttcattactcatctcactttttaaagcacttttctatgatttcattatttttatttccaggacagcctggtgaggttgttgggatggctgccaatcaattcatgtgacttatctatggaaacacaatgtcaatcttgctatttataaagtgtcaagagatctatatcacctaactgtcatgccaatgcaattttatttttttaccatactatgcctccttagactcttaaatccattaaatataatcataaagttcacagcttgagagtataacttgaagacaaagaagaaaacaccacagagaaggtttggctcgtttatatcttgacaccctggtaaatgctttcttcactctcatctgaaggaaattagatggaaataggacacatgtgtaatgtcttccacatgaattgaagtgcattgtggataaatgtctggacttgcacgcttgacaaaggtcggtcttagtaccatttactcagccgctcctgggtgaacagacactcctggagagccgattccctcaggctctggagacactccgagcccccgtgcttcttgtttaataacacgagcagcacagagttctcaggcagcctttgtggtttgatgaaatggtatatattttcattagattttcgtgtgtgtatgtgggaatattctgaaaacagcaaagctatataaagataagtaattacattaataaaataaaataacaatactaacacttattgagtacttactctttcctattttcaatagctttaagtggtctctcatcctagtatttaattcttattccattttaaatcctgtcttagtctgtttgtgttgctacgaaggtatacctgaggctgggaaatttataaagaaaagagatttggctcacggttctgcaagctgtacaagaagcatgacaccagcacctgcctctggtgaggccacagggaactttcattcatgatggaaggcgaagggcagctggcgtaacccttagagatcacatggtgagagagggagcaagagagagggcaggaggtgtcaggctgtttttaacactcagatctcaggagaactaacagagtgagagctcattccttacctggaggacagcaccaagacattcatgagggatctgtccccatgacccaaacacctctcaccaggccccacttccaacgctgggggggtcacatttcaacacgagatttaaaggagagaaacatccgaactatatcgagttcttaatcaaggacatagcattaatcctgttctcaaaccaataccattgctggcccactgacatagactaggattcccttggaagcacaagtaatggagaccacagctaacattttggagacaggctgaagcttttcccaacatggagcgagacgcctggaaaataacccatcttgttcccagcttgtccttttacactaaggcatgttcagaagcatgaccagtccttctccctctcctctagccatgctgaactgtgctgtcttttaaatcctggcatttatttctgaatccttggagctttctgctgcaaggtctgttcttcttccctgctctcatcccatcttgacctccatcagtgtggtcaatttcaacagaccctcaggtctttctccagaaagtctccactgaccactcccctacacaaccctactatgggtggagtaattgccaaacaccaatattctaaaacaatcacgtacaaaatgttcttgaaatacattgaaataaatggatatgtaattcttttcagttactttcaattgggtaaagaacagagcagcagaaataatgagatccagtgtttttccttcttttaatgcaggttgtagggctgggattttacttctgaatgctactggtttgtttaattttccaaaaaaaagtgtgagaatatatgctcaaatttctcaaaatacttaaaaacgtattttatttgacctcaagttgtacaaaggagttcagccaaggctcgtgcatttgatgacaggtctctgaagtagaaatgtttgaattctgtcttgaaacaattttgcttctaatcatcttgcaatgattttcaagttattcttgaatttttctgctccattctatgacttgcatggaatttattttgtgacggaaggccacattctgcctatgagggctggttattctgttagaatttcctcctgaaggttcatgtaatattattttctttctctcatgattccttcttctttaattgtcttataagagaacacttggtagttcaaatcacatctaatgtttccctgatgccaaaagcattagtggttttgttaattccaccaaacaaactctagtgtctgagtgtacttattacaattcatctaattcaagtgactggccatgttaatcaacacagcagctttttttatcagtacatccagaggaataaatgaaatacaagacttggaatctgggttgtgtgttctgtttctcacacctacaattaattactttcagatataagtgatgggatagagggagaaagctgagataagggacagttcaatgatagtggaaagcgtatgtgaggtgcagtttcagggctgcttcagttcagcagctcattcttgtgcataaaggagcaggttctttttatcactcttctctgccttccatgggttagattgggcctaacactggctgcctacctgacagcaaaaaattgcaattccagactttggtctgtacatgcacagaccagcagaagacaaaatatttttatgtgtgtggaggggtaagctctaaaagggtgagagtttattttccagaaatcatagcaaaacttctcttgtgtctcattggccctgaaatatgtgctcatttctagaacaaagtctgaccagggcatagtcaaaactgcttgagtaaggcctggataactggattaacgttaagaacaagaggatggcattacccagattgctttgaccagtcagctttcaccccagaagtggggttcacccctgttctgtgataatcacctgtgctgtgtatctatcgacttaactagaatgtggattcacagaaacagggtcttgcactcatttcactttgcatttctaggtcagaacacatttgctctcacatcagaagaactcaaaatatttattcaatgtgaataaagtagccagtttcccatatgagctgctattaggtttgttccctttcagtgattccaagattactcatttagcacctatttgataccggacgcaggggaataaaatggtgatgaacaacccagtccttgatcttaaggaacttacagttttgtaagagagagaaagatacatacataaacaattttaataaaatgtgatgatgttactgctgagcgctgcagggctgagttggggaacttcctgggctaattggaggtgaggaggcctctcagaggaagcgatatctccatggaggtctgtcaggcttatgcagctttgccaagagaagggggagatgaatggttcactgtggagaaggatgattcactttagagaggaacatgacaagaccccgttatgatacccatcattcactttacaaagtctcactgcagacagtgtgatattacctattgttagactggcatggtcggttgctctaaccaggagcatcaggggtattcagccagtacataatgaggaagctaattctgcagaagcagcttctgcaagtgtttcagcttttttgcttactcgacaccagagaggcccactacttagcataatttgtctcagaaatgtgtgtttggccgggtgcggtggttcatgcctgtaatcccagcaccttgggaggctgaggcgggcggatcactaggtcaagagattgagaccatcctggccaacatggtgaaaccccgtctctaccaaaaatacaaaaattagctgggcgtggtggcaggcgcctgtagtcccagctactcgggaggctgaggcaggagaattgcttgaacctggcaggcagaggttgcagcgaatggagatcacatcactgcactccagcctggcaacagagcgagactccgtctcaaaaaaaaaagaaatgttgtgttcatccatgtcttagccccttccaactgacataacacaccaccacaaactgggtggcttataaacaacggctgtttgtttctcacagttctggaagctgagaagtttgagatcaagatgctggcaggttcagtgtttgatgagggtccccttcctggttcagagacatcaccacctcctgcgtcctcatgtggtatgaggggtcaggtggccctttggggcctctcttataaagatactgattccattcatgaggctttgccatgtttgctatatcaactcctccattaagtattattatattccctagttgtcagatgaggaaactgaggcaaagagaggttgaggcacttgtctaaggacacagaggtagaaagcaatagacagtaggtggcaattctgaatcaggctcctgagccaccgtaggagagtggggaaggccatttgtggagagatagccttcacaaaggccagcttgtcctaaggagaggagtgtggaattgttggagggatacagggagccaagggacattgtttaaaattagagatatttcggagtgttgataaggtaataacaataaactcgtctatatacaggctaaaaaagagattgacagttgaacagaagcccctcaggaggcagaagggggtaaaattgaggcaaaaaaggacaaccttgtaacaagaaggaagagtgaaaaataagaatggaggaatgggagaaactgccatgtgggaggaatggcagaatgctgatgtattgattttccttgtgaagtgtgaggagagtgaaggaggaggtagaatgagagctttgagtagagtgatgttttgaaaaacaagtgtcacagagaatggagagaacagtggataatgaaactaagaaagatctcctggtagtgacgagagcctgggtgggtttggagaacagaaaatgatggtggcaaggtagtaaatcacatttttttggggaaaaaaagtcaaatgctctgatttggagggtttgctaattttgttggttcaaacaccaattttgttgattcaaacatggttcataacaaaccactggtggtttaagaagtggctcaaaaaatttctgcatatttaaccactgactgtcaggaaaacacaatcttaggccagtgcatcactgacccataccggcttgtgagatttcctctacagcacagtgaagaaacagaagcagaatgcttaggttggcccaaggttgtggtttcacctggtgaattacaaaggaaaagggacagaaagataagaatataactaagggagtgatgtgattacatgtaatccagattgcacagacatagtggaggtgatgagaaactactattggtgacagtgaataatagatatttagcatcattcttatggggtggtttgtgttgaggggagaggttatggaaggaatggaagatcatgtgtaggtggtcaagatcaagtgaaaaataaaaccttacaagtcttttagggacctgttaaaagcaacagtaccggatggattatgaactggagtaacagatacctggatgcatccctggaatgcacaagatgacactttgtttactgtccctgagaccttacaggtggtcagctccttggctgctttggaagccaatacccatgaaccaggactcaaagggactgtataatttcaaaattccatagctttgtttgagaaagccccaaacctctagcagagaataggtgttccacagtctgaaccaacctggtttttgtggctaatttctcattctttttttttttttttttgtatccattccacatacctctttcacccacactcacaactgtcagacaagattattctgcactgtttagtacctctccgcttttacacatgttctctccttcttatttatacacagaatgccttttctcaccacccatcatctttggccacctggcaaatattgacttattctttatgctttctttctaaagttctcccttttataggaattccttcccctgccctctccaggatggcttgcccttcattgtgatagtgtagtgttctgtgcaataaaaatggaaatatttctcacattgcattctcactttaaatttatttatatctctctagcactagactgccaccttcttgaggataaggattatgtttgattcatactggtatccctattacttagcaaagcaccaggtatatacattcaaagcttttgttttgttttgttttgtttaatggatgaggtccatgttgcctggaacctacaatcaaaagatctaaatcattctgaaaaaatgacataaagacaatacacatatgtttccaatgttaccttctcattatgttagcaacaagcctaatatgagaatatggaaggaattttgagaacagggtataccaaaatggttaaaggcagggctaatatatgtagtgatctcccattctataactgatatggtttggctgtgtcctcacccaaatctcatcttgaattcccacatgttgtgggaggaacctggtgggaggtaatggcagatctttctcatgctgttctcatgatagtaaataagtatcacaagatctgatggttttaataatgagagtttccctgcacaagctctctctttgcctgccaccatccatgtaagatgtgacttgctcctccttgccttccgccatgattgtgaggcttctccagccacatggaacagtaagtccattaaacatctttttcttcccagtctcagatatgtttttatcagcagtgtgcaaatggactaatataataacacaaaggataaattgctaacccataatgacactttcccactgagccaggacgaaaccttaaaatccttttcagcaaagccttccaaactgtcacaacaaatagtgtggagctggcatgtgggaggaaccttgtgcaccatccacaacagaaagtctctctccctagcagctgactctcaaaagtggtaaagaacatttttcctctgcctttggttcactgaaactgttctaaataatatgctccatttcactaataagtaaaaagcagcagattgagtttgttcccaagccttaattataaatcattttatcttccactaaagagtatattttgatattttgaaaacattgaaaccattccatgtcttaatgaacaacatagaaaagagttctacatcttgcataaattcattttgcttaaatatttccatggtccactgtgtaacacagtttatctctagttcaagaaaattcttttataaaacaaacactgtgttttatgccctgttatcacatcatgattctttatgtctagctgatcaataattagatgaagatacttttttaaaaaatcaagaggtgaatttaaaaaaatgtgctggggaatcagttttctctttcagtcaaaatatttatgtatttctttagttcttggacattttctaatatctttttttttttttgagacagtgtcttggtatgttgcccagactggccttaactcctgggctcaagcagtcctcctgccccagcctcccaaataggtgggattacaggtgcacaccactgcacccagctatttcttttatcatttatttgataatttcatgtctttaaatttcttgtcatcttttatattttccaatctcattaactgtttatctttttgttttagatttcctcacggttgttcctaaatctttgcctggagtcatttatttcagatattgtatttcattatttgagagattctttgttctctaattttttctataatatcttgtttgtgtttcatggatttaccatattttaaaatttgtggaagcatagtaattgaactttttagtttttttttaatgattgtctcttctctaaattctctcttttctccagtgccaggtattcttccacattgatattttgaaattcgttttttatttgctgagtttctcttatatacatgcctaatgagtcgcatttcattcaagaagagaaacaactctgggtatgtctttgcaggaggtaattgaaccaagggaactggaaactacaaaaccatgggaagcgcggaggtgagtccgggcccagcaggtctctcttgcggagcaggggtggcgcagggagcatgcgcggcgcagggagcatgcgcagggccggctgcagccattctgccatccggcgcttgtgcaggtgccttccgcggagtcagtctaggaaacgtttccaggcgcctagtctttgcaatcaaaagaatcagaaatgttgctgaggccctaagaggcagttctgcacagctgctcaaaacagaatcggaggatggatgatgggggatagtgtgtgcggctctttgctggctaggtctcctaccagacttttaaaaagtagcacgtgaaggtgtatggaggtcagcacacagcgctgcttaggactctttcttcacaggaagtgggtaaggagctagctgtgagatgcaagtccctcaaatagtaacaacaacaacaacaacaaatatttttaatttggaatgccaccttccaagttaggagcatcagctttccccaacattcctttcagtttcttggaggagaacctctggggtttggcactggggaaatatcagctgttacttgctttccattttggataaggattgagggatggaagtgctgattcagtcactgtttctctcttcagcagcatgcctgcctcaacctcagccctcagccaatgccttctgactccgagccgagagcccttcctgacctcgtggctgagcgtctctggccttctctgcagctcctcaacggtgtggcagcgcagcgcaggccctcctggctgaccttcagaaatctgttgaaatcttaaaataagaaaacagggaagcttgctgcatcgattgactcttcctttcacgaaagatttctctgtagcgtgcaatgctatgcactggaaaaagaaagaaagaaagaaatctgttgaaatcactcgttcgttgctgttgaccctctccacaccgttgtctttgagaacctggattgtacttataggctttatttcatggaggcttatggcaaacaggtggcaagggcatatgtctactctgccatttaactcggagagttttgcctgctttttaaggtatctttgagtacttaatatgggcctctatctgatctttgcaccctgacttttcataacggtacagtgcacgtgaaaaattctgttcagtcaagcctgaactgccttctgaactcagatgctcatttttgattcagtttctttgcagccctaggaggaccattcttcttcctttcttcccctatgtatttgaataattcatcaaggccaaattaattccatttccttcatcaaggtgaattcagctaattgtagcattctcccttctctgaactataattgaaccattattacgtgataaagacatgtctatactagacaacctggtactacatatactttttgttatataattatgtatgtgttctaattagttaagtaacactctactagattctggaagttatttaaggcatgtcacatatgtacttatgcagttagatttaccttgctgaaaccaatgtctcttttagggcatagcatgatactggagatatggtaaaatattaatacacaaatgtacaatttattcattacaaaaaatttacactgcaatcaactacatacacacgttcttttttacaattttttaaattatactttaagttctaggatacatatgcagaacgtagggtttgttacataggtacacacgtgccatggtggtttgctgcacccatcaacctgtcatctacattaggtgtttctcctaatgctatccctcccctatccccccaccccctgacacgccctggtgtgtgatgttcccctccctgtgtccatgtgttctcacggttcaactcccacttgtgagcgagaacatgtggtgtttgacacatactttctttttacttatcttgattatttttcttttcctatcctgagttttccagacaaaatagctaaagaagtcaagaaaaccaaaggatattaaaacgaaagtggcaacagacaacaaaaggaattagtaattgacactcattgaatccttcttcttttccttattatttttatcagttgtgcttatctttacttgtgccacagtgagcactaggattcttccatggtaggttggtgtgtaatagttaaatgagcactcataatatttaggcatttcatagtgtgtcatcttaaattaatgtaattttcataaaatttacagtttgaatatattctatatgctattttaatttttttctgagaaagaactgtctgctgagaaatagtgaaatgaaactcttcattttgatgactgggaaaagagatgggagtagtgtctccactgccagacagactgcatctctgctgccagacgtcctgggatgttgctgtgggtttttgacaggcttcttgcactattgaagtcaaattctttcctagtagcacacacctttccaacactaatctatgtgaaaaataagaaaacctttcttcctgttgttggctggagcacccctgcatctttgaaactattatttcgtttgttaggcagaagctcctgggcagctgccagccttctctatggtgtttgagcactgacccctgagcacggtatgtgacatattattaaagaattattaaagaccaatggcatgctttggtcatttttcttatctaacagtcatagtaaaactgaaaactagaaattatgaatgacaagaaggggaaatttaaattagggccccaatttacttctttttactatcagttttgataatttatttttcattagcagaggtattttacatgaattttcttagtcttcccttcctttcttcagggtgcaggttcaaactttatctaacaattaatatacatttttaattatcatacgataatggtaaaacattaattaaaaatttatatgtattttaaagtgtaatgctaccatataaattatgtatattttatccatatatctatctgacacttacctatatcatgaatgaaaagaggttatacgtaaaattcacgttattattttatttgccatgcaatttagaattaaatcaggatgttggcagaaagctagctaaacccttaactgacatgtaccctctcagcaatgtaactaaggatgatcgcagtctggcacccatgctaggcatgtggtagaaagcatgccaattcttggcacaacataaaacagaaggaatttggtgtaggacatctggatatttagtactttatgcaaaaatacatagatcctttatttttccttctcttttgacatttgttgtacaaagtcttaaaaatttattctttggaatacataagttggccatattcatatgcttcttgaaaaagctatttttaaaaaacttttagttctagcatttaatgctggagaccagtactacccacttggactttgtgcagtgatagacacactttatatctgcaaaatctaataaagagatgactagctacgtgtgtccattgaacactagaaatgtacttggtgcaactgaggagctgaattttcatttttatttagttttaattcatttaagtttagatagccacatgtggttgatggttaccatactagtaaagctataggctattaacagtctcagtttaccagtggttaagactagctgaagtataagatatttcttaattacagaaggaaaattgtctgatgaaatattaaggacctttcatttacatgcattatagtgatattaaagtagtttcaaaatagaatagcataatattaataaatacacatgaatatatgttcatgcacatatagttttatacataaatatgtgtgtttattcaaaccagagaattcattaaatcggattatacagtaataatatacaaaaactgaaaaactgctataaaatttcatggctagaaacatgttcttgtcagtaaatccgtaaatattggtacatacatagcaataaagcataataaacttaatgacaaaataagtcccaccatatatgcagtaccaaaaagcaaaaatggtactatattttcatgaatattggtgactaaaaagtaaagcaatgtaaaataggtttgatgaaatttcttttaagataaccatagtttgcaaataaaattaatttatcaaaaagcagcaggaactatacatctagatagtaatgtttaagagcattcaatgttgttccctggaactcagaaaagtaaatttcttcttattattagataactagtaaaaagtgaacaagagtatttactctatgaattttaacctgtgagtttagtagttctatatcttaatctaaaattttaataaaatagcccaaattttatctctcctcagccttgtaaaatcagattttttgtttaattataaataatacaatgacaagctctgaaatccctgtctttgatgtgatgggggtggtgctttttgccatcagtaggggtaacatgccctccccacctctgatctctggagctgagctttctgttattattatttgcacactggacacagatctcataaaatagatcttagtcactggaaaatatattaatgtatggatttttcatacatatctaatagtccaatcaaggtgtcaacactgatgaggtttatatgtgtccctaggcgtacatgtgtgaagaggggggcatttggggaaagggaggtggaaaatgcttcacttgttagagtcatgaattaaatgatgcaagtctgaatctagttgcaaatattattatagcaatgaacaatatgatagttatatttaaaaaaacactttgggaaccaagcaaaaacaaagcaagctgcatttggaacagtgagatgctggttcctgtagccttcaatatgctttgtgattatggctaaatctgtgacgatagtttgaaaagatgataaagagttacatatttgcttgttttttcaaccattagttctaaattcctttgcaagagagtgcattgaagaaaagcacaagacaaatagtcaagagattgtgctatttttctgactcttcccattacgtctctgtgatctactacgaatgttgtccttagatctcagtttccttacctataaaatgagaaaattatatagatgacttcttactacattcaattacagaattatcctctggaatggaagagacaaagcactatgcaaccaataacatttccagagaaggcagctgtattagtttcctagggctgccataacaaattatcacaaaataggtggcttacaacaacagaaatgtattctctcacagctcttgagtctggaagtcacaagtcaaaatgagggcagggccacgttctctgtgtagacactgggggaggacccttccctgcctctcctggcctttgatggttgtcagcaatccttgctgttccttggcttgcagatacattgcgccaatctctgcttccgtgaggtcttcttccctgtgtgtctgtgttcaaatttccctcttcttatagagactccagtcagattagggccaccctcatccagtatgacctcgtcttgacttgattacaactgcaaagaacctacttgcaaataaggtcacgttcataaggagaggaggttaagacttgaacatttatctttttgactgggacaaaatccagcccacaagaagacctgaaggtacagtctatttcttctttcttcttttttttcttttgttaagttattttagtgatgttcaatctttacataaaattaaaatctttttttaaaaataagtgtcagtgccagaactgtaaatgaaaataatcaaataaaagttagaataattcgttactcgttgactttccttgcacttaaagcatctacaatgacaatctacctctgtatattaatgtagtcctactcattttaatgatattttacctgttttgattatggataagatcaatcatctttaaaaactattttataatacctaaaaattgttccaaagagttattctagatagtgaatataaaactgggaaatgtggtgcttaggaacccttgaagtaatatttctggttattgtcagaaccagatgttgacatgaaccatgaagctgaattgtcaaaaattatccttggttgttgttttttaagtagaaatgaaagtcctgctggaaggcctgatgacagttccttttgggactctgttgctctcccttgccattctgccccagtcatagcttttattaacaaacaaacacttgtgtgatatgggacacgtctccatggttagttgtgtgtcatccagagcctgacttagaaatagcccaaggagatcttctgaagactctagacttactgccattcaaaggcttacagtggagttacacctaaccaaggttcttaataacagcaggtgaggcaaaaaccctggagtggaaatgacacttgaaaatcccataaattacatatgaattgtccactcacctgaatagtggacacctgaatagtgcggtacgtgtcagtatcagtgggcaggaaagtcctcatttagttgtccagtcctgtggggtaaacattgttgtccttttcctggtactgaaacttagttcaaaacatttttgtcacatgcccaagatcacacgagaaagtcatacaaaactattatctgcagcgaatacaccaagtgtattcccctctacgtcctcattcggaacatcatctttccaggcctaggcagatagattacaaaaactgaaactgtggaatccttgcattgtaactttttaaaaaattttactttagcttctgggatacaagtgcgaaagatgtaggtttgtcccagaggtatacgtggcgcagtctattcccctgggaggagtcacaagcctcaaagaaagtagtgagatagttctatgatttacacatagaataaagaaaaatggaaaagcaatatgaatataatttgtattttttgacacaaagatgtgcaaacatacataaagatatacagcattcattgtaaacgctagaaataggaaataaagccaacataaaaccataaaaccctattttaactttaaacaaaatcaactcatttgcttggaaaggcatgagagagtctcaacaggagaaatcaactggaagagccgggagcctccacaagatccctttttacctggattcactgtaggcctaagtctgccttcagccttcagtgctcagaggctgggatctcagtcttgctgagaagttcagcattgctgggcctcagttgtgcacccagattagtgcagttcaaaagaaatgagcatagccacacagcatttccgctaatttccagtgaaataccttatggccacactggccagatgtcatagtagttgttcagacagcctcatcctattgtaagctgcatggtaaccagccaaagaaccaaaaggatgtgttgtgaatgcttaaggacattgagttttgctagtcaggcgcatctacctccacaatagccagtatttgttaaacagcctagagacttgatttaacctgacctctctttggaaaattcagtgatttggaccaaacaaccatgcagaatataatttcagagttagaatacacatcttttttttctccgtgcttcctgaaatgatgtctatgggtgacagagagcaaattagtttggggagggcaggtccaaataaataatatcgaaggccctgacaggggacccagcctgagcatgttcatctttattctctactgtttctgcacattacattcttcctatctcaatggatgccagaaagacaaagatccctgaagcaaagtaaaatgtctgtgtgtgtgtgtatgtgttatatgtgtatacatgtagattatcattatttgtggatttgatttttgtgaatttgcctacttgctaaaatgtatttgtaacccctaaatgaatacttggagtgcttttatggtcctttgtgaacatgtgcagagcagcaaaacatttgagttgatcaatgcacatggcccagctgaagtcaatcaaggcaaatgtcgtcacgtggcacatgactgttgttggagtacatcaaaactaaaaacttgtgtgcgttcaagagcgctagcaaataaaaggccacccagagagtggaagaaaatacttgtaaatcatatatctgataaggggttaatatcctgactatatacagaactcttacaactccgcaacgacaacaacaacaaaacaacctgatttaaaaaatcggcaaagttcgtgaataaacatttctctaaagaagatacacaaatggccaataagcacattaaaaagatgctcagcgtcactaatcattagaaaaatgcagatcgaaaccacaatgagataccacgtcacacccattaggatgactactattgaaaacagcaacagcagcaatacagaaaataggtttttggtaaggatgtggagaattggaatacttgtgcgttgttggtgggagtataaaatggtgtaggtgccgtggaaaacagcgtggcagttctgtaaaatagaactgccacgtggtctagcaattccacttctttgtatatacctaaaagaattgaaagcaaggtcttgggatttatgcatccgtgttcacagaagcattattcatgatgccaaaaggtggaagcaacccaagtgtccgttgacgaatgaatggataaacaaaatgtgctatataaataccaggtaatattattcagctttaaaaaagaagggaattctgtgatatgctgcaacatgggtgaaccttgaggacattatgctaggtgaaataatacagtcacaaaaggatacatacagcgtgattccaatgatatgaagctcttagattcatagataaagaaagtgcaatggtggatctcaggaaaggaggggaggctggatgggagttagtgtttaatgggtatagagtttcagctggggaagatgagaaagttctggaaatgaatgctgaagattaagtactatgtgaatgtacttaatgccactgaatgtgaacttcgaaatgtttaagatggtaaattttatgttttgggtattttgccacaattagaaagaaaatatacatgattaagactgtggaatttaacattgtaatgcagtcttctccagtcgttttaaccattaaaaccacccagtcagtgtcaatggcatgtaactgataagaccttggaaaggaaaatagaagaacctataaaatcgaatgattcaaataaatgtttctttggaagccaataaaatcattttaaagggaaaaagctcttaaggaggaatgacacaggttaccccattcctaacacactgggtaatgagaataaggttcaatatttcagaaaagcttatacatttgaaaagaagttaattcctgctgtaatctgcctttcatagagaattttaagaaaggtaatactctacctccttcaaaacacacacatgaaatattcacacacacattaagagaagctctaaaattcttggcgctgaagagatgaaatgtggatgtcctgacaccttatttgcacagtccatgcctgtatagtctcaatttgcatttgcacctgcaaatggcttttttcctgaaaaacaatttgtatgttcagctatttattttgcatatttcaattcatatttggcatgcatagcagcctgtgtgactgttactgaggggccaatatttgcaagtcttatctgtgaacatgaatgtcccttgggccactttcggtttagccatgggactgtgttaaaggtggatgggtggcctctgcgggtgagttaagagtggcttggctgtggaggccttaacttcagttagttgcgcggaagtgcctctgggaaggctttttctgggttattgagtaagctttagtatttcggggagtgatctgaggtgtggaggaagaaagcaagccagagcctccgtgtctttatgataatatactccttcctagcttcagccttagggcccagaggcagtttttcaggcaagcatggagcagtgggaagaacaggcgtggtgagctggcagctctgggtttgaattcggctcccttgtttaagagctttgtgatcttagtccagttcactgaccttgctgaccttcaacctctctatctttaaattggaaataagactccactcacgaggttatgatgtgaatgcagggagatcatgtaggaaaagctggtgaagtacccggcgtggagtatttgctcaacaaatgagagctgacactgccgttctcattttattcctatggatttgagaaggatctgaggaaaggggatacgctcttctgagttcaaaagagaccctcaacaccgagggatgagagggtcacagaggaaacacgggtgctttgatttggcagcggtcagcagccagacaggtttgtctgatttgcagcttttaattatcactctgataattttagaatgggctggaaacaaggcggtcgccttcagagaccaccctctgaaaccaggttcatctctgaccctgaatgaaaactccagcgaggcatcattatgatgactgtccatggcttcgctgtgttaagaggtgccctgcccttttaattggactgaatagagttcctgagaaacctcaggttgaattactcacgtctttgctgctaaaattgcacaaagatataaacttgctgctttacatgaaatctgctggagagatttaaaatttatcaatcctcttagctttgctgcttttaagaacaccaaaaaatggcctgtctcagagaaaccttgcatattacaattcagtttttagacatggcaggagctcattcacagtggaatttacttcacattacatttggggcatgcatgagatttaaaagcaatgcttttcctctaaagtactcactacaaaagatatatcacacatactcgggctatttaagactcagcaaggggaatatcaacagatttttctccaagtgtgctctctgatcagctggggaaataaaatctttcttgaaaagcaacgaattgaagcaattctagtgcattaaagcctaggggtctgtcctgtttggttggaatttttggcagctttgaatatagaagtagtgtttatataggtgtatgtgtatatgaatgttatttttgcccctttgaatggttttctgacttacataccttcagtgttttattaataaaaatatttatggctcactgtaatcccagcattttaggaggctgaggcagacggatcacttggaccaggagttcgagaccagcctgaccaacatggcaaaaccctgtctctactaaaactacaaaaattagctgggcacggtggtggacgcctgtaatcccagctacttgggaggctgaggcaggagaattgcttgaacccaggaggcggaggttgtagtgagccaagatggtgccattgcactccagcctggatgacagagcaagactccatgtcaaatatatatatatatatatatatatatttttttttgaccttggagtcaaacatatatatatatataagaaataaaatgccattagcaatttttttggcttgaattacttatgtatcaatcaagaatccatcaactgtttgtaatagaatcaatctagtactatttttcttaaaaagaaaatctatgggctcttcagttgggatattcaagagtgacagattcagatatgatatgatctgattcaaaattatcatcaagattacccttttgccctgactcttgattttgggctgagaaacagaatcaataggatagactgtgtgtgtgtgtgcatgtatagatgaatatatgtatatatgaatatatatgtatatagatgaatatatgtacatatatgagtatatatgtacatatatgaatatatgtacatatatgtatatatatgaatatatgtgtgtatatatattatatataatatacatattatatataatatgtatattatataatatataaattatatattatatataatatatataatatatagtatatataatatatataatatatattatatattatatatatatatgaaaagagaaagagagagagagattgagaggggattgaatgtcacagggcaggatggcagcggggagcccaggaagagtccatgtagctggcgtctgaaggcagtgtggagatggaattccttcttccttaggtgtgggagatcagtcagagtggtgggagaaagcctaactggacttaggtgatctcagtctttttttgaaggcctttgattgattgcatgaggttcacctacttataatatggagggtcaggtactttactcaaagtctaccgagttaaatggtaatcacatctaaaaaatgccttcacagaaacatctacactgttgttggaccaaaaactgggtaccacgacccagccaagatgataaaatgaaattaaccatcacatcatccttctctggaaggttatcctgcataattgcataggtggtggcagggagctgtaggcttccattgtccttatggtttagcaaccccagcaagagaaagggagtgagtgcctctcttctgatcatctcaccagagttcctggtctgacctgttcacgtgtctaaatcaagaactggggcaggggcctggggtttactgatggggcaggctgctgtctctcctctattgctgctagagagaagtggtccatcagccccagcataggtctggggaacactttcctcattgaaaagggcgtagtcccagaggagggatgtggggagcccgctgggcaggcaaaggactccctcctgtcatctcttcagagcaaactgtggtgcatgaggcaggtccagcccactgcctatttttgtatggctcatgaactaagactgggttttccatttttcaatcagtaaaagaaaatcagaagaatgatattccttgacacacagaaattatctgaaatataagttctgtgtccagaaatgaaattttattggaacacacttgtgcccacttatgacgctttctctaaacggccgatttcacattgcacagcagagctgagggcttgtcagacacagcctggcccgaagagcctaaaatatttactatctcgtcctccacagagaagcatggctggctgtgttatcacattgcaaccgcaactggaatttataatactaggtattttcaattcaatttggaagcatatgtttagacacatgcatatttgtttatttattctaaaactgattcctcatggagagtatcaacaatttcaatcgtggagaaggttacaaactgaaatgctaaatttctttccatttccatctccaagtccttctttctagatgtaattcctttcaccatttttttaattttaatttttttggtggctataagccctaattcaatattatgctttcacttgtttcctggttgaccagcattaaacatcagctacatgctataacagatgggaaatttagttcctattctttcctccttacagtttcttacagaacattttaaaaattcaagtttatatattagttatatttataacatcatataatatatacttaactctatttttgacctatggaatttagaaatatgccttgtcctcttgctcagtaaagaaagaaattttgggctctgctttgtcttccagcttctgctgttttgactttaaattttgacgattaatggcagttatgctctgttctgtaaaattaatctcacactcttgatctccaagttgaattaaattttcatcttattcagtgattgacaaacgcattttatctcaagatgcatatcttttttacagctattactttgattattgcttcccatcatttttgttctctttctctttaattcctattggatgtgtttccttgcaatgatattctaaactctaaaatttttcttgttctcttctttcctttggggcatttcctttacttttatttcacatacttttatttattctttaatttccataatctttaaaaaagtgtttactgcttctttttatagaagcctagtacggttttcttgtgtgtctgtcagagttgatctcctcttgttgagtctctttgaggttactgctggcattattttaatggtctcctcttttccctcaattagctgtgtttcctgcagtggggttgttctgtttctctcccgtggttcttctcgtttgtgttactgctgtactgctgttccttaagtgtctgctgacctgcagctgtcccttcaaatgtgtacgcctggttcgggtaacacagctccttgcactgcagcttcctccagcattttctgagtggtagctcgctctgttctaacttgttcactaatgtaaaaataataatagaaagtagggatccagtgcttacaatgtagcagacgctattcaaagcagtttagatgaatcattggatttaatcctcatgaaaatcctagccaataggccttactatcattcccattgtacagatgaggaaactgacgcacagagaggttaggtaagttgtctaaagtcacacagcttgtgagtggcagatccaggtcctaacccacgcagtctcgcttgagcaaccgtactccttcctcttgtgtgctgagctatattgatctgattcgtgggcacttccagaatttaaaaaatcttcagcctgctgatgtcatcctgcaagttcttgcaatttttattttgtcttaattgactccatgtggtacgttaaaactgttgtttaaattttttttttttagtaggaagggccataaatatgtgtgcccagtttactgtcctggtgaaagtctcagctgggcttactgtgttcttatcattgtgttgatcaccctgagggaagtgggaggggtggaggaggagagacagtgccagattcccagggggaactttcagtggcgggataggctgatggacaaacgtcatattgctccactgttctttattttctctatcttcttctgcgttctgtctgccctcccttctgtcttagcggttcccatacagccttcaaaaccaatctcctccaagaagcctttgctaattctccagcctgagttttgggctctgtgcttttcctgtgcctagtgcacgcctctattacacaccctctaaaaatgcactctctcatggcctccccgagagtctcagcacatgcagggcagggaagtgctaccgcccatgcccagcaagcaaaggcctggcctttagccattgtccattttttttttttccagatgagtgagtgaaagcaactaatataaaaggggtcgatttcttatttccaaatactttgcaggaatggggtttattcagataaataagatatctagtcgtattgatacaaatccggctgggctgtggctgagaaagtgatcacacatgaaattctccggttgtcctctgagttctatgcagtatggctggacccctaggtttctgagtccagccatctgtgttatattgttgagttacagaagactgcattgccaaaccaatcttttcttttttcttttttctttttttttgagatggagtctcgctctgttgcccaggctggagtgcaatggcactatcttggctcactgcaaccttcgcctcccaggttcaagcaattctcctgcctcagcctcccgagtagctgggactacaggcacctgtcaccatgcctggctaatttttgtatatttagtagagacgaggtttcaccatattggccaggctggtctcaaactcctgaccttgtgatccacccatctcggcctcccaaagtgctgggattacaggcatgtgccaccacgccctgaccaaaccaatcttttcttaagttgctattttgcatgatttttttatcttgggagaaattttaaaacatagtcatgaatgactgaaaacatgatctgaatgctatcaataataaaacctgaaaagggagacaaattggttagtgttttagagaaactgaattggttctggtttctgagctttgcgaaataggcctataccagccttcaaattggctaccgagactttccttgaacctccagctctacgacactggacatatgaaataggcatgtgacatctgtggcactagctcgacaccctgttttatgactatgtctttagatctatttctatctctagaccgatggcaccaactcagtgccttttgtcattgcaacaaccccctcagtgctcctccatccttcagcctcactctctcctccagggtactctccacgttgcctgcaaattcagctttccaagcacagaatccatcgtgtgattcccttttcacgcattacattcttagaataaagtccagacgtcgctgcgatgcacctgagccctcccagtcttgcccggtaaagctttccactctcctctctggtagtttcctgtggctgctgtaacaaacgactacacactcagtggcttaaaacaacacagatcgcaatcttgcagtttggtagctcggacatgtgatgtggatcaggatcttgtggttctgtagctcaaacacatgatgtgggtctcactgggctgaaatcaaggtgttctcagggctgcatgtcattctggagtcttgagaaaaaaatccatttcctggtcttctcctgctcctccggggctgcctgcattccccggcttggggccccttcttccattgtcaaagccagcaatgcaggtcagtccttctcacatcacatctctctggcttcttctgcctccttcttctacttacaaggaccgtcctgattatgctaggctgcccagataatctccctatatttgggttagcttatagcaactctacttccccttatgaaacataacattttcataggttccaggtctggcccatggacacaaatgggggaccttactctgcctaacacaatgatacctcttgctaccatgtattccttgctctagtcaaactagaaaacctgctgctgttgctcagagcatcattcatatttacacttcccttgtgctcacattgctctctatgtctgaattataccttcctcccattctctatatattctcaaatgtcattttctccaaagccttttctaagtggcccaggcagcaatgctcctacctctaccatcccatgctacttgtttatatagttatccccattatccttggggaataggtcccaagacccctcgtgcattcctaaaactgcagatagtatcaaacctatacatactatatcttcttgtatacatacatacctaggataaggtttaacaataaaataataaatagaacaattataacaatataatgtaataaaagttatgcacatgtgatctcactctcggttgcctgccaataactgaaaggccagcaagtgaaactgccgaagaggggagctgctataccacccactccaggctgacggcactgtgtgctaggctgccattcccatcccacgtcaattcccggaacttgccttcacttaatcatttttgcatcttctctaatggccaccaaaaattgtgcacatacaaggagctcgaaaatacgtgtggccaggcacatccctgcagtcccagctactgaaaaggttgaggcagggcggtggcttgagcccaggagctcgagttcagcctgggcaacacagtgagacactcgtctctaaaatttttttaaacgtgctatatggaatggatttttaaatgtatgatgtctctgggagggaattatgatcttcatttaaatagttaagctccttctggtgaattctatttatggttcagaagttctatgtattggacagttccataaattgctgccactaggggatgggtggaaaggaagcaaagctgaaggcaaggttttcggtcatgaaggacctgcctattgtgtgtctccagtatttccttgcagaggctgaaagacgagcctccacgtaaccctgaagcactcagagtctcttcagcattacccctgggtttgcattctatgtgaaaacctatgaagttaattttctttttttttttttaattttttcttttcattgcacaagaataagaagttacttttctcatttgggagaacattccatttttttgtcttaacaccagactggtatgttttgggtttccaagagagatttttgaaattattctaccattatgattgatatatatttttaaaatgaagatataataaacaggcacttatgataacagttgttagtatcttttagtaattttttaaaaacataagttcccaaagaacaggccatttttcttcttctcaaaaatatgaaacattaaacaaggattatttctactcgttggagtatttaaatacagctattcaggtaaacattcataatccctcgtcacacagatgagaatgattctcagaaggcttgaaggcctttcccttagtctcagaacaggtgggctgatatccaatctcaggtctttctagcttacaagcacctgctattttaggtatgatgatcctgtgtcctaacatcatacatagaaaagactctgcatttgctttcaaaattaattattctgaatattactgaaaattcttatgtgatgaagtacaaaatgtataatatttggaatatggagttatgtagatctgagtaagttgctcaacctttttgaatttcagtctgttacgaaaaattagaaattagaaccctacctctccattgggtaaagattaaaaaacataaatcagttaatttatttcattatgttttatttcctactgaatagtttgaagacatcagagactctggtgccataaaatcccctgctcagaagcagcatcccccacatattacgaatgagaacaccagatgtccttcagtatacaaacatctgtgggctgtcacatcctcacgggcaaatcactgtatcacgtgaacacataacggactgacgggatccctgaagcgaattgtttataacgaagaaagagaagagagtgattgggagcctggagccctggtgcttggaggaagcggattttcctgggactggcacctgagtgtcttgtatcggtcacggaggagtcaggacagaggggtcatggaagaggctggcggggccgggaaggtgctctgcccccgtctcggggtccagggccgtccactccgcccgtggctgccgcccgtggctggctctctgcggagcagccagcgcccggtggaacagggctttctggaaggtggctgctctctgaccatgtcctcggtgccagccgggtcaggggctgctgtccacacttcccacttaagccagtatttaagacagagggagaagggaggagaaatgagggacagaggggagaggtttacatggggcagttgctcccgaggaaaaagaaaaggggtccccaggctgtctcccatggcgtccttcctggtgcccaccctctatgccctacctgcaaccccacgtgcgcatgagaggacggacgtctcttccagcctgaagggaaagtgcagactttccgcatctgccttgcagccgtatgttgtagaaaatgccagcaggtaatttgctaaaagttgcctgaggagttctccatggcccagtggtttctatctgcgagctgtgctcctcttgcagacggactgtctttcagtaatttgcagctatgtcatttttttaacttgtaatatattgtatcatagaaaaaaagtcaggctctgactatcactttaaaagcctatttcatccacgacgtggcaaaaattcccctttttttcatttattttctttttcagtcatttcaaaaaataaattatataacatttaaaatattttaatgtttcccattttgtttgtcatgcaatcagttgctaacaaagttatgaataacatgatgctcttcggtatatgaatgtattcttcagtaaacactgttgagccctactctgtgccaggcatcgttccctgctatttcggagctcacttgaaaggcactattgagagtccttgcctcgcccccaacttcccccaccacacacagattagagtgaacaggctttacattttttttttataataaacaatctatgaacaaacatatgaaccttggtatctcaatagcaaattatattgctgcttctatgtaaaaatatagcttttcccatgaaaacaaacagaggaatgtgcaagaaatctgacaggaacttcttctggctattttacccttgttactgtagaaactccttatgctacgctatttttattgtggttattttggctgaagtgtcctcaggaaacaactcagattcaatgtgatcagaacatttgctttctcctgttgctagagccatagtggtttcacctggcatttttcttttttaagagatggggtcgcctaggctggagtggagtcacaccatcttggctcactgcagcctcaacctcccagcctcaagcaatcctcccgcctcagcctcccgagtagctgggacttacaggcacacatcaccatacccggctaacttttaaaaaattgtttgtagagatggggatctcactatgttgcccaggctggtcttgaacttctggactctagcctccccaccctcccaaagtgctgggattacaggcatgagccacggcccctggccaacttcccattttacagagaaggaaggtagggcccgtgaaatgaagtgaattgctcagcatggtgcagcggtcatggacagatgaggctgcagtccagccctgctgaactttcccgtgcactgcagtgtctgtgaccttccacttgccactctgcagtgctcgtggggcttccaggccaatagctcttttgctgggaaaacagccggttgcatatgctgaaactattgcaaggacaatttggtaaaatcttgaagaccttaaccaaaatagtactagtaaatgaggctcaaactctccccatccatcaaattggaagctttttcattaaggctactactgaactttctttattcaggaaacctaatcagcaataaaaacccgactgatcagtgcaatatgaattttactgctgtgtggagacacggttttattttgccgtcaggaaaagtgagatctgactggggaatgagtgactctataatccttcctgcatcattcctgctggtcatgaaggcgccaatccaaagactgcgtcctcttagatgggatctgatttttaaacatttcctggatgtcttattttccttagatcctagatctgacataaccctaatgcatcttgcatattttttggctccctaatagtttctgagaaattccattccatttttattttttttggctgaagctgtggaaagacaaaaagagggggaggggagacagacggacatttagaaagtgtattttaaattgcaaattcagattgctaggctgcgtttgtacatggagaaggaagggaggaatgaatcaataattcaatgttaaaactggaatcctgcttcaattatgtgactattttaaccagagttatttcaatctgaccatcgataatgattccatctcctcctagtcctgagcctagaagttagctgggccttcacctgttcaaagggcagggtcctcagcgtgttcccttcctctggggccctagatcctcagatggcttcctttgcacttgatccaagtccactcactctcacaccagtgggtcagaaaattaggctcatttcttttggaagcagttgtttcccacggcgtagacatatgctatgaatttcacagttcgttttctatcaagatatttctaaacagctcttcttttattcatatgcttgtctactggggaaatcacatggtcacaccatattggtggaaattgttgctgaggggaataaaacttgatttcaaattttgaaagataaattggactatctaattagccttggtcaatgcaaaatctttgactaggaaagtaacattttcttctgatctggagcagagaaacaggtttttaaatcagtgggaacaagagaggggaaagacttccaagtgtgtccagagaagaagcagatttgttttacacaatcagtctgcagggagaacctctgagaacagacatgatcatctccagagacttttaagttactcacagccaagtggaacataagggcttcttattcaggaaaggcacttaaccatcttctaatataataaacagacagggacattttagcgttttaccaaagagaagtaagtaaacgtaaccgtacctaactctgtaatctgagctgatctgatgtgtaccatgtgactgtaacattggaagctgcaaggggacccttgcaaaatgcgggtaatgagagtcacctctgaatgaatgagcaagtctggggaagcaaacccaagcactgaaacgtttagtgaatggaaagggcctatgcatgcccttcacaaagttagaattgtggactaaaattagagttgaatagagtaaacctaagctttggaagatttttgatattgtgactttttttgtgtgtgctacaaaagcagcagtaagagcaataaaaaaaccatttcccttctctgtagaatcacaccatattaagaacatataaaaactgtgctatcaaattaaagtgtaaaactaagcaactgggatttagaaatatcatccaggagtttgaatttttaactagaaattagctctaaagaagtaaactgtaaatgagacaactggtattgaaaagtcttttcagggagtcagaagaatttaaccctagttccatctctattaaatagtttgttttgtgatttttgtcactccacttaatctttttaggtccaggtttccttatctacaaaatgagggcattagaccccgtgccttccagcttcagtatttctctgattttggaaattttagatcaggcagatattggttcaaatttagagaatctgacataaaaacttttgtaggagaatagggtaggaagattggcctaaattattcagaaatctgccttactattatacatcattttaaacccatgaagagtaagaaattgttatgaattatttaacaaaacaaatttgtatttaaaataattttgctgagtactggtgtaaacaggctatctgctaaataggggataatgacaaatactctgcatttttacagatattgaaaggtggaaatgttctctccaacacactaaagagtaatcaaaggaactgatcctaaaactatgtgttgtacaagcaaaggtaaggggtcagcgctgtcgtttctgcagtgtctcagtctcatcacagaagtgaggatttatggtgaaaaggagtttaaagtttccattgtaaagaatgttccttcaaagataattgaaacgaaattttacaagtgaaaaggaggaaataaaagcagaaatgtgattcttgaaagtatagttgaaatgtcccagttattaacctctctgatactcactgttagtgattcatgtcatctctcaaccgccactttaataattgctttattagtgcacactggaaagattcatattaagtgatttttccacaagggcttctctttctcctctttagtgaactggactgtaaatatgtgaatatggtagctgttttgctagccttttgtttttttctgaaactcagcgaataaagttgaactttggacatttccttatgtatttttcttcagcatatgaaaaacttcctggcacagttttctgtccggggacaatacattttctccactcctgatggttttttccaggtgaagggagatccacggctgtcgtaatctttgactttctccactcctggtggaataacttagctgattgattataagtttggagaaatctagacgtttcctcttcattgtctcttaatagttaagtttggacatagagggcatatatttatctctgttccttcaagttttacaggggctgcctgtgcttgaatgagtaagtctgtttaaaactgggattcaattttaggaggcccactttcctccagatttaagccaatatccttcaacctaaattttgtccgtaatcaaggcaataatctggcctcatctaccttactcttttgtcttttttttttttttcacagaactgtgttctgtggttaaaaacacagttgcagaagatggtgatttttaaaaagttggactccctggtgttattgtagtcctttatgaataataggaaaataggagcgatgaaaaagttttacttgatatcaaattgtaacatcattattgctctgcagcaaacacagaattacattccaggatttaagtattaaatgatatgtttttaaggtctaagaaaggacatttgcttcccgattgattgcattaatataaagcaatttaacacatgttaactacagagtcagccagacttgagtttaagtcctgactattactaactagatggtgttggagacttcgctcaaactgaacttaagttttttccaacagcaaaatgggggaatagaaatcaattattaataaaaggatgcctatgaggagcgccataaacagtaccccaaactccccctcccacatacgctccttttcatcacataaatagtgtaaaatatattgacaaatggcatgatcatactttggcaaatagtttctcatgaaaacatttttggaaatgatttctaatagaacaaatgtaaaaacaaagatatttatatgaagggtctatttacataaaatagaaatttttctaagttaattgaaggaattaccatacttttttttttcgtaaaactcatcaacattaaaaacaaaagtcatctccaaacttaattattgcagaaaaaagttggttggaataatgctttaaagtgtacatcactttgatgttcaaagactcctgattagagtgtcctttctataaccaatcttgttccttaaaacatcttgaatgatttgatctcagatcccctgaagggactgctgagatcatctgcaccaatcctaaaaaaaaaaatctttcatgcccaaacccttagcaaagctagtttcttgtgggactcttaatccctcttatcctgcttgacacagaggtgctcacctgctgtgcatcagaaacactatggatacttcttgaaagtgcctgcaacagagatactgatgcatctgttgtggggtgggccctaggtatcagtaatttaaaaagttttttaaaatacgccccagataattctgattgcttgtaaatggcaaaggttgagaagcactgctggaagcttttgagctcctgttgggtaagttcaagcgacaggagaatctcatagtgatcataaaacagcactctgaattcttggagaaacccagactcatcttatgtgactaatttccttaatgtgtaccccaaaactatcctagcgcgttcacaggtacaccaggtaatgctattctgattgagcacccaagagtctcatttagaactaacatttttttctgttatgtaaacaataatgtaatcctgactcaatccgattcgtttattttactctatctgtcatgactgctgttaacattttttcccaaaacttgtcagcaaaatgttaaagggaaactcaaacattccataaacttcctttgactattcaccaattccattcttttaattacagatgtgatttggtttctcttattcccacctggtctattttgcactggataaagattggttggggtggtggaggcgtatttcaagatgttctccagagctgacccacatcccataggatttaggcctacaaagaattcagtgaagcgttaaaacaagtaatacactagcacagttggcgagctcaggagagctgcccggcagttcgggattgagggaaatgacaaggatttcttttttcagggtgggatgcggttgccctattctgctgctgaatgtgttccgaaaaaaagcccttctaggtggcggtttcttcggggaggtatgattaactgagcaagactgttctctgttgtggttttggaagaacaactgggtatggccactgtatttaaagagcacatttgtttggcctaaataccagtgtctttctataaccacactcgagtttagatcagtaattcatttaatttctgatttaaactcatggcttgactttggaaaactatgcctggggagaagaaaattaccagagcattcaccatctccaaaacagctttcggcaatggaggaccgctacttgtttagcacatgactttggagaaaccacaaagctcgaaaatactaatttttttcattagagtaccagaaaagtcaacccaacagttttaaacagtggtttttatatactattaaaagctctataataagcaactttgggaatcaggatgaaagctaattatagaacttctttgccatggctgtttctatttacatcttcaaaaccacagaagcaaataatgtaggctttcctaatacgtcagcatcttcttgatttctgagttctttgaagctgccctaaatctttcccttgaaaacacattgtggttgaatattcccagttcaaggacaatttcagattagagtttttagtccaagtatactattctttccttgaaatactgaatctcaggactcagacaaaacatcaaaattgttactcaacatggtgcatgttatccagtcccttttgtgtgggtttaattttttgtgtgtttgcttacttcatcagtagcagcaaaacacagaagaaacattagtcaagagcatgatgtatctgctatgtcctgatcttttccaccaccaaaaggcaggtgtaacttatgagttgatttttaagaaaaagaaaatgttgaaagtgaaagaaactgtttagagcaaacatttcaggatattgccctgtctagctggattgaatgtttcagcttcagtcttactcccaaagctttgtagccaatttacactgtggcaattgactcagttggcctggagagctattatgaaagcaattctctccagtgcccagccttgcagacacacccaattgaccccgaattaatcagtacccacctaaaccacagttctcagtcctggctgcacatcagaatcgcctggggagctttttaacaatccccatgccaagtaattaaatcagacccattaaatgacagtctctgggggtgtggcccagtcatcagcagcttttacagtttcccaggtgattactgtgggcaggcgcggctgtaaaactgcagctgtatcgagagcacatcagtgaggttccaattccttgggtatttccattcttccttttacatggtgtggggtaagaggctgcctcggactcccagaacagttccccatttttaaaatgtccctgaattgggcaaacaaacagcctaatagaaaataagcaaaagataaaacatacacgtccatcatagatttatggtctcctaatttcaatctcgaaagtaatcagcatttttctaaaaggaaaatctgtatgtacccattattttgtagcaatgagtataaagtatttaatatccaatgcctttgggactgagggaaaagagatagtcttgcatcttctgcaggcgtgaaaatactactactggtactactgaagtcgctaatatttaataagccagggcaaggagccaggacttgctctaggaactccatatatattaactcatttgatcctcacagcaatcaagtgaggtcaatatcatgattatccccattttcagcagggagatagaggtgctcctgaggtcacacatctcacgaggtgagggagagggatgctgagtcgggcagtctaggtccggagtctgtatacctggggactcataaaatggtagggaaattgaataatctttgcccatagccttacataggccccaagatagcaaaagtcctcttttaggaaattatcttaagaaaataactagatacatgtataagtatattcattagaaataaaataaaatattcaggaaaataatgattcaaaagtccacacatagggggttggttaagcgaagcacattacagcatgtcatggggccgtatgttcccatttagaagctgtgttgtaaagtggttcttctcagcccttttcacgtcatgaaccataaagtgaatgacagtgtttttaatcacactctatgttaacactcaagttggctggaagtgactgttttggaaactggtggcacagcccccactagctgctgcaagagctgacggcatcaaaatcttggtgtgcccattcctcgtcaccaaagaccagtcacaaagttctcatgtataggaatatattttgctgtaggagagtgttccctagattttgctaagttcagaaaaggcatactataaggaagcaccttgagtatattccaggctgttaactccatcagtacatatgggcacagatggtcataccaatggttaaaacatcaaatgaccttcatatcatgggtgcacagccagtgcaccaagaaccccaccaccatcaccactacccacacacagggcttccctgaaatccagcagccctggaccacctcaaggcaaagcaaccaccaggtaaagcctaacttggagggcttggtttcagtggtgggaattactgttctccatcagccaacatgtgttctgattggttggggcctaagcttggcaggtgtttaaatgttttgaatattacatgtgtacatgaaaagaagttgattcaggggtacacatatatggtttgatagaagaaataagacccaatgttagctagatcagtagggctactacagtttccagtaacctattgtccattttgaaataggtagagaagattgggaatggttctagcataaagaaaaaaacaaagatttaaggtgatggatatttcaagaacactgatttgatctttactaactatatgattatattaaattatcatgtgtaccctcaaattatgtacatctatcatgcattgataaaaatgcatcaataaaaaatacaaattattcttaaaaaatctaggtggagaagagtttctggagggatatatgtcacagcattattgtttattcttctcttttctggatttcccactcttcagctttgggcaagtgtatatttagaaaaaataaagaccaaaacatcatttttatttggaagtaaacttgcaattatggctgaatctgattccttcaatcctattaacttacaaaagtatacttcgtctttgtaagcatcagaaagttcctcagctagtggaggaaagttcccactgatttgaactaagaatactggatgtcacaatgatgacctaaaaatcagaagatcttttccccattttttagatactacaagaaattctcatattcatgttgaacgctagagagtggaaggggccccaggaataagtgagatggagtttcaaagtcaaatcattttgatttaaaaacaatttttaaaaatatggtatatcttctacctttagactgtggaccaaagtctcatgcaagtgcataagtggtcagggttctttctatgtgttcccatcaaagggctcttccagtctcacatgggtttgtgccgctgtggaccagggtcagcgtgattgcagtcagagaaggcagcaacctgtccgagtggcgcaggtcagaggccctcaaagtggcccccgatcagcagggctcctgctctgcctggcgtaaggaaataatggcatctcctctgtgcctctcagtcccccttacaacttcaatgtaattgcaaagggcaccctttagtattgctctcaatctgcacttctaaattcacaaaaaaaggtctagcttttccttaacaattgtttggctcagaaggcagccaaaaatggttccatatagatttatacgtgattatctgctaggaattctttctcccagaaaatacttccatgtagccacctggctgtaatgggaaattgcatgttcttaccgaaccgctccaccccatctaacatgacccaatcgtaattcattttccttctgctcaaagtaggcttatgaatggacatatgacccaagccaagcccatcagaatcctcctgggtttctctgtgtgttttggttatatgtgcatgggtacctgcaagtgtacgtgcctgagtgtgtgtgctttacaggaactccaagaatcagtccccttttagtttggggaactatcacatgtacaactggggagctggcggtggccgtaagggcacatctttcataaggagaaagctgcactcctggacaagagacagaagcagaggtgagagatggggaggtgctcttgttgtttttaggcctgactttatcctgccccttctaatttttaatcaacctatttcttggattctgtgaggtatttcagtttgtgtttgtaacatttagaacctgaagagtcatgattaatgcattgtcttccctattttacttctcagcttcctttttgccccaggataatgccctaagggaattagattcaacaaagtcacttgttttgagaagcaaggagcgagcagagagaatttgagggagggagaggtgccgccaggaaaggtggccaagagcagcattaaggtccccgagggacggggccacgagaataagagatgcctgagaggagtagcaggacagagaaaacagagtgtgactagctcagcatcgtgccaaaggccctgctgaggtgctgccagcaggtgaagagtgtgactagctcagcctcgtgcccaaggccctgctgaggtgctgcttgcaggtgagttagtggttagtggtttttctgtcttcacatgttatttaaagatcatgttatttaaagctagacaattttggggaatgtggaagtgaaggctgataacaatactaaagggtgccctttgtggagttttgaagttgtaagggggtactgggaggcacgaaggagatgccattatttccttatgccaggcagagcagaagccctgctgatcggggccactttgagggcctctgacctgcgccactcagacaggctgctgccttctctgactgcaatcacactgaccctggtccacagcagcaacaactccctggaggctggaagaatcctttgatgggaacatatggggagaacccacaggtgcatagctacgcacttgaatgagactttggtccacaacctaacggtagaagatacatcccatttttaaaaattgtttttaaatcaaaatgatttgactttgaaactccaactcagtcatttctgggtaccactctctttctttaggttcagcatgaacatgagaatttcttgtggtacctgggaaatggggaaagaatgctcttatcttttggttgtcatggtgatatccagtatcctctttatccctgagagtggtacctctcatgcagctgcttcggcaactttcttggtgctgggagacacagcgcctagagtttatgcttctggtggaccccagagcctttcccctttgaagtcttgtcacttttctgaaggcttcccttaggttgaggcacaggtcactgctgttgaggaaatttgtcaatttctatgcctttctataaggaaataacctctttctctctctttctcttttttgttttgagacacagtctcaccctgctacccagggtggagtgtagtggtacgatctcagctcactgcagcctcaaccttctaggctcaagcaatcctcccgcctcagcctcctgggtacctgggactataggcacatgccacacacctgggtaatttttgtatttttttgtagagaagggttttgcgatgtttctcatgttgttcttgaactcctgggctcaaatgatctgcccaccttggccttctaatgggctaggattataggcataagccaccatgcctggcccatctctctttctgattagcatctctgaatacccctatgcccactccactggcttcccctagcaaagcaccctaaaagagctcaggcttttgggactccaaatccagaaaaggaatgtctttaccctctgctttctacctggaacccaaactttccttaaggcaagagaggacaatgagacccacctgcttgtcacgaggaaaaaattgtgcaaagacagctaaaatacatttcctctacagtacatagccttcactgactttcagttgtgagctgcttttgaaaaacacaggacagaaataatgagtgctccatccttcttgcctttacacctacaattcctgcgtaagcccagagtttccgcccagcccttgggagactgtcagactttgcctggcgctgaatctcatggtgaatttgctatggtgctgaccttgctctttgtctttttattcaaatatttgccactgtgcaacacaatcatatattgcatctatgtagtattgatattaaagtgtttagccaattaggtagtttggtattaggtaattcaaaaagacttcaaaataattcatttattaaaccgtattcttttctagtgaacatatgccttaagaatgcttccatttctcctgttggtttcaggcaggcatcattatgcacaaggtcctgtgttgtttaggtggctcagaggaagagtggaagtcaggcatatttcaggagtttaagttaaaacctgtcccaggggaaagaatgacagagtggaacagaagcaagcagaaagctgtgttcagagtctccagggtgcatgacagaggacactgtgtgcacatgtgtgtgcatgcatgtgtatgtgtttgtgtgcattatctccatacacacacacataaatatgtgtacatacatatattcataatcccatgaccatactcatttttggccttctctagaatcataaatatatgtactttctcacatttacatttgaatgagtgtattgaatgaatggtatccaaggatatatttgaacaagcaaagtgttaccacaacattgcactaacttggaagttgtttgtcagaaaactaaactatctggaacacagctaagaactaagaagaaaacaaaacagatgtctcagaacacttgagtcctgggcactttatttagaaaagtgtcattttcgtgtgtttccccttatgttacatacagttcaactgagccaggccttttgatttctgtgatgaaaggccttgaattttggagccagaaggtcttgggcttgaattcaagcaaattaactcttctgaggtccattttcttaatccatacagcagaaatagttacatctgtgtataaagttttattatgagaattaaagaagctaaatatgaaaagaatctagtggaacctgacatataaaaagtgttctttaacaggccaggaagggtaactcatgcctgtaatcccagcactttgggaggccgaggcaggtggatcacgaggtcaggagatcgagaccatcctggctaacatcctggtgaaaccctgtctcaactaaaaatacaaaaaaaaagtagccaggcgtggtggcgggcgcctgtattccagctactcaggaggctgaggcaggagaatggcgtgaaccgggaggcagagcttgcagtgagccgctcgtgccactgcactccagcctgggcgacagtgaaagactccatctcaaaaaaaaaaaaaagaaagtgttcttcaacaataatttgtttctttccccttcttttcccagcttatggaaaattggaagcaggagaagagaaggaggattcaaagatggacagaccaacgacagtcagaaagaacactccagcctaatagcctaaccctaagagatctcaggatgagactaatgagaaagacccaggtcctcactggcatctgaggccatgactgggtcccagtaaccaagaaaaggtggagccatgctcagctggtttctcagaagtggtgaggcatggcagaaacttcagcactgctcctccccaaaataaataaggtaaaaagaaaacattgggggcagcaaatgaaactttgctcagcatagaggacagctgaggtgttcacatggcaagaagtggatctatctggggggctagctagagctaaaccacttccaggagcaggagtccacaagctttttcagtaaaggtcagataggaaggatttcaggctttgtgagccacatcacgtccctgtcacctattcttcttgtggccacgtgtcttcttgcttgcttgtttcttttgccactcttaaacatgcaagaaagcattgttaactcacatgctgtccaaaagcaagctatgcactggatttggcccgtatgtcatggtttgataacatcacctacagtgtattacacaagatgacagcatcgagtgccttttcacatgtgttccatgaataaatgggtaaggtgcatatgtcctgtttaagtcatcccactagtaacaaaattatcctccttgtcattttggataaatgcattcattggcgtttactcatgtagatttgcctttgcttatcaactagaattttaatcagccaaaaaaaagaaacattggcactcacatacatgtctgagagaacagtaaaagtccatcacataataagaggtagcatttattgtgaagttactgtgtaccgggcactgtatatatacttgttaggggctgacttgtgtccccctaaattcatatgtgaaagccctaacccctaacgtgactgtttggacacgggctttaaagaggtcatcgaggttgaatgaggtcttaatggtaaggccttgattcaataggaccagtaagaagaagggacatgaggagtgtgcacacacggaggaaaggccatgtgaggacacggcgagagggtggccgtctgcgagccaggaagaaagatcgcaccagaagccaaccctaccagcatcttgaccttgggctttcagcctccagaactgtgacaaaataaatgcatgctatttcagtcactcagtctgtggttgttaccgtagcacaagtggactaacacagcactatttaattcctaaaatgtgttataaggaaggtgctgttgttatagtgagagaggagatctaagggcagagatggattaggtaacatccccagctggtctagctagtgagtggcagagttgggactgaaccaggcaacctgctccaggacttcggctcttcacctgtccctcggtgggctctcaacccaggtggggaggttctgtgggtgctctccccttcacaggaaagatagctcttgctcacgcaatagagagttctcaaagtgcttcagcgcaggacctcctgaggacgtctgtatacctcaggcatgcccatctcactgcttccaaaaggagctgaacaaagtagggactgaatggacgagtgcttggtggggggtagatcttggagtctgcccaaaggaagaaataggagccatattttatttctctccttatgccttatataatatgtatgcacttacaatgtacaccatggtgacttttgtatagacattttccacataaacctttttttttttttggcaaaatgtaatgtgtactaaaggaacgatgaattttccaaagtaagccagtctttcagaatttcatagctgtgaaggggataaagcagacttacccatgcaagccagcctttctcttggctgccctttcctaccctggactttctctcctctggctcctgatctctgaacttagaatctagcctgggctaatcctcagtggtgtcacactagagaaacgcccaggctcagactttgacatttatcctgaactgaattaagttctagctgattgcatggtcaaagattgttgctgtgatgggaagactgtgactcacatggtcaggggttggaattagagcattcccatgtcaccaaggtgttcacgtggcctgcagtttaataactaaaactgtaaccgacattgtcttgattgggcttatctgaatgttctgaataaaaaatgccaagtagcatgcttcaggagggcatggaaaaggcccacatagaaagttgccctcactgggccattgtttggtaaaatgacgttcatttcattgagctccccagagcgtgtaattttggttgtatgaaagtggctttctgaaatgtccctaagcagacatgttctatttcttttccatgaaacatgcactaaatacctataataggtacacagggggatcatggtggaaataaagcctgaaagatagatattcgacttaatcatttgttaaaagataattttgagtgggaaacatttattatatagaatcactgactaacctggtatatttttattctcccactcttaccttgtaaagttgatatttaaaggtgtcaaatatatggctagtgtgccttatttgacatggaaaatatgaacttatctgaagtaaaaatcaccttccctttgggctaagaaagggcttggagaggagaaatctactaagcctccaccaattatgatacagacccagggagctacacagtcacagaaactcctgggcaatgtctcattattatgagattttcagatacagcatttttttttaatccataaaggaacaaattgaaaggatggggcaggtggtaacatttagtttaaacttttttgaggaaaattaagtttcaaattagaaacttgaccaagatattgtactgatggatatggccctggagtctacagtcaggcttcccagtctatatatagtctttgaacaggaatatcctagaagtctattgccttcaacacatggcgtttttggatcatagaaaatggtgcagctgtgtttggcccagtaggggtagtgacacaagctgaactgaaagataaggtggtggttacggagcatggaggcaggcggccttaatgccacggaggctgagaggacactaaagggtcagaaacagaggaacaacatgagagatctgtttcaggatcatctgtactgaatcagagattcaatgtttacttccatgcatttcctttctaacttgcttgtaggtgacttcctatttcctggaaggacaggtggccacactgccgagcagagggcagtttggattgtgacaccagaaatgcaaagagaaaacagacaagttagcgttttcgtttttcttccaaaataggtttccgaagcttatcccctccatcaatacttttgaaaggtaaaacaacttcctttgcaaaagctgcattttactggaagcagatgagattcttagaattgacagcagaggcaaggaataaagtttattccaagacctgaatggaaaaagaggaagaactcatagttaagagccccatcagctgaggagggaccgtgagaggggagacccagatggactgtagttttgggacaggggaggaccagagagggttcctgatagcggaacagggtggttgttggggcgtggatggggaaactggggggcagttggcggcgtgcagatgaatagagctgttgttcagagtcagctgcagctggtctccagtgccaggaagtcaagatggagccctcagaacatcagcctaggtggaacaggcactgcgacaggctcacttggggaagcctcgttttctcctatgcttatggctatctggaaggccatccacgggtatggcagtgatctggatctaccagtccgtggatcaccagagcaaacatctgccacctgcacctcagtctggactctttcttccaggaggttaacatactcacaggcctgttgaaatcctagagggatcagtggtgatgtggagggaacaccctcacccagcccacgcctcagcactggaactatatgtgggtcaggtcagtggtggaaactcagccctggcctccacagccacctctctgctggctccgggagtgaagagtagaaagactgggagtggggagagggatgggtgtctgcataagggtgaacgaggctgacaccaatgcagtgggaacattggtgaggccaccttcttgaaaaacacttcaggtttgtagtttaccaattttgtgaattttatcttgaatattttaaaacctaagtagtttctcctgctatctgtgcaatatgaaatagctttttcattggcatggggatttgaaaaacatagtctaagcaaaacataattagaaagataaacatagttccttcttaatcatatgacgtacatgaaagcctaaatagagctgtttggtacattttgctcttcagtattatctgcgtcacagctacctgctcccacccttccctgtgagatccattacagcagataatgacgagctggctagatacagggaagagtaaaattaagccttgatgtaaccagtgagagctacactaattcctgcccactcagcagttgatgctctgataggccctttatgtgggtggttgttgggcaggttttagaaatgcagtcacaattaattgctgtgaacctaggcaactattcagcctaagaagacatcaatgatgtcttcttcttcttctgtccctctatctttccatcatggggatctgacattacattagaatgcttgggtgatgggaggtttggtctctgagctcatccaaatggctcactggtggcactaatgggacctctcctgttgcatggaggatctgcaagtcttcactacaggaaagcaactgaccacgtctgctcacctgatagtagtttggttacatttacaatagctgccttatgtgagacaccgttctctccccatttgtgtaaagtatgcagaaagtttccttgggtattttattttttagtgcaagagttggagaaagcatgagtaaaagttcttgctacacacctaagtatttcataatgttatttattttaatttaatttttttttagagtcaaggtgtcgttttgtcactcaggctgagtgcaataacgtgatcacagctcattgcagcctcgacctcttgggctcaaacaatcttcccgcctcatcctcctgagtagctaggaccgcagtcatgtgccaacatgcccagttaattgaacgtttttttagtgggccgggcgcagtggctcatgcctgtaatcccagcactttgggaggctgaggcgtgcagattgcctgaggtcaggagttcaagaccagtctggccaagatgatgaaaccccgcctctacttaaaatacaaaaaaattagccaagcatggtggcgtgcgcctgtaatcccagctactcaggaggctgaggcagaggaattgctttaacaagggaggtggaggtagcagtgagctgagatcgcgccactgcactccagcctgggtgacacagtgagactccatctcaaaaaaaaaaaaaattctgtagacatgggatctcactatgttgcccaggctggtctgtaactcatcaagtgatcttcctaccttggcctcccaaaactctggggttacaggtgtgttcctagctcaatctctccctccctcccttccttctttctctctctctctttccctttctttctcccttccttccttccttccttccctccctccctccctctctctctttctttctttcctctctctctctttctttttaaaaagtttttcagcacatgtaagccctttaaactacacttttctccaaactgatttatgtacaaaagcatgctatagtccatcaacaacaatgacagggctgtgtcactatcaataggcctacatttaaaattattttctaggattggaaatgaatgcatgttgattccacccatgtttcctgccagaccctgtttgctgcaaagcttccattaggaggtcacttggttgagaataggaggacagttgctggagacttgagaatagagaagagcttaatgtacattcacaaaatattttgccacaattttttgtccggttgataatagtttcattaaaagtatgcaagacatatagtttttattcacttaataacaagtataatgaaacatctgaaacaacctgaatgttcaataataaacaactgcttaaataaattatgatacatcaacttagctgaatattatgcaactattacaaggaaattatgaacttacacaaaaacattaaaaatgctttaatattggaaaagaataaaaaattatatcatgctgtgattagacaagaaaacatatgttcattgaaaaagacaaactaatttatttatcaaggttgcagaataatggttaatttttttctttaaagtatttccattgtgtgttgtcccctgatatcaggtgctgagaaggatacaatatcacttctgttagtgtccctgccaaaaacgcatgaactgaatctaatcatgaataaaaactaatcatgaggaaaggccttctacagaataatttgtgtgcttcaaaaatatcaaagcctgtagaaggccatgaataaaaacaaatcatgaggaaacatcagaggcacccaggataattcgtgtgcttcaaaaatatcaaaaatatcaaagccatgattgaaattttagcctatgttcacttataacaaatcattcatgtagaaaataattcagtaaataatcagacattttatttttatagtaaaatatcattttccaaatataaatgtcagtgaaataaataaaaagctttaaatacaaatgaatattttattgattatttttattttaaaacttttactttaaactttgttaacaattttattacactttttcatttctgtttgtgatattttatgattgaaatttcctgaattaagttgatctgtgttatcttatatttgtcagaaagtttaataatctttaatgtctctgttattattccaggaaaagatagaattgtaatagtctgacaatgacaagtaattgcttagactatttcttttttcttggcttagggatactaaatttgtaatatattaagcttaccatcacaataagaaatattcttctttctgactaaaacaaccagaatttaatatttttgtattacttgatgagaaaaatccatttgcagttgagctaaaaacaaaagaaaacaaacaacagcaataagaaaaacaaaggaaacactgtgttgtttttctgttccacggaggtgaaagagaacaagactcattatactctcacttttcctagattgaaaatttctcttaaaattgggtttgggatctaattccataattcttttttttttttttttgtcttatagtaaagaatatagctgccatttttattttgcaggtgacaaccgaaccttaaactatttctaccaatgctaccagtaaatctaatgagttagcattagcttttcataaagtcataactttgctctggtgaatacattttcagttgaactgtactcaagaaaaattccatcccagcactttacttaaaagattgtttaatgttttgttttgtttttggattagctgtaattgcagaaaagaagtcctcagagcgcagagtgaaagtctttacagctgcgattgtctccccagtggtaatgacaggtttaatttaaaactgcatcctcttctcactcagatcatcttaagaccaacgactcagaattgctctttagagttaggagttggccatggtatcaagtgccgataacgtggtctccacaggaattcagattctgatttgggcctcgctgtgttctaatcaaggaacctaatgaactacactcatggtaagttcatctagtcggaagccttggactgttcccagactcagagtcaaatgttttaagtggtaatcaagtttcccttgttattgctcatatttaatcatcagaaaattctgtgtatttatgtcgatatttaaagaagaatctttgattccatgtgcatgctaaatgcgaattggctgtatagagttatgccgtttgaccttcttcaacacacggtgcggagtgcaacacttccctgcagtgcttctcttctgtgactttttttttaacacttaaatttgcatttttgttcaaggtgatgtgaagaagttcaatgctactagcacatacaattgattcagtactttaagagataaaaattattttgatcagtctattcaacaacaatttattaagaagctattttgtgccaagcactgtgccagatactaaaaaatagtgaacgtggaaatggaaaaaagaagaagattgaaactgatctaatagtcctaccaacagttgctttttagatgaacatagaaattaaccctcctggtcttaaagtttgaaacttacatgttttatctgagtttcttcctcaggaaaggatccccagggctctcaaaaaaaaagtgtcaaagaactgaaactcaccagatcatgacatccagacaaagagatgccggacccctcatccaccatgattacttccttacccctcctgcgtttctgttttctcacacattgctacatttttctccctgctatataaatctcctaattttagcccatcagggagatggatttgagactgagctcctgtctcctgggctgcagcacctggttaaagccttcttccttggcaatacttgttgtttcagtgattggctttctgtgcaatgagcagcaggacctagactgaacccctggtgtttcagtaacaagattgctgaggaaaaagaaatgatattatacacaacgtatatgtttattgattgatcttgtttataagttgtagatctgataaatctgaactataaaaatagggaatcaataaatagattcatacatttattggttttattagttgacacttgacaataaagtatggaattttcctcctcttttttggttcatcaaggctattctataaggtgggttgaaactccaagaaggttcaaaataatccttcccttacacccctacaagaaacttcagttcatgaacttaacaccagtatgtatatttttccagagggttgggaatgatcttgatagagatcaatagaaaaggaaattgtggacttattgggaatagaaataggaagtatagcagatttcaaaatagaaattgaagtttttgcattaaggacttgtaagagattgctacaagcaaaacagacaaaaatcccagctcttaaagttttcacatttatggttatagattacaaactgtctttgcaatgagacagggtgtggttttgcaaactggcagctatgcaacaatataatggaaaaataatgcaaaacttttgcagggtaaaaaggtgactactataaaggatgcaatatttcatgaaatcaataaaagtaatattaaagaactgcacatttcaaaacaaactcagtgacaaatggaagtttatcagtctagaccagctaataactgaagaaaagagaaaaaaaacagcactgatgaataatagctaagttaaatagaatggctccaccaccaaagaattcagaaagatcatggaaaattgttgaaaccttgacattctttacaaaaatttacaaatgttatttaaaatatcaaacataaagtaagaaattctatacctgtatactatcagaaaaaaatatatgcccaattcaacccctaacatcttattaatttttttccttaggatgaatcacaattataaccttattattattaaaagtaaaataaacttattttataacgtacgttttattgagaaaatcttaggaaagcctctcccatcccttaccccattatttactgtgaacctctattcagtggctttatcaagagccactgatcaaggaccttttttatctctatgcgaacagccttcttagccttccaattttgaggtccattcaagtcaagcaattcacttttgttttggttcagcagttggagaattgctgtatttccgatcatcatattcatcccactggattgtaaggatatctttcatgtttagtattctctaagtcagagaaattttaaaatttagatccccaaaatgatagtctgctccactgatcacatgtatctatgtattagttttctattgctgcataaaaaaatgaacacaaacttagcaacttaaaacacatatttagtatcttaccatttccaggggtcagaatctgggtgcggctggtctgggtcacctgctcagagtttcaaggggtttctcaggtttcaccatcatctggaggattaactggagaagaatctgctctcaagttccttcagggacttggcaggattcattgtcttcaggtagtatgcctgaagactttcggcttttcactggagtctgctggaggctgccctcaggccctagacatcaccggcagttcctacccactcaggcttctccaacactggcctttactttcccaggcccacaacagtgaatgttagtcctgttgctaagctacagtcttccagaacataatcaaagaagtggcttccatcacctttgtcatcatctatcggttagaagcaagtcacaggtcttgcccacactcagtgagagggattacatgaatgtgtgaccaccaggagatggtaacaattggggtcatgaggggatatgactgctacaatctcccatcatcaaaaacaaaaacaggaatctgtaagttgaagttcaaggttatgaaaagcaaactggctttctgtttttatcatttctggatatacagaacaattatatcaaatttattaatatgaactgcatcatacttaagttttaaacattagtagtattctatttgaaatttttttcctgtcctacttaaatttttgaggacattttatatgtttaggaatgatctaaaattgtggaatgtcacttttttctaaatcttcaaataattctaaaccaaatggaatacagatgaacattttctagaaatcactgacattcactattttaatttcttagccattgataatgtttttgaagttaacatttactctggtcacagtggctcatgcctgtaatcccagggctttgggaggcttggtagcagaattgcttgaagctaggagtttgagagcagcctggacaacataggattaccctgtctctacaaaaaaatttaaaaagctgggcatggtgatgcatgcctgtagtctctgctactcaggagtctgaggcaggaaaatcacttgagcctaggagttaaagacttaaaggaaacagtgagctctgactgcactacagcactccagcctggacaacacagtgagaccccctctccccgctctctaagcatatatatatatatatatgtgtgtgtgtgtgtgtatatatatattattaaataagtttatggactttataaaatttatgttaaagtgacaagtatatagtgtgtgcagttacaggcatgaagaagcagttaataaattatcctggaattaaaacttgaagagcattctgaattacctatttatcttgaattgtcttagatcaaagcaagagcaccagtgaagaatctatttggctgatatggaccctgttcttgctggttaatgatgagcatcactgttcagctagaacacttgtatgatcattacatggctgactccctgtggaaatgggaagggaataaggaatacatatttggaatgaagaacagtttacaaacacttgtttgttggtactaatttacagagaatagtgcaagagttagctttattttttctttattaatattatgtatgtataactttatatatgttatatgtgtatcttacatatacatttctagagaccttaggaatagaaatctgaagagctgagttgcaaaccccttattttcaagggtcgaacacttcaggtagttggtgaataatttattacaaagaatctctacttagaattgtaacgtgtgtgtatatatattatatgtaattatacatatgtaatatatacatacaaaaagacagagacagagagagacagagaatttacgcaccaaccaacacaaatacatatggaataatagaacatatgttaatatccctaaaattcagtatgtatgaggccagaagagagcgttcataaaatataaaggataaacattatgtatacgatgttttctcactgcagtgaattaaaattagataccattagcaaaagaatggattataacaaaataatggattctacattgagatctttgtcgtcaaccattctctcattacttctgtctcaacgagtgaagctctaggtacagaatgttctacaagttagcgtttccaaaatttcaggaaacacacaatctgtgtcttacataagttgtttcagaacacataaaaggactaaaaactgcctaactccttttatgagactactgtgatatttttaaagttaagcatcacggaaaaaaaaaagaaaatggtaagtaaattttatttctaaacaagttgcaaatttctaaaatacaattgtacatagttgaatccaacatagtagcaaagaaatgagtttaataggatcaagcctgatatatcccttaaatgtagaaatttccatagtttaaagaaaactctacaaagtaaatcaccatattaatgagtttaggagaaaaattccatgattatttgagtagatatttaaccacactattaaaacattttcactgcagcagtcattggtgtaaggctttacaaatattaactcctttaatcttcataatagccatatgtggtaggtaatattacccacattttaaagatgagaaaactgaagcactgggagattatgtaattaggtcaattaaggtcattcagctaatatgcagaaaagctaagatttagtacatgcaatctagctccagcgtccaggttttcaaccagtcttttatgctgcctcttttgcaatatatggagaagaatcatttgataaagttaaacttttatttattataggcatggtagaacacttggaccagaaaaaaaacctttaacatcataaaagctatgtttactaaaagtattcatgttttagaggcattccctttaatctcaggaataagaaaagaataccccctttcattttcctgtccaatatttgttcattcagcaaatatttgctggtcgtctactgttggaggccgaaagaatgagggtcttgatcaactcagtataccaccggaggctatatgagcaaacagggaactgttctcatgaaagcaggatgttggcaaactgacaaactgcactggccacccagaaggaatgctaagggcagtcagacccaggcacaagtgtttcttgtgaataggcacatctgaagcctgttagcaataatatgaaccatgatcaatcaagcagctgatcaatcgttagctccttcttgctctttctacccaaaaaatatgaagggcaggagaagcagcggtggctgcctttgctcactagaagcagggagccctcctcttcttcccctggcctcttctttaaaacagtttcttttgtcttaagttttcatttctgcgttcgtcctcctttgttcagttctgtgatgatggtctcaagtagtaacagtagtaactgtcatagtgacaggctcaagtagtaaccgtggcagtctgccacaatctactatgtgccagacactctcttaggtactgggaatgcagctgtgaagaaaatagaccaaaaaattctaccctcatagagcttacattctagtagaagaaataggtaattagtaaaataattatataagttatattggtaggtaatatgtgctatgaagaaaaaataaaacaaaaataggaatagtgggtactgggaaaagttacaattttaaataaattggtcagaaagtaatccttgaatgaatacttgaaaggggtaacgtgatactgaaggttctagccaatgcagataggagtgaagagataaaacatcattgttagaagatgctctgatcatttaatagaaaattcaagaagatctacccaaaaaattattcatggcattacaaattcctcaggtttccaagaaataaatcaacataaaaatccattccatcatttacattaaaaacagtaaattaaatataatagtatactaataccatttaattaaataccttagatttagcttaacagataaaatgcatttttatgcattttagcttttgcttcataaatatgtttttaaaactcaatttaaaaactttaaagaaaaccaaaacaagtggaaagaaacatcattatatgtcagttccctccaactcaattcaatatttctgataaaaactctagctagattttactggaaaaattgaaaaactgaatctaaaaaaatacagtgaggaacaattgtcaacacttagctaagatgactttgaaaaagaagccccaatctattgtattaagacatattacaaaagtatattaattaaaagggcatggtaatagcatagaaacagatgaatagacaaatcagaaataaaaacatgttcactatacccttttatatataaagatttgaaatatggtcgacctggcatcaagaaatcagtggtacaagagactgagataggaggataacttgagcacagatgttagagaccagcctgggcaatatagtgagaactcacttaaaaaaaatcaatggtaaagaatatatttattaaatactgttaaaaaattggctcattatgtggaaaaaaagactttgattcctacctcacatcatattaaaaaaataaactccagatagtctatagatctaaatgttaaaagcaaatatataacactatgagagaaaatataggaacagatccttgtgatgcagtgtgtgggaaatggtacatatttatgaaatactcctaacaaatattttattacatcaaaattatgaatttgttttaaataagagaaactgccaggaacagtgaggagtctgagattttattctacttgcacactgacaagttaaagtaccatagttttatggatgctatgagaagatacgagactcttgggtcagagacaaagaattctattactcatggcccagcaggcagcatgagcttcatgttcagctggtttctcatagcccccaaggtccactggagcaatgaagatggtcctagatagatgctccactaacagtgggttgacataacagcaagaaaacctcaagttcaggaaaccccaatatttttaaaaaggcttcaaataaacttgcccaacttttgtcacagaaggagatattatctttattagactggacattaaatatgccctctaatccagatgaaggcagtgtctctgtcatccaaggctgtttactatacacacatccttgaaaagatggtacagcacaaaaactgtcaatgtctttgcttgcaaaaagtgcagaaatatgacagacccctggtgaattgtctgctaagagaacaaatagtcaaagtaaacacaaaggttataggcttagatattttgctttagatttttctgactttcaagaaaaagataggaaatcaattaaaaatggatagtagttataatcaactcacataagattcaactaaaaatgtgaatacatgtttaaaaaattgttcaacataagtggtaatctgataaatggaaattaaaactaatataaaacatcaatatatacccatcaaattgaccaaggtataaatcagttaatatcacatgttagcaggaatacatagacagtaaccttcatatcctaccagtaagagtgtatctgagaccaccattttgagagcaaatttggcatattggtgaaaacattatgcatatgccttatacccaataatttcatttctgggagtaaaccccagaacgactttgctcagagatgtgtgaagacgttcaattcggcagtagctggaggctatcttcatagaagatagccatagaaagtggaaatggctgtgcaaattatggtttatctataagatggctgtcattcattagaagaaataaacaatacctagaaatactaaaatataaatatgtcagagtctaatattcagtaaaaatgtaaaactaactgatatttatgtagatgtttaaaaaacacacaaaataacccaataatatacaaaatcacattcacttccctataaccattctctatttcctttcccttcctttgctttctctttctttctcctttcctttcctctttcccctttttcttttcctttcttctttcccctttcctttttttccacagggtcttgctctgtcatctaggttggagtacagtggtgcaatttcagctcactgcaacctcgagcttctgagctcaagtcatcctgccatttcagcctcccaaggagctgggactacaagtgcaagccatcatgtccagctacattttttgtacttttgtagagacagggtctcattatgttgcccagggtggttttgaactcctgggctcaaaggatttgcctgccttcagcctcccatagtgctgagatcacagatatgagccatcaagccaggcatcctttttctttatagccctgatcaccccctgaagttacattacgtttatttattaacttgtttatcattcgtctccgccagttggtggaagccaatagggcactcttgactgtcttggcagtcttttccctggtggatcccagctcctacaatagtgtctgacccataatatgagctcataaattatttttattgaattatttatttttattgatattcatctgtaaataaatgaatagaaacaaaaagtcctatgtaatttgtgtgtcttcaggcctccatggcctctgacattaagtaacatcacgtaacatcattaaccactttttttttttttttttttgagacagggtctcactctgtcacccaggctggagtgcattggtgcaagctcggctcactgcaacctcctcctcccgggttcaagagagtctcctttctcatctcctgagaagtggggatcacaggaacgcaccatcacacctggctaatttttgtgtttttactagtattggccaggctggtcttgaactcctgacctcaggtgatccacctgccttggcctcccaaagtgctgggattacaggcctgagcaatcgcacccagccattaaccacagtttttgtaagtgctttcagctggttttgcaggactcctggctccctgaaaaatccacttaagtacttctgagagtccttataagggggcgtttccctttgtgaagaatccctacaccgaatctatcttcttcttttcctgatagggctgctcctccttgctgtcttttgctcatgaagctgcctaaagggtgactcagcactatgcaacttccaggtaccaactatgagatgccaaagtccatccaaaggatggacccaaggctactggatcttaaggtttcagacaagtgtgtgagactttgtacatgaagttggagaatgcctcactctctaccctgtacagggttgtgatccagagctggatttcagacccctgtttctacaggaactctaaacaagcccaggtaaaagacacaccacatccatttctccaattaaacaaacagcaaacaaagatacaactttatcctcttttcttttctttttcccctccctccctcccttccttccttttctctctctctctcttcctgttttttttagaaagggtctcactctgtcaccgaggctagagtgcagtggcgcaatctcagctaactgcaacctccacctcctgggttcaagcaattctcctgcctcagcctcccgagtagctgaaattacaggcgcccatcaccatgcccagctaattttttgtatttttagtagagacggggtttcatcgtggtagccaggatggtctcaatctcctgacctcgtgatccacccgcctcagcctccaaaagccctgggattacaggtgtgagcaaccgcacccggactatcctttttctttaatcaaacagcaaaatgtcttcctatcagtttttgtaaaaatttctagaaatgtcattggccaactagcttcactaacactcaagctctgaattgcagctaggttagctcttcttgatatatttacatccaaaaggaggaaagagcttcaaagagggtgtggccaaccccgtacaaataaggagaataggtctgagaagaggccattgaatttggcacctagtaacttgtttgtagtagtaaaggagtttctgtagtcacctggagtctgacttaaaagcactcaaaggattttggatgttctgtaggtcgactgggctccactaaacatttggcaacagacaagcatttctctccaagacattgagaaatacagagcaattctctttattttctttagagatggagacatgctcctgtagccaaagcaaaatttggagccattttgcttcctggtccctgggcgtaggtttgctcttttgtttaataagagagtcaacagtgctttttacaatcagtggtttctccagcatcctgactaatattatctcccttcacaaaataggctttggcagcccaggctgtggtaaacaattcctgagagtgcagtcactgtggtcactctggccccctccgctctcgccatcttctaaacccaagctgtaaacattctggaacaagggctccataaactcaagctattttgttccttcagagaacaagtcacaataaaaagaggtttataaaggcgtcgtttttttgccaagagagttgaatgaattcttttatctcctcatgattcattcctaattgcaagatttttatttttagaaagcattttggaggtttttgttatgtagtggtaaaaacacaaaatgatgcactcagcattccagatcacaggctggagaggaggaggagttctgtggatgtggctctcgccatgcaaggagcctgtggtcttggtcagcctgggctgctgtaacaaaacgttgtcgactgcggctctgaaccacaggcatgaccttctcacagttctgggagttgggatgctgaggtcaggctgccaggctgttgggcgcttggtgagggccctcttcctggttatgtccttacctggtctttttgagtggcgcatggagaaagaaagagatcctgggtctcctctgctttttataagggcacacactgatcccatcacgagcaccccagatcctgggtctcctccactttttataagggcgcacactgatcccatcatgagcaccccagattctgggtctcctccactttttataagggcacacactgatcccatcacgaagacctcaccttcataacttcatctaacccaaatcccctcccaaatgccccacttccaaataccatcacattgagagttagcatgtcaatatatgacttttgggaggacacactcatttagttcatagcacctgtaatcagtgaatacaagaatcgttgatctctgtagcggaagaggattttctcgttgcctgactgctcttgaaaacagtcctcctggagagaagagtggagtgcaggaggtgatgacattttcattccatatgtgaaacaataaatgcctgatagtgagagttttcagaaggatgaacaggctgtttgtaagaatactgagttctatgtgactggtggtatctaagcaggggttgggtaattgtggaaaaactttaagagcattcagaagggcccagagaagtggctcgtgtctgtaatcccagcactttgggaggccaaagtgggaggatcgcttgaggccaggagtttgagaccagcctggtcaacttaatgagaccctatctctacaaaaaattacaaaattgggtgggcgtgatggtgtgcacctatagtcccagctactcaggagtctgaggtgagagaatctcttgagcccaagagttcaaggctgcaatgagctgtgatcgtgctactgccctccagcatgggaaacagaacaagactctgtctaaaaaaaatgtgtatgtagatatatggcagtccgagcacccaggtccccagttctcctttcagtgctgaagctatgtgtttgaaaatttacttgggggccacagctgcatacaccctcatcacttctgcacaattctcagtcctcaggaggcaatagtttagacttaaacttcaacgtaagcagactacattggagaaggacaaagggaagctttccttggttccataggacattgtcaaggagtcaggggcaggactggaatgaacagtatgagaaatgaagtatgcacaatcgtgcgtgaacattatgggaaacatgacaaagatgcgatgattttgcagtccccaagttccctgcgtgtaaaatcaagtgtcacaagcaaagcagaatacttgtcagttcttttcagtgataatgttgacaccattcctcctggtttgagttcctttcttcccatgctctctctacccacagaaattcagccagttttcctgtcccaaatcaaataggactttccccataaaataattccctgattcataaaatacaatgactataataattatctgattcctgctatccacatgtcttttgatctattctgtttagcactcttatatctcttaggttattctttactctaaaaataccttttcttacatactagagtctaattttttgaggacagacattgtgtcttttttagacttttatatccctaagatgtcaaataccctaccttatggctagtacatctcagtagatagatattaggtggccgggtgaatgagcagaacattctaaatggggagaaacggcaaagctaccttgctgctgcaggattctgctccctttttccttagatctaactatgtggtcttttatttcagacactcggctgggaagtgagagactcaaaacaacgtgagaagtagaaagcgggcaagtttgttggggccatatgtaacttcatgaatatcactgtttcaaggactaagttataagttttacccttttcagataaggaaaacagagtgtgagtggggttagaaagaggaaaaacagcaagccaagttgaatcactcatcctgagaggcattcaaatacagagttatggagaaagcgactttcctccacaagggtaaacccctcaacagcagctggtaaacctcagtccacagcgcagagtgtgagaaagggaagatttcaaacaacttaaatacaaagaaaacacttttttaaaacattagtgattcttttccacatttccctttaggctctattcatacggaaaatattccgctacacctcacagcaatatatcttattttttttaatatgcagcaaccgtcagccaactcatagctgaagcagggacactgtgcagctcttggagcttgttcttagtatgtgttcagagggctaatactctgtcaagcagggcggatgatagccagagcaaacagccacggtccccacggtggaaaataacgttgccaggcaagccaaaatatgattttttctatgaattttctttccagggagtacctctgaaaaacacctctctagcataacagtcactgaattaagttatatatttttagacaccactaactgttctttgttttttcttccatttctagaaaattccgcacatctggaaagaacagcaatgaacaggaacttgtgcattcgtgctaggctcctactgggcccgcttcgtttcatttcctccatttttatgacactttcccatgctgctactccagacattccatcaaacacctcgccacgaacaaattgaaagggaaggaaatctaaagaaagtctgactgaatttctgagtgtctcatcactagaatgaccaggaaaacctgccaggagtgtagattcaggcccctaatcccacttctctgcagtctcctcttggtctctgtgtataagctctcctgcctttttgcacctctaatccattgtcagacaaactggcctacttgtgtttgcctctgagagcctgtccacttcctcacgttaggagaaagaacacaaagaatcctagctttgattcagttttccatacttcagccatcagtctaccatcaagcacattttttactgggcaaatgaaaagtcattgctttcaattttttttttttttttttagactgaatctcacctgtcacccaggctggagtgcagtggcacaatctcggctcactgcaacctctgcctcccaggttctagcaattctcctgcctcagcctcccaagtggctgggattgcaggtgcccaccaccatgtccagctaatttttttgtattttgagtagagacggggtttcaccatgttgactaggctggttttaaactcctgacctcaaatgatccacccacctcagcctcccaaagtactaggataataggtgtgagccacagcaccccgccaatatttttgtttctaataaaacaagaactagtagtgcactccgtctagagcaagatagtgtggtggggacagggagcaagtaggtaggggataaataggtcaagaactgaattcacaattgaggctttaagcttgataagaaataaagcaagtttgaatcatctgggtccctggggaagcatttgtttagaaaaagatcaatagtaaataaaaataccacgcacctagtttccaggtattgatttatctaaaagggacctggctttcacatatttacgatatgcaagtgcatttcaaagctttgcctgacagctggatgcaagctgggtgaggctgtaggggtgacagtgtcatcacatgtgagagaggctgtgggggtgcaggtgtcatcacatgtgagagaggctgtgggggtgacagtgtcatcacatgtgagagaggctgtgggggtgacagtgtcatcatatgtgagaggctgtgggggtgacagtgtcatcacatgtgagagaggctgtgggggtgacagtgtcatcacatgtgagagaggctgtgggggtgacagtgtcatcacatgtgagagaggctgtgggggtgacagtgtcatcacatgtgagagaggctgtgggggtgacagtgtcatcacatgtgtgagaggctgtgggggttcaggtgtcatcacatgtgagagaggctgtgggggtgacagtgtcatcacatgtgagagaggctgtgggggtgacagtgtcatcacatgtgagagaggctgtgggggttcaggtgccaccacatgggagacaggctgtgggggtgacagtgtcatcacatgtgagagaggctgtgggggtgacagtgtcatcacatgtgagagaggctgtgggggtgacagtgtcatcacatgtgtgagaggctgtgggggttcaggtgtcatcacatgtgagagaggctgtgggggtgacagtgtcatcacatgtgagagaggctgtgggggttcaggtgccaccacatgggagacaggctgtgggggtgctgggtaccaccacatgtgagaatacagaaaacacaaagccgtcagctacggagaattaaaatcaaattcgcatagctctgtactctttcaggggatgattcttggcctattttaaatattctgaattaactttttcatttcctacattttttccctgacacaagcacattcccttagaaagagaagaatcataccgtatctctatggagataaatatattccttggtttaaaacaaaatcctttctttcttccttatttccttcatttcctttctctcccccttcctccttctcctcctctccatctctttctttctttcttttttttttttttttctgagatggagtcttgctctgtcgcccaggctagagtgcagtggcaccatattggctcactgcaacctccgcctcccaagtttgagcgattctcctgcctcagcctcagagtagctgggattacaggcacctgccaccgtgcccggctaatttttgtatttttagtagacatagggtttcaccattttggccaggctggtctcgaactcctgaccttgtgatccacccacctcggcctcctacagcgctgagattgcaggcgtgagccaccgcgcccggcctccatccctttcttattattattttagctgagcagccctcaggcgagggtgtcatctgcgcagcgggaggcagagtctgagttaggtgcatggtggagtcacactgccagccgctgtggaccgtgggaacgatgcctggcagggtaagggtggcaggggtgcagcgtgggctgttggtgattgggagaggaaagacggcatccacaaagggtgtgacggggtgatgcccacggagggtgctgagggagatgatggctttgacaggcgttgagtacctttattggtactctggtgccgagaatcaccaatatggaaaaggagaaaactgggatgaacccgttaatgttggactggaaatggaaatatcgtgtggatttcaatagagagataaacagatactataattacatgcaatataattcatctgtttcctagttctgtcctctgagagtcagagagaagtgacacctcaagagcagtcggcacatcttttccgtggtctgtaaatgccattctccactgagaggactcatggctccttggagagctcgctgaatcctgagctggggaacggaaggtacagatgggccagaaacacctttttgtatgggaagataagaaaatggtcccgaaattataaaactatgttgagaagacattgtcaaatctgggatcatttgattgtcaaataagtaatgacagtgacagattataaccagttgaataagatgggaatccatgagtctatgcagatatgaatgaatgaatgagagaggtaaaatattttccttttatctctgatttaagcaattcagcaaaaacatcaaggcatgtaaaacatgtgggtgaaagttagatgaggtacaaactacttggatagtctcaaggtacctctgcacaaaatacttccaattccaaaggtagaagagaatagatttactatgagggaacctggaagatatgaccttaatccagtgctcatgtttaatatcaccagtaatgggacaaagtgcatttgtttgcaacctgaggggacacaatgaggaaaacatggaatcactgctctgatatttctgctcaaaatgctcaacttgcatctggacatgaagaaaaatcacataaacctaaataggaggacacagtacaaaatacctagcctctaattttcaaaagtttcaagtttacacaccagtcaggtaaagagggagaaggcatgaatccagcctgagggtaactaaacagacatgacaactgtattagtccgattgtacatggctataaaaaactccctgagactgggtgatttataaagaaaagaggttgaattgactcacagttctgcatggctggggaggcctcaagagacttacaatcatggcggagggggaaggggaagcagatgccttcatcacatgacagcaggaaagagagagtgagggaggatctgccacacttttaaagcttcagatctcatgagaactccctcctatcacgagaacagcatgagggaaactgccccatgatccaaacatctcccgccaggtcctgacacaaagggattacaatttgagatgagatttggatggggacacagccaaaccatatcaacaactgaatattaatataactggattctttctattggaaaaatggtgaagcttgaatcaactatatggattagatggtagtaatatacccatttgacttcctgattttggtggttatattatggttatgtagaacgatgtcctcatttattagaaatttatactaacatatttgggaggtgatggggcataaggttgcaacttaatttaaaatgattttaaaaagaaagaacttcttgtactattattttaaattttgtaagtttaaaattattttaaaataaaaatgtgaatacatacacaaagaagtgcaaacaaaatcggaaatttgaacaagatctgtgggttgtatgaatttcacatcctagctataatagtgtactattgttttgcaaaatgttactattgaggaaaattggttaaaggtataacaaaacttgtgtatcatttcatgcaattgcatgtgaatctataattagttcaaaaagattttaattatagaaaatagttttaaaatgttcgatttgagggaactagcattgaacgagcaaagcttttcagtgaatcatcataacagttctatgacatttcacattattttattcaatacacagactaagaacataaagggagagaatttaagaaatatgcttaagacttgattgttattaactagaatgaatgaaattagattaaaaatgtctgggtctacagatagaataaaatattccaaatatactcaattaccattactgatgaaactaataaatgcataatttttgtcaaataaagtagatctaaatttttttaaaaaaaataggtacttagttctctgtgcaggttatgagggtaaataatttttattactaagattccacagaacctaaatttcaatatgaacctgaaaataatattttcgtaattcacctacaaacagacccaacctctaaaagttcataaggaatgactttggtattttcttggcagaaattgcaattttataaatcaaacagttagcagttgacatgaaaatacttaagaaaaatatagaaacagaaataagacgtgagaatagatgtactgattacctaagtaggagattctgtcctctaaaattagctcacttttagtgttggacacatgtgataggctgagggaaaatagattcttctttaagaacatggaacatcattaggcaaattaagttattgctggttatctgctctctgaaaaaaaaaaaggcccctattctaacactggaactccagatgcagctcatggaatcagcatgtgttgaactaaacgtagagcacatgacaggtgagagctgctgggagacgtagggaatggccacgcgtgggagcaaacaatgagaccaattcctctttggcaataataaacagtcttgtttgtctgagacgcagtctcactctgtcacccaggctggagtgcagtggcgcgacctcggctcactgcaacctccgcctcccaggttcaagcgattcttgagcctcagcctcccaagtagctgggactacaggcgcgcaccaggatgcccagctaagatttttgtatttttagtaaaggcaggatttcaccatgttggccaggctggtctggaactcctgatctcaagtgatccgcccacctcggcctcccaaagtgctgggtttacaggcatgagccaccgcgcccggccaataaacagagtcttaaaaatgtaaattcaaaatcatagggaacatatttccgacttatctctggccgcagtaaagaaaacaacggagatggaaaagctcaagaatgcagtcagctttctccatccaccctgacatacagtgtgaaatatgactgactgaagctccgctttcaagataaaggatgatcgtcacaacggctagtatttgtgggcttcccgtagttgtctagagttaccaagtggcaagtggctgccgcgagatgaacgcggagtagcttggccgtaaagaccatgttctcggtaattaattagtcctttgtgagcagttcagtacaactttgaaatgtatttacaaacttcagaagttataacagatttttggaaaggacactattatttaaactgtaaacggatcttgctggaaatctataaagacagtttggatgtatttacactgacatttaaaaaatatcttttttttttttaaccaaaggaaattctttattgtaaataagatataaagtacaacaaaagaactattgtgcaaattgtaagtcataaggatttttttaattaaaacttttgttttctaaggatccaagttttgatgtcagaaatctacacccaatatacaaaaacaatgttaaatgggaagatatagtgacatttttcattacatattttaagcaatttacttttgttttgccactgtgtatatcatccactatataacagaataaaagagaaatactgttaacaaaagcaaatgttctaataataatttttctacccaactacctccacattcccaaaaaactcctacaaattaacaggacaacatttgtaatttaattgctttgaagcatagctacgatttgtttttgcatttttgttttgaaagtttaacaaatgactgtatctaggcatttcattagcttagaactttagtttgcctgcagtttcttgtgcagatttgaaaactgtataccagtgtgttttctgtagactctaagatacactgcactttgtttagaaaaaaaatctgaagatgaaatatatattgtaaagaagggatattaagaatcttagataacttcttgaaaaagatggcttatgtcatcagtaaagtacttttatgttatgaggatataatgtgtgctttattgaattacaaaattagtgaccattaaaaaatatctttgtgtactttgctggctacatctcaaggacttttttaaatcttttgggaattatagttcaaatttccatatttttctaccaagtgtaaggatatagctgggctattctcatattaacatccagacctcctaaaagcatgattaactgagagatttaaaccaatgtcctttttctgctcttttaagacacaaaaaaacttgaaagaactatatttagtgtctactagaatcactatccagtacatttaaataatgcacatttaaatgaataatatataatttagatcaaaatttttttttatgttaagtgtgattaaatacatttcccctaatcttcaattattattcatgttgatttgctccttcttgagtaaagccagctcacaccaaatcattactgggttatccatgattttatggcacttgtcactggctcctcatttgggaattaaggtaccttactcaagtatcaaaaattttacagccctttctctctatcttctgtagacttattatccctctattaagagagacataattaatttctcttagaaactctcagtacaaagtcataacttacattccaagttctaagctttctctccgctttgactaatttttatgttgtaacaaaaactatgcagctgaacaatataatggtctgaaaaaagtgacaatatttttaaaaattttatgcaaatgttatttgcacaagaattttaaagttttcctcttaatgcagtccccaatcagatattccacaaattgatttttaccttcctctcctatttaagaatagaaatgtcttaataaattgaagtatgttaagacactgtgagagtctctttaaaattgttgtgttcaagaaaaggatgggccaggtgtggtggctcacgcctggtatcccagcagtttgggaggccaaggcaggcggatcacttgaggtcaggagttcaagaccagcctggccaacatggtgaaacccatctctactaaaaatacaaaaaagtagccgggcatggtggtgggcgtctgtaatcccagctactcgggaggctgaggcaggagaattgcttgaacccgggaggcggaagttgcagtgagccgagatgacgccacggaactgcagcctgggtgacagagtgagactctgtctcaaaaaagaaaaaaaaaaacggtgaagataaaatacttaggaaaaaaaacttagagatgctgctagactactcactagatattattatacaattattggaaaataattttcagactgacaaatgttgactatattttgccaacgaatccagctgcagggagaatcctgacctgctgacaacatagcttgcaagtttactgcacagtgctccattttagccccgcctccaggaggtgccgggtcttcggcgatgaaattattcaaaaagtatgtctgaaatgattcattcttttcccctttcgtttgcttttgaggccccttttcttagcagagaatttagaaaagtcagattgggatcaggtactgtgatgcaagggcctggtctcttcagttctggtttaggccttaacagaaaggacaagtagaatgcttgaggctttcacagtcaaccagttcaaccaacatttggtgaccagataggatttgagggcagaagcccaaccaggaacaaatagttttatttgttagagtatagcctgcatcccatcctttagaacttaagaataaccaacagctaagtggggaggtgagttaggtatggccgaggcaaggggacagcatccagagaagttagccgggtgttaccccaaatctgggccatagtggacagttttccatgttcagtgtcattagttgttttaataacaattgtcatgattaatgaaaaatccttcattaaggaaatgctgaaatgtgtcttatgatcttattcccctagattttagattgggatctcaggaagacaagaggtcaatattactctgagcaattgccatccacagggaaatggatacacgaaggtgatggggagctgattctgggctcctcaacaccagcaagtaaagataacccttccccgcataacgttaagtctcttctattgataaagagtgtgtcagggaattttaattatctattgcattagatacttatgaaactttgtagaaaaacaaaatacttgtgcacatgaaaagaaaaggtatttgcatcctataaatttctattttaatttttgctagtattcatgtttgtgtattttatacttttaatgtgttgaaacatacatttttattttgacttttgcaattcatggtaatatttatgcttccatctactaacagaattgacaattatatataggattttattataaatattatattattataatattatccatgtagtctgattctgaccaacgatgttgcacttgaccaggttgctctgaagttgaaatgagccagttcatagtgctgtaggcttaggcagcattgtgcgttactgaaatttatttttgaagttttaattgcaaaatgtaataaaaacaaaattgtttttatttttgtttctgtacattttttttcagcatatggcttatgatttctatttccttataggtgagcttttaatttataatgatcatttgctcagcaggagaaggcctgtaactttgtatacttgtatgcacgtgtgtgagatcaagcttttatcagttatattgttatatatcttgtcatttatgtgtgtcctcactatcatttatagaaattattttaattttaatatatataaatattcattggctatttttcctttgatgatgtgtgttcttagtattgcacttgttcccctaccaacccaggctttatttaaacagaattgcctacagctccatggtgccttaagaaagcagtcatatagcaaaagtaaactgagggaacagatcgccccaccaaagttgcaaaaactccttgtgtctctagctgtaatttaccatttttaagggagtattttgccagctgaaaatgagttatttaacccaaaatgtatatccctaacaatgtacacatctccatttgtatctactaatattctggtaattgttttatttttgcttccatcataacatatctttccaaatttacatggcaatatattattttaataattctttttatgatgggataatttcaattgtgtagacatttaaacgcaccatttttaaagtctgagaattgatcatttttcattattatctaaatatttaagattctaagtatgaactaaatctgtacagtgactctatactgtcttaactgggaccattatccactggaaattatccaccagatctatctattgatctattgatctatctatttatctatctcatcatctatctgtcttagccccgggggtaggtttttagcacctagatcagtttttcacagctattctccatgcattcgcttgctttaggtcatgtgaggtgatgatttcagagttgattccgaggttatgaccaacctattggatttgtttccgtggtggagctgcagatgtatgaatttataacaaattctccagttgattcttatacacactaaatgcgaaaactagagctctaggagttttccttttctaggctcatctaagtacaatcaaatataatgtaagttttattacccaagttaaagaacatttaaaaataaccaatatttaaggatgaaatataaattattttttccacatcaatcatatgaaattgttaaatatctctccaagagattttaaagaaaattagttcctctacctgtaaaaatatacaggtgaccattttctagacatgcgttacttgaatttctttaaattactctcttctgaatgaataaaatttactatctattgattggcgaatatttactgttttattaaagtgtaacatacatacatagaaaaactgtccaaagcctaagagcacagttttgtaaatttttacgaattgagcacacctatgcaaccagcacacatatccaggaagacagcactgtcagaactcatccctcctaccagtcactaccatctccccagggagcatttcacctattccgatttataataccacacttctgtggttagcctaaactacaggtttgtttaggctaactttgaacttcacacaattataagcccttcatttctggcttattgtgccccagcattacgtttctgagacccagccatgatgctgcctgttattactttattctcattgctgtatgatattccattttatgaatattccatactttaccaaagatagaaatgcctggatcatagatgacccagctaggagtatgaggatgctggatgctgatggtgtttaacaaccagagtctgagaaaaaagaagaaaaagcactctgatttacagcacttgccaatttctgaggtgcaaatcttttcacctttgccaatttcaagcaaccagtggtgcatctcgcaagctggtcagccagcccagcacccctttggcagatagtaccaagcagacttctcgagcggcttcagccccaccagcagtctgtgacagttctagttgctccacatacttaaagaggatttttactgctgtggattagtttgcttttagcagttctggtagggacgaagtggaattgactgtgatttttaatgggcattcccttgttgaccaatgacattagtcagcatatttatattagcagcatattttaatatattcattggctatttaaatattcattaattggagttcctgttaagtctactatccgtgttttctaagttgtcttttattttggtgtgaatttttaaaatgtaacataaataagtttctctcttattcatcataactcttacacaactggatatctgtttcggaatctcagagtatcaagcctagactttgtgttactaatagagcccactaaatcttttcaacagcaacttccctgatctttaaaagcagattagagcttcaccctccacttagagtggagaaaggtttttaccttctaacgacttctttgtgaagttagaataaaaacattccctgtgccatctgccagaccttggcctgctttgtgcctctgtctgcccccatcacttcttcccggttcctgtcccgaggacctgctgagctcactgtgcctttgcacttactcatttctgtacctggaataatctcccctcggtttgcacttgactctctgcttctcttcactcggtcctcatagaagcctttcctgaccactcctcctttagaaacactctatccaactactgagctttaatcacatcatagcaattactaacatgagaaatggccatatgtatttgtttacatctttattttctgtctcccaccttttaaatacatgatgcaataaagatacttaatctgtcatttcattcctgcatctaatacttaaaacacggccaggtacataattagaattattgaatgaataaattaaatgcttatttgaaaaaattggtttcttcgcaaacttcaactcctagagcattgtacacaattgcaaacatcatttatccccttagccatattttcttaacaaaagattttcccgcactttacaaaagtgtgatttttcatactttctaaaaagttttggctgggcacagtggcttacgcctgtaatcccagcactttgggaggccgaggttggtggatcacaaggtcaggagattgagaccatcctggctaacacggtgaaaccccacctctactaaaaatgcaaaaaattagctaggtgtggtggtacctgcctgtagtaccagctacttgggaggctgaggcgtgagaatcgcttgaacctgggaggtagaggttgcagtgagccaagattgcaccactgcactccagcctgggcgactgagtgagactccatctcaaaagaaaaaaaaagttttattttcttgtggtaagaacacataacataaataagttctaccctgttaacaaattttaagtgtatagcatattattgttgattataaagacagtgttgtgtagctgatctctgaagcttattcatcttgcttaactgattggtaactctattttccctttcccctgccctgacaaccaccattccactgtttgatcctataaatttgactgttcgagatacctcatgtaattggaaccctgcagtattcatctttctgtgactggcttattccatttaacataacgtcctcaaagttcattcatgttgtgacatattgcagaatttactcctttgtaaaggctgactagcattccattgtatgtgtgcaccacattttctctatctattcatttgtggatggacctttagttgtttctacatcttggttattaatagcgctgcaacagacatgagaatgtcaatatctctttggatcctgattttaattctggtaacaaaaacaaaataaacaaatggtactatatcaaactaaaaagcttatgcatagcaaaggaaacaattggcagagtgaaaagacaaccaatggaatgggaaaaaatatttgaaacacatatatctgataaagggtcatctccaatatttagaaggctctcctacaaggcaatagaaaaagaaaaaaaaatgaatgacctgattaaaaactggattaaggacttgaaaagacatttttccaatgaagacatacaaatgaccatcaggtatatgaaaaaatgcccaatgcccctagtcatcaaagaactacaaatcaaaacaacagtgatttaaaaaaaagacaagtgttaatgcagatatggagaaattggaatctttgcacaccaccgatgggagtgcaatatagtataatgctgtggacaacagtatggaggtttctcaattaaaaatacaattaccatatgatccagcaattccacttctgggtaattatcccaaagaattgaaatcttccctatttttatttcaatattataaacagcatatttttcctttgatgattaaagctggttcagatccttttattccaaccagattctacttggaatgcatagtttcaactgttggacctgagacaaaagtgaagaagagaacaggatgtacgtaaggcaaggtcaaatagatgcatgtcctatgaggcaaatattgttctaggtgccaggaatgccacaatggacgcaataggtagatttttgggaaacacgaaattaagaaccgggacaatctttataagacagagaattgcaaatcaaataaaagcaaacacgaggctacacttgtgaggggtaataacaaaagtggcaagaaaagtaagggaccagggaagttgcacagtaaatccagaaaaattcttgagaagacctttctattatgctggggtttcttccgaagttatgtgcaaaatcttgaggctactcttgtggcatctgaacctggcctgtaacatatttccagtgttaccccgccccatctgttggcagagggagatctggtcctcttgcagcagtggtggagaaagaattccatcaagtttggggggatttcttgctggatcctcgttcctcgggttgtctcttcagaaccgtgcaatttcgcaagtccttcaaccagtcgagtcacagcaaggcttcaatatgctcagacgacagatttgtctcaagtgagatgctgggtgtgatgtggttaggctgaaagagattaatgcaaaataaaagatgagttaattgtaaagctgagagaaatttgagatggaatgtagttgggttgctgatgattgctgtgccaatttctgttaggtagatgaagcagtaattttggcatggaagccaggcttgccctttggtattggagcattccctgggattcgctcatcaggtggaagatggtttttattctaattttacctgtgagaaagtggtcagcacgaattattcagttcttgactgggagattatatatacctaagctgtgtctccacatgactcagcctttgcaagtcacattgaaaaggaatacaactatgactgcagaagctttgaggtattcccattgcttttaacaagtccagcctaggcatttcactctgctcctcacacaggaaatttaccatacatctgtttaggtacagtttcctctttctgtaattacacattcgtgaaagccacacatacgcaaaataaataaaaatatttttgtgtgttgatgtcattctgctcctttattctacttgctcctacctctgtctccaccctcactaaacacactcatgcacaatgtccagcccatgctactcacccgagccctctagcctagcttgctgcaccattcctgtgccctggtgcagctgttagacaagcatagcctcacaggcagcctgcttacttggatttagggctgcagctgagaggcctatagatgacttttcaaacaagaatctctagggttcaggggaggagagctgtgaatgtttgtataacttgtttttcctgttacattgctagtgtgaacataacattgggcagatagttttgagaattagaggaggaagccataaagaggagagttttcttggtagatgtggaccgtactcttaaaaaattttgccatgagcaatggaatagcttagtttgtttgttcattagttatatagtgccagaagttttatttaaaagttcactttaaatgtttagtattcatctgacaagaagaggtaaaatgatgatacacgaactttagtttgaaaactgaaggtaacatcctgaaactaggagataaactgagtcttgaagttagatattatataacccaaaaaacgatcactctagattatttctgaagttatggtctgaaggaggccatctttgaaagggtatctgcattcacagaaagaatgtcacagaactgggatagggattgatccatgatgaaatgtaagaataaagatgaccagacagagagggagaaagagacaagaactaaagacaaattcaaatggattctagattcctaattcagctcttaatagtggcatataatgtgatctttaagggaaaaaaggtaggaaaaactatttggacaaatgaaactttacagagcataatcttgttgaaagcaatttagttaaaagcaagatggtcagcagattactttggcagaaatatgatgggttctcaatgacaatacctagacactagttttttttttaatcctagtcatctttggtgcaccatggggacactttgtagaacttcatacatgattagctattttttccccaattttggggtatttttctacttttttcattttgatatctaatatggtttcagacttagttgtgtttaaccaataattcctcattattttgctttttgtttttacattaataattcaaattaaaatgatttccacactactctgcttaccataagaggatgttggaataaaacatttgggaaattgcctaaataaattatggtaggttacaaaatatgatcctattttggctaacatatatatttgtataataagtaataaactaacttcatattttagaaatagatttgtatggataataaaaaggttaatggatgatttggatgagtaaaatttcattatttatttatttattctagagatggggtctcactctgtgaccaaggctgaagtgcagtggcacaatcatagctcaatgcagcctcaaactcgtgggctgaagtgatcctcccagctcagcctcaggtgcacacactaagcttggctaatttttatttttatttttgtagagatggggtctcactttttttcccaggcagatcttatactcctagctttaggtgcctcccactttggcctcctaaagtgtcaggattgcaagcataagccaccatgcctggcaaatcccatttttttttatgctctcattttttctaattttattttttattaaaaaatacatttgacttttaatacgggaaaatagaaagagaaacaaatcataaattggattattaatttaagagacataaaattttgaagaatgaggtttttgtactttaataatattaattttaaaagaatcatgcctattctatttatttggctgtgtttccaactttgtacaaggacataaaataaacagcttttttaaaaaactcatccacctttgttagagttttaggtcattctaatgtttccctattgaaaatgtgaaagagtaggcataattagataagagtgaattagaaatactggtaaaatatagagaaataaacaggtaatgtgggaataattggctgataattggcattaaaaattagacaatctggtcgggcacagtgtctcaggcctgtaatctcagcactttgggaagccaaggtgggcagataacctgaggtcaggagttcgagactagcctgaccaacatggcgaaaccccatctctactaaaaaaaatgcaaaaattaggtgtggtggcatgcccctgtaatcctagctactcgggaggcggaggcaggagaattgcttgatcctgggaggcagaggttgcagtgagctaaggtcatgccactgcactgcagcctgggcgacagagcaagactctgtctccaaaaaaaaaaaaaaattagactatctaaaaagttctaatgggtggaaaaatgcaaactttctacgatatgcatcaaaatagtctaaataaataacgacagattacaaaattgtgtcatgatctcatttctcctcataaataagacacaattatttatataatgtataatatgcacattttgcattttagaaatgagtctttatgaatattaaaaaggttaatgtgaggttgcacaatatacaacaaaagaatacttgaataatcagttcctattgacattcatttttgacacaattcttatacacactaattttgagcaaattgttgggttgaatcgcaggtttcagctgaactatgttcagtcaaatttaagcaattttttttctaccatgtatcttgaattgtatcatatattaggcaacccagggctactagaaattgtggctaacctgaagaagaatcttgcaggatctgatagaggtgattgaatatggaaaatatggaatacttgggcatgaaaatttgatgggagacatattgagaaacacataaatgaatttaaaggagtcttcaggatgtgtgctgtaggttgagggagaaggtgtgtgagttcggggaccatgagtccccagttctgctaatgcaagaacgtgtaggtgaggaagtcttggtggattttaattttcctttgggaaaatagaatctccaagtaccttcatgatacttgttcactcatgtaaaaggtgtcacgtgtgagtattcactccaggagagtcaaaatatacacatagattggtataaatattatacattttcattgataatcaaatagttagatgatatcccaaatcatataaagaactactgtgtggcagttgaatgaaaagatctgaatatattaacatggaaatatttttatgatattattatgagaaaataattttgcacaaatttttatatcacatgaccccatttatactaaaacattgtacatggcctaactttttattcatttatgtatatctgtatgtaaatgcatagaaaaacattcaaaagtaacaaagcacattgttcttattcctgagaatgaaatgagaataggtgacgacagtgggcgatctgtacttttacccaaaatacattagtatcgtatgcatttgttacataaaaatatattcccatgttactagcaggtgtggcaaatatgaaaagcttgagtaactcaaagaagtaaataaagaactaaatggaagaacatctaaaatttaaatttttaaagtagctaacatttaaatgagtcttcaagtgtttcctcctcagaaagatattttttcctccacatggaggaaagaagagggcaagtgagaagataaaaattattgaagatgtacatgctcaggagttagtcatatagttgtaaagatttgcttttcgtaagggtagagccaggaattgtatctctacaactatttgggtcaggtctggataaatattatagtgctttcaatagaagtttaaaaaagaatttttaataatgaaaaaaattctcttaagtattttcttcgtataacttttccctagaaagtgttacatgatgaccaaaggtaataaattacgacataatggttagctagttggagtttcatttcaaaggtatttaagtacctcaggttgacaaaggcttgtctacatatgcaagatggattaggtaattatacacaataaatcagggtgaaaaacctattacaaagcaaaggtaggggtgagggctgtttctgtgtctaagattgattgcttaaattagttaaactcactgtgttctttactttgcaagaacactagtgaccaaacgaacacttttcctactgggtcagtatcttgcatatacaaggttctcaatgaatatttgtcataaaaaattgaatttaaatgtaagaatgctttcaaaacactacgtattcatttaaaactctgttgttttgcctaatttataatattttggttttagtttaatgctctatgatattttatttactcttttaaaagctaaaaaataagttattaataaattattcaacatgttaatttttgaatcagaagaaagcagaaattaagaaactgatggtaaaagctcttggatagtttggctcaaacttgagtgataaatggacaatttagaaggaattcacccagacatcttccacacatgaaggtaccccagtggctttttcactgctctcattcttctctttatcagtgttaaacagcttatcacgtgcatctcagctctaaagtgcttgcgcacttcctccagccttttccaaagcatttctacactctctttaccttaaagcaatgagaaaacccaaaacaatctacacagcactgggattgatatggtttggctgtgtccccacccaaatttcaacttgaattgtacctcccagaatttccccatgttgtgagagggacccagagggaggtatttgaatcatgggggccggtctttcccatgctattctcgtgatagtgaataagtctcgtgagatttgatgggtttatccggggtttcctctttcactcattttctcttgctgctgcctgtaaagagtgcctttcaccccctgccatgattctgaggcctccccagccatgtggtactgtaagtccaattaaacctcttttccttcccagtcttgggtatgtctttatcagctgcgtgaaaacagagtaacacagagattaacaatgtggtttaacaagtttgctgtataatgcttagaaattccatacaaaataaactatttacaatggcagcaaaaatatgtggcataggaataaatgtaaaagcgacatcacatatttttgctgccactgtaaatagtatattttgtatgcaatttctattttggaatattataaaacattagctgaaaaatatcaaagaagacttaaataaatagaaagttataccatttcattggcagggagaactcagtatcatacatttgtcagttttcccaaaattgatccagagattattgacatttccaagaagaattctaaaataggttgtcatcaaactaaataagcagattaaaatatagatatagaaaagcaaagggcatgaatgtccagtcacacctgaagaaggagattaggtcaggaagacgtcccctatgaaagacaatgcttattaaaaagctgtagttgtgatatagtggatattaattcaagaaaagccaaatagttgaatgcaatgaataaagaatctagaaacaaagacacatgtgtgtaaaaatatagatgcatgacagaaatgaaactgtaaattggtggattggttttggagcagttagctaaaaatccattccagactgatcaaaaaattaaataataaggaacactaacaaatgttaaagaccacatatgataatatatttatgacttggtggtggcaacatgattgtcaaataagaacaaaatgcactagccgtaaaggaaatatggttaaattttatcacattaaaattaggacttcatgttcatcataacacacaaaaagagagtgagaaaacaagcaaactatgacacaagaccagcaacacatactagtgataaaagtcagggtccagaatatataaacttgaatatatatagaaacaaacagctcgacggaaaattgtgcaaaaatatgaacaggtagcttacaaaagtgcaatcatgaattactaatacatctatgaaaaaaaatgttgttaaatcccactagaaatcatgaggatgaaggtaaaaatcacagttagctgccatttgacaccaacagactgggaaaacaaatttaaatctgatagtacaaatgttcagaagattgtgactcccattaatcagcggtctttggggctttacctagtaatggtaaacacgtacgttacctataaacacagaaattccactccttggcatataagctaaagaaactcttgcctatatgcaccaagagatatatacaacaatgtttgtagctgcattttcacaaaagcaaaacttggaaacaatttggtgttttctaaaaccagaataaacaaatgaaagtcacatatttaaacatgtatgcatctcaaaaacataatactgagcagtaaaagaaaatcacatgcgcacaaatacacatttatatttggtaagatttattattataaaagctaaaattaggcaaaactaaatattgttcaggaatattaatattttcatataagtattgataaattcaacataataaaataccaaagctattgataatgtacaatggtggctaaatgggtagtagcctttttatcattcttacatattatccgttatatatagttggcatatattttaaaacaacaatatgaaataacgtgatgaaaaaattaacgaagctacaacatgaatccctttttgagcaagttgtaaaaagagatctgggagagtttctcctctctgtatctaaaagtaccatctcatctatatttaagacgtcgaatatagactcatgcagttttggtttaactctttaaaaacggctttcaacagggtttcatgctcccttaattgcttgttgttaaaaaaaaacctattttctctgatgtcttattttaatttttataaaccagtttagtttaaaaaacagtgagttactctagcatttacacttgatttgctttttaaaaataccttctaattaagaaaaaaatcatagtttaatatagagtcattaggacaggtgggggtgggcggcgagggggtggctggacttcctcgggagcgcagatctgtgtcctcgcggagatcatcgttctgcacagaggaagtctgtgacgtgcgctgccacccgttgctcctggcagcagtgaggaaaaccagcttagggaggcccggggagcacagcagaatggcaagcagactgccagccagagggacactgttcagtacaaacttgttgactcggggcacagtctggacaggccgtgtgacagccttgtgtttcaattactccagcccaaggaggcaggaaaaaggaccatctaattgagaaacaggcattgtatctaaattgagatttccaagggtgcatccttgttaaaaaggagaactcatggttaggtgcagcctgccctgcaaagcctgggtcactgagcatcagcaagcttatttttaaatcatctttttttttttttatgatgacacctccgactggaaatcattgacttggcagaatagcaagtcacacattaagcaacaagcgaaatacactaatcgtagcttgactgttttgtaaagaatttcacagcacaaaaagttaatatcattgatttggaggaagtatgtaggggaaacccatatgtagtgagtatactaattgtgacagctcttttaaaagcaggcagaaggcattattgctgaggcagcttgaggagctgtttgtcattttaaaaaagcatggaagccacaaaaaagagttgggcaaggcttgggagaactgaggaattatgagaataaaaaacaaaaaccggtaaaaattctcttccatttcatttgaggagctcggaattcaatgctttctcttagataatgagagagagcagttagaggcagacggaaacagcacgaagtgctcattacttttaaatgtgcaatttaaatactcaagtgtatccatggaaaaaaagatttaaatagcaagcttcattactatttgctcctagaagacaatgatctctgcagattgccccattctgttgaagtcaacatggagatgaatagcaattttgcagtttgagaagaagaggggtatgtgggaaaactgaaatgtgaacaaaacaacagttgggcctttttccattgtttatgggtgctttgggaattctctgcagctttatctttcatgatggcttaataagtaaaaatacaggacatagtctacatgtttgagacatgattcacagaatggtactaattcacctaagggcctctgcctggcttagtccacatagcacatctaagcatctggaatcacaatggcaatcttcccaaaggccaagggctttagttattttgctggttatgtacatagaccagcataaactatgcagccatctgtatttttctgtaccaagactgagtaaaatgaatttataattttgaaagtgttcatccttgatgaccccttcacgctaatttttattcttttcaaacaactgtagggtctgggatgcccggaactctgttcactccaaatgtcccatccatcctcatttgcctggttgcccacagctttgccatctcagtatgttccccacacaacgccatgggcaatttgtaagatcgctagcagagcaggctcttgaaccacgctgcctaggttaaaatatccactcccagcttgctgtgtggaatgttgggcaaataacttaggttctctgtgctttctttcctggcttctgaaatttaccgaagagtaataatacattcccattcagttactgtgagggagaacagagctcagcacactggcatgcaataggtgctcagtaagcgttatatgtagtcatccacaccacgcatcactactgtgactgtgttccaccctgaatcaaatcactttctctgtcagcaccaactccttcgactggggtgagtgtcagcagcgagtgacatgcagagccacaccagggcccacagcgtttcccagagaggagaggtaatccacaggggaggttcagaatatggagcctcctaagatagcatccgtaatgtcgcaaccttggggatatcagaagaatggcaggtgatttttttttttttttttgagacggggtcttgctctgtcacccaggctggagtgtagtggtgccatctcggctcactgcaacctctgcctcccggattcaagccgattctcctgcctcagcctcccgagtagggactacaggcgcccgccaccacgcccggctaatttttttttttttttttttgtatttttggtagagatgggttttcaccatgatattttactgaaactaccaaggggggaaattgaataacagagaactccagagtgtgcattatcacaaagggcaacttcaggtagaagtctcactgatgttcctggagcctggggatcttggtcatcaaggaaaagctgcacaaaaaaaagacagggtaaaaggacttctgattttgccagaagagcagccaatgttatgtaaagaaagacagttgaacccttaggttattttaggtcataaaaaaagacttgattaaaacacatattgtagagaaaatttataaaaattttaaggatgccagttcatgtgtggacataagctaatgaactggctggggcaaaaccactggatttttgatgatattctaaggaagatggcttgattcctggaaatgaaatttattaatagaagagattaccaggcctaaggcatatatgctattttatattaatttttaaagaactgagttaggatgtattttacatcctaataggaattgtaaataaaaaataactgtttgacaattatgcagaaatggttttgtattcagtcttgttgtctgtcattgtcatcatactcttccaagggtatatatttttgtgcaacttacagtccaaaggcaggaaagaacccacaaggcctttgcttccacttagatggagttagaagttgtttccataaggtgataagagagggaatttagttctcattatttcacctgcccctacaccctccattcatccagatagaaagccttttgatagaattactcattgcccttctagatatttaggtagcttctttaaaaatacaattcattagatgggcagtggaagttgaccaaaatattcagggacctatcatagtaagtattgatttatgagagcacttttctcctgacagggggtgctagggaagcatggagaacaggagaccaactccatgggggaaagatgaagagcaatggtgtttttgagcatgggccctgaattaagtaagacatatgttcaatttctaatgttgacacttactagctgtgtaaatggccttgggcaagttcatggtacaagctaagcctcatatttcttcatctaaaacaacagggattttagtttctgttgtattatgaaatagatattaataataattattgagcaattagtgaaactgttcataaccagactgactgtaggcaagtatgaactctaacagattaactatgtgtacagcatagagacacacaagtggataatgtgaagatagaggaaaggacatatgcattcgaatttcaatttgaatttcacagcggtagtcaaataatacctaccatcaccagaagcataagaagtccccatgcagagctgtggttttctagcccttcttcacgcttccccatagccttgatgggctagatgctggccatggttaccatgcactcacctggcgagggctttgttatagcttcatgagtctcagaagttggacctgctggctttagagtccgactaattttgtttttctcctagaagttgtttctgaatggataatttggtgttagacaattagaaattcactggatttctggtctaggcaagatacatttgattgatttttcttttcatgtaatcgtttctggtaagtctctgaatgagcatgttttcaagctttttattataaataacaaagcaaaatacaagttatagaaagacattagagctttcttctaatcttcttgcctgttgtcagtctcctttctcctttcttccctccattccttcttcctccttcccttccttcctccctttgtacctgccttcctttcctttttttttttttttgtttgtagtggacaaattagttatcatcaatttatttctgaatatctcaaaacttgaaatgcacaaacatatgctgttagtcacaatacttaaatcaccaagtgtcctttttattttttacattaaccatagctttgggttcaactatactggagaattctattccattgaattaaaaattgcacttcaatatcaatactgcactaaaagctctggcattgaattggtgtaattttaaccttctaatagaaatggttggtgtggggtttctatccagccagcacatgctttaattttgagagaagttctttgaagaatgtctaattgttttcggaagtatgtccttttgttttcataaagctcacttttccattccctgtgccaacatttttagccgttgtgggattttctacactgttgcttgaaagtcaaatttaaggtcttaggcaatttctgcttaaaaattccatgtgacagatagaatggaggttgagactgaattgtaccagtgatcaaattaggtcagctctacacagccatggctgaatatgtataaaaccaaaacatttaggctttcacgttattactaagtcagtctctccccctgccccaccaaatagaatctatctttttattgttagaggaaaaattgttctatggtttgtttttttaatagatttacaaacctctgagtttttataaaatacaatgggtatttaattaacttatgaacttaaagcttaaaccacattatttccttttttaaatgccgaatggaaggagctcttctgatgggtgaacctacccttccttcatatagctcagtccgtcaatatcttgtctcagcatgtcttttttacaattttacccaaagagagatggatagaacaaggttggctaatggccagatcaaggtggggaaaggaatcctagtgtagataatttaacccctttcctcctgcctgtccttacatccacagccctatgtggctaagcataaagagaagtgctgcaccttgactgctgaattctgaaaaggtacagaaaaagtaagtggacagaatagagaagaattacaagtcagatagatattcctctgatgagtggagggtgggtgcagaaaggcaggaggaaggttgcggaaaacctagtaacacccatgtagtagagcgttcccatgaaacaacttccagactcggagaatgaaacctgtttaccaatgtacctgctcaaggaggattttcctgatccccttttccaccctcattcgctcatgccccaacctggaagaacagaagtaatagctattgaaaaagatagaaaaggagagagaagctggtcactcctttccttagctacatgaaagagaatcttcaagtgaagatcaaggtgttgtttcatggaactaaacgttctatatattttttaaattcgtgtatattttatgtcttgaatgtcatgataggaccaaattccatgaggtcctctataactaggacagtgaaaaaaacctgacttgtgagatacttatcacaaagcaaccttatctgaattctcaatttaagttttccaggataatttaccctacttttggattaagaaataaaaatctggctgggcgcagtggctcacgcctgtaatcccagcactttgggaggccaaggcgggcagatcatgaggtcaggagatcaagaccatcctggctaacatggcgaaaactctgtctctactaaaaatacaaaaaattagccgggcgtagtggtaggcgcctgtagtcccagctacttgggaggctgaggcaggagaatggcgtgaacctgggagatggagcttgcagtgagcccagatcgtgccactgcactccagcctgggcgacagagggagactctgtctcaaaaaaaaaaaaaaaaaaaaaaaaaaaatctaatctctctatgacataccggaaaagcatagaaaatccacactatttggaatagttcatgttcgtggataaatatttgataatttataataccttcagcagctaggctcgcaaaagagcttgaaaaaagtgtaacattatgaatgacatatttactaatttttggtctacctcgaatgatatcaaatttcatctttggtcatgaacattcctaaatcctgatagagatatacaaggactttgaggcatcttgctgttgcatcttgaatgtaatccaacttctccatgttgtatttacctgaatagtcaagatgacttgacacaggagggcatagggcatactacagttcttgagtttttaaaaagcattataaatgtaaactttagaaacttacaaagaaaaaatgcactgatcttatttgtgcaacttcctgagttgtgataaatgcaaccactcatgaaaccactgtccacatcaagatataggatattttttatcatgcctgaaaattttcttttagcccctttcagttaatctgcatagccacaggaaaccactattctgatttccataatgataaattagttcacctagtctagaacttcatgtaaatgaaattatataatatatactcttctctttccaggttccttcacttggtataatgtctgagattcaaccatgttgagagtatcagtagttaattcattctattgtatgaatctacaacaacttgtttatcctttctcctgttcgacattggttgtttccagtttgtaactaccattaacagagatgttctcaacattttgtacaagtgttttcaaaagtaattttcaaaatataaactttgtacttttttgttgtgtactcctatgcacatttactttattgtttttgatgaaaatatcaataggattgtttttcccagatttattgaaatataattgacatataattgtatatatctaatgtatacaatgtggtgtcttatacatatacaatgtgaaatgattaccacaatcaagctaacatatccaccaactcacatggtgacaataaccattctaacagttatgaggtgatatctccttgtggttttaatttgcatttccctgataattagcaatgttgagcatttctccatatacctgttggtcatttgcatgtcttcttttgagaaatgtctattcaggtccattgcctatttgctaatcatgatatttgcttgctattgagttattagagtccttggcatattttgaatattaatctcttatcatatatttacttgcaaatattttctcacattccatgggttgtctctttattttattgattttcttagctttgtagaagctttttagtttgatgcagtctatttttgcttgttttgcatgtgctttttgctattttatcaaaaaaatcattctccaaatctacatcaaatagctccatgttttcttctagttgttttgagtttcaggtcttacatttaagactaacccattttgagttgatttttatatatgatgtgacataaggatacaatttcattcttctgcatgtagatattcagttttcctaacaccacttattgaagagactgtcttttattcgtgcgtgttattggtgcctttgtgagagagcaattgactgtaaatgggtgcatttatttctgaactgacaattctttattattaccatttttaattgacacataataattgtacatatttatggagtacggtgtggcattttgataaatgtgtacaatgtgtaataatcaaatcagcacaattagtaaattcattacctcaaacacttatttctttgtgctgggaacattcaaaatcttctcttctagctattttaaagtatacaaaaattgttgactatagtcatgctacaatgctatacaacagtggaactaattcctcctagatagctatgattttgtattcattaactgacctctccccagcctcctctcctgactacacttcctagtctctttattctactctctacttctgtaagatcaacttttttagctttcacatatgagtgagaacatgcaatattcatctttctgtgcctggactattttattgcacataatgtcttccagactcatctatatttatgtgattgacaaaatttcattcgtttttatggctgattagtgttccaacatgcatatacaccacattttctttatccgttcatctgttgttggacacttaggttggtttcatatcttggatatcatgaattgtactgcaataaacataagagtgtagatatctcttcagcatactgatttttttttcctttgaatacacaaccagtagtaagattgctggactatatagtaattctatttttagttttttgaggaaccaccatactcttttccataatggctgtactaatttacattcccaccaacagtgtatgagttgctggtttgtgtattctgttcctttggttaatatgtctgtttatataacagtaccatgctgttttgtttattatagctttgcagtatattttgaaaccaggcagtgggatgtttctagctttgttcttgctccagggtattttgtttacttggggtcttttgtggtgccaaacaaatattagaatttctttttctatgtctgtgaaaagtgccattaaaattttggtagatatttcattaaatctgaagatgtccctgggtcgtatgtacattttaacaatattaattcttccaattcatgaacacatgatatctttccatttatttatatttttcaatttttgtcatcaatgttttatacttttgagtgtacaaatcttttatctccttaaatttatttctaagtatctttttttttgatgctactgtaaaaaggattgttttcttcatttcttttttggaatagttcattgttagtgtatagaaattctactaatttttgtatgttgattttatgtctttcaactttactgaatttatttgttagttctgacaggttttgtggagcttttagtttttttatataaaaaattcatgtcatttactaacagagacaatttaacttcttccttttcaatttggaggttttttgtttctttctcttacataatttgctagaactttcagtactacgttgacaagtggtgacagtgggcatctttctcttgtttctggccttagaggaaaaggttttagcttttctccattgagtgtgatgttttccatgggcttgtccatgtgtggtctttattgtggtctggtacattttttcaatacctaatttgttgagttttcatcatgagagaatgttgaattttgtcaaatgctttttttttttgcatctactgaaatgattatatactttttgtccttcattatgttaatctgatgtatcacatttgttgatttgtgtatgatgaaccatccttgtattccaggcataagtcccactcaatcacagtgagtgatcctttgaacgtggtattgaattcagtttgccagtattttgttgaggatttttacatctgtattcatcagtgacatttgcctgtagttttcttttcttgtagccttcttgtctgattttagtatcaagataaggctggccttgtaaaatgagcttgaaagtattcctttttcttcaattttttggaagagttagagaagaacttgtataatttctttaaatgtttggtagaattcagcagtgaagctatcaagtcatgaggttttctttgatgtttttgagggttttttttttatcatttctaattcaatgtccttaatctttattggtctattcatgttttctactccttcatcagttaatcttggtaggttgtttgtctccaggaatgtatctgtttcttctaggttatccatattgttggtataccttttgcacctctgtggtgtcagttgtaatgtcatctctttcatttatgattttatttttatgtcttatatttttcttagtctagctaaaggttttggaattttgtttatcttttcaaaaaatcagctcaatttggttaatatttttattgttttttctgatgtctatttatttttgctctgatctttattattttctttcttctactaaatttgggcttactttgttcttattctaattcttggagatgtaacattaagttgtttgagatttctccatttttgatgtgggtgtttattgctgtaaatctattagaaatgtttttgttgtatcccatatattttggtatattgcatgttcatttttatgtcttgaaatatttttaaattttcttttaatttttttctttgacacattgattgttcaggaacatgtttaatttctacatatttgggaattttccaaaattcctcctgtcattgatttctacttttatagtattgtggttagaaaagatacttgatatgattttaatcttcttaaatttgttaaggcttgttttgcgacctaacatataatctatcctggagaatgttccctgtgtacttgaaaagaatgtgtattctgctgctgttggatggagtgtcgaatatatgtctgttaggtccatgtaatctttattgttgctcaagtttgctgcctttgacctggagcccgtgtctgcaggggctggcctaacaccagggtttaatggggtgggcttggtagcagggtctgtggcaaagtcaggttctcattttcctctcttttacctttgtggaggtatctctcagcacagtgcttcctgggcttaggagaggagtttcaaaagtaatatgaaactctcctaccctcttcaatgtgtgttttcttattcctgtgctctacccaggtgctgtaacctctcatctggttcccttggctcttgtgaaagtatttttatttgtgaataattgttcaaattaatgtttctggaagggatgagggctggaaacttctatctactatcttgctgatgttgttctgtcttgagctgcgtttttaagtagcatgctgcttcttgctgaaagagcatctaacaaccttaaaataggactctggtgaatacttccacaccttcaagcatcagaagtctgccagtctgtgattccaatcctttcccaacaaaagtcaaatgctagcataattgagagaacaagatggttgtcaccttgggaagtaaggagtatgaagaattattcaggcatgtgtcactggggatataggtgccactgatgcaaacaggaaagtgaggaagaaaaagtatgatagggtttgagtttaactttaggtaaaaacaacactacttatgaactgtaatggtgattaggcaataggagatatttacagcgtggactacagtgtttgatatcagtatttagaaatggtcaatagaaaggtaattcaggttgaggctattagaaaaatgctgatttgacactgcgagatgttggagttacaagagaaaaatgaaaagcctcaaaggtaagagaaagaaagaaaatgttccttattttgatgatccaaattcttaggagtcaaaagttaaaaaaaaagcttattgtaaaaatttatgattattaagtaacttgattaccattagtaaaaataccactttttaaaagtcatagttaaataaaagtgtttgaaaataaagatggaaggatttcatattaggggaaaatattgtttataaaatgtaagtatatttaaatatatttaatttagaatacatcaaatgcccttgtaaaatattagaaaattaaaacaagaaaacagatctatgaacttaacttatcccagagattgacatatttttcttcatagttccaacttattctaaaagtaaattttactcagaagtttaaaaatactattaatcattaagagttgtgtttattggaatctttttatggtagccttgcctaattacaattaagcttatatttaacttctgcaaatgtcaaaataattaataaagtaatccaacagctctctctctcactctcttttctctctttctctctctgttctcctacaaatgtatatatatccatgttcaacgtgctgcactaggtgctttggctgacaacaataaggtagagtccagaggtaatataaacacatacgcaaataattataatacaagttagaatattttctggttcattagatatgaattattgagtggtggttataaatgttgaatacattctctattcattcctgattgattatagttaggtagcggtgtaaggcaaattttgatggaatgatggctaatttcaaaaatctcaatgctataatttttagaaaataaataggtatattatgaagcaaataagccttttgctccgtttagaatttcacattgatttatgtagtttcctgaagaatatttacggcaatgtaattaattttgaatgttcagataatgttattgtcaggccatgcagacttaattcatagcaagctcttaggcagaagaagtacataaaatccaagctgttgactattagtttcagtaagtgcattgaagcaatttttaacaagtgctctttaggtaattcagattttagacttaatcataaacctttctagagcatttctatgccaactaaactttaaatataaacagaaaaatctgtatgccaatatgttaataaaatctaagcatgataaagaaaaaatagacatgctcactgagattttaaaagttaaaacattgcttactacatactagtcatagttgaagagaatttactaaagattttggactcacttagcagtgtgcacacatatcttacttacataattacttgaagcaaccacttgaatccatcttgttcattttgcattttataagaaagaacaaactaattatgactctacacagaagacaaatataagccttgtttgctgggttcatttagtcgtatacctctgccgctcagaagagcataaagtagagaaaaagcagaagtggtcattattctgcatgttgtagcagtgtgcttaaaaggttaaatatcccctggagccaactgtcactaaaggatggaagggatgctggttttcttccatgctagggcacaggcagcaacatgctgatcaggaagccatacctcgagagaatgacttgaaatgggctaatgtggacagagtgaagatttatgtgctgtgatggaagaatgaggaaagtgctagcacaagacacaagtcagcccgatggcaagcgaaccgttaacgtgagctgaaattcagtgcaatatacaaacaaggggcatgacagagagaaaatatttgaatatctgcgtatgtaggcttactctaaaggagaacaatgttgcctcttcaaaggtcttcagttgaactatgataacttgatatgtgctcccttaaacttatgtttagagagaaatagacaatttgagaacacaagagccaaagtattataatgcgatatatttaaagatttcaagccatggttactttcacagacaacagcgtgaagctcaggtggcccaagatattcaattctgtctagagctcactaggtgtggtcttggatcaagttggtgctggaacaatgatggatatacaactcgaaagatttatattcattctgtggcaactcctaaaaatgccctacttgtttagggtcttctatatgaggtgccaaccctgcagctacgagtgtaggcagggctcacctgcccaaagtgagagacgagcatccttcataagcagaaatatgcttggaagtggaatcatagcttgtgccgaacagtgagcaaagcttctatgtaagccatgtgaatgggtgatggcactttacagatctgtcaaatttacagccaaaatattggtgtcacttcagttgctttattaaatattacagggtattatatgtcaaattttatttctagttagcaatcctattacttcattacagatttggattataaaatctgaagtgagttgtcattttgtagcataactgtatcatgtttattttagtcaattacatagttgatttaaaaaactgattttctgggtcacacaaaattaattttcatattttttacaaatttgtcacaaagacgaatcaatgactaatacgtactgcattatgtttaaatgattgattgtatatgggtgaagctacttctctaattataaaactttcccctgactgctttctatgtgtttaccctgttggagtaagaaagggataaatggcaacaattttcttttgaaatgttatattttctgaatttatatatggacagtatttttcccacagttacatgatagtaattgattgattaaattactatcatgtaactgtgggaaaaatactgtcaatcaattcataaacattatgttgaaaactatcgaccactattagtttaattgggtttatgttgctcttagtaggaactaaactatatttactagcaaataagaattcattgtagatctctgttgggagacaatcctcttttcgtcttttgcattttggcatgtcttgggagcagaggtggtaactgctggtcttccgtgctatttttttcaaggatttgtttagtagcagatgccttggaagataaagataagtgtctctctccagggaaagagcaggtttgctgaaataacaacaatatcttcctttagaagccctattgtaggcttactgcctacaatataaaatactggggaacctaaaggcagggttcctctcctgtaatacaatgtattgccactgcaggtacaggtgtcctctacttctctttaagttgccctttaggaattaagcttgcagaagtaagacaagaaaatgctgatactctggctactgatggttcttgagtaataaagtcctttgcctctgacctgtgagtcccatgacttttgacagaacccatgagactgtgccaggctaacttattagcttccaagtaggataaaaatctcggacccttcattgttcttggcagtatcatgacacgaaacaaagaacaatgggagcactttaagaggagagaaaagagaaggagacaaggttttcccttcagacactgtgaatttctgcccttggcatgaaagtgtgtatgtgcattcaattaagttaatatgatttccttagattgtcataatctcctaagtgtgtgtgtgagtgcatttacaagacaggaggcttctgacagttgttaaaaggattcaggagcttagattgtggaaacagctggttgatttttctccatcactttggctaataggggaaatgaaagaatatactaggtgattttatatatatatatatataacttttaactttaggtctatagaatattgagggatagttaagatttgatagacttctgaactgatctataaaatgaactgtgtgcagtctttgcctttatgtattatactttaatggatcagatcagactttctctcaaattctttttgtctagagcaggcctggtgagtgaaatacaggtggtgtgacttctgcaaaaggtggattagccccaaacacgtggtgcgcgttcacagggattctgggaaaaagtcttcctgaaataaactcttccatttgctctcagatgcctggaattctttaccaccaaaaggaaatcctttcatccaatgtttacagtaaaggattacaatgcacatacactgggaaaggtatgcttgcttaagctggaaccttgctgtacaagaataatagatttcctaatagctggtcttcagtcttaaactggtggtggtaggtctttatatgaaagggagaaatacggtcagaataattttgttaattaagataattctcattacccatatccagtgccggcaagcaaatttttatcgtgcatgcaaacgcgacttgattgtcagtggtttcctagagggctgctcaaggattctagggcatgtccaggttcattgagaccgctctgttgtcagtgagccacggtctccaggagcatcaagggaaagttgttgcacataaactagatatttggttcccacattattagctgcaaatggcttactaaaagtaaatgtgtccatttccgatatcctgtcatctagtagccaggagctgatgtcaaaaattaatggcacattttcatttcttgtctttctagttctcccttcggcagcacctacagcatattcttgcttctgagctgaatatctgcgttcctgctaaaccagagatcacagttatcaggtgattgatcaactccagtgtatcaaatcacaaagttgaacaaccatatcatctaattttagaccattttgtcactccaaatctattgtacttattagaagtggctccccatgccttctccccatctctaccgacctctctgtcctcaactctcaggaaccactaatctatcttctttctctatagatgcctcctctggacatttcatatgaatggataaatataatacgaagtctttcgtcactgctttctttcacttagaatgttgtagcatgcgtcagcacttccttcctctttatcactgagtggtattccattgtatggataggcctcacttggtttatctactcattagtggatgtagttggatggtttccagctttagcttttatgaataaaattgctatgaacattcctgtgtgagtttttgtgcagacatatgttcttatttctcttgggtaaatacctaggggtgaaattgttggaagatgtaataattctgtgctcaacattttgaggaattaccaaattattttccaaactggctgcactattttacattcctactagcaatgcatgaagattataatttctacacatcttagcttgtattttagttataatttccatgtttctctcccccaataaactgaagattgaactctattttgagctatttttcattcatttttatgttatcaggaatctctaaaatatgtaaaaattagaagagggatggaaggctgagtgtggatataacttgacagataggaaatttaaaaacttaatctaagattttaacactttttcttgacctaatttttcctgaccttcttaatgggacaggctctaatgtgctatttagcctgattttcacacatattattatgagtactcaaatctaaaaataacaactttgtcaatatttcctcaggactatgaccagggtgccatgagaatgtgatattataatatcatctctgcacttaattttaaagaaggaaatcatattcaaatgacaatgccttcaacagtggttccatgaaaagaatagcaaatttctgttcaacaatgagcgtgagaaagaaaaacaggagaactcaggaaatatgaatagtttaagttagttcagccattgtgggaaacagtgtggtgattcctcagagacctaaaaacagaaatattattcaacccagcaatcccattactgtatatatacccaaaggaatataaatcattctgttatgaagacatatgcacatgtgtgttcactgcagcactattaacaaaagcaaagacacagaatcaacacaaatgcccatcaatgacatattggataaagaaaatgtggtacatatacactatggaatactatgcagccatacaaaagaacaagatcatgtcctctacagggacctgggtggagctggaaactgttatccttagcaaactaacgtaggaacagaaaaccaaatactgtatgttctcacttataagtggaagctaaatgatgagaacactggtcacatagaggggaacaacacacattgaggcctttcggagagtagaggttaatgggtgggagaagggagagaatcaggaaaaattactaatgggtagagggcttaatacctggctgatgaaataatctgtacaacagacccccatgacacaagtttacctgtgtaacaaacctgcacttgtactcctgaacttcaaagttaaaaaaaaaaacacttaaagtaaaaataaaactgtacaattaatgagactttttataagtcaaaaaagccattaaataatattctcttgcacgttacatattgaatttcgctacaaccttttctgttttacctaagtttttcagaactgacatagattgtgttaattacacaaaaattcagagggtggcaagagtacatacatttccatattttaatcttcaccttgcaagaaggcacatgtggcttagaagctcttccgtccaggactgaggtatttacctgacatatcttagatgtcagtgaatcaactgtcagcatttattgatcatcttccaggatattagtgctttgcaagtatctctggattaatgagtaaacattttgcaagtgatttgcaagtatctctggattaatgagtaaaagaggcagtgaggaagaggctcagagattattctaactgatgatttaaaaatattttagaatgacttgtgcatggtgattactgaatactcatgaggagccttcagtccacctgtgctgggcacacatcaagtctccatgttgtataatgagtctttttatgagttcacaatttgtgtcattgattttaacaaattgacatttattatctgagcaagtttaatatttccccaaaccttcagctatgcaaagacatgcttttgatggtaaatcttcagtgttttgtatggaattccagcacaggtatgtctcattttcagaatcactttttcttggaagtctgtcttaaaaaatattacattaaagaaagagaccctggattgtccttaagaaaaaagatgattgagtttagcaaatctacatttccccatatatatctactttccacagtaaaacgaatcctgattctgaaatttccttatgatatttttatctaattttcattttgagggcacagaaaatggaatgaattacacttatcttcatcactggggtttagtataaaacaaaaatgttcccaaatggcaaaaccaagaaaaggtataaaacttaaacataacttttattctacatctatattaatacagtacagaataaactcattgggttttgttcgatcctaaatatagcaagaacgcctattgtgagtctgcaattgaatttttctcacttgaagctactacctaaaattttaccttacctttagacagttaaaataggggaaaaaagaaaatgttttggacaagtattattgaaacatgatttgatcaaaatcatttcgctcatttattttgattatattttcaaattcatataatatatgacatatgagtcatataacatacaatatatatgacatataaaagtcatgtaactcatatttttactttctggccaagaaaatgccatttgttacttaaggtttttcttttagtgaaaattcaaaatcaaataatgaaaaagtgtttaacacaattagaacatatattggaataaacaattcctattgttttgtattgtattgtttggttggttgtccataacagacctctgtgagaactggattatgaatttttattgctacgatctactttgattaattcataattgctatgtttcatgagtttataatgctgacagagttagtatatctcaaagtgcaaattcataaaggaagggtaacttgattctaattcaattacttaggaattcaactttgagccagttggtacttaaagaagtctggatttgttgattttacttcacagtaatactttccagttgccattgctatttatttattatttttgcatattctccacacttatctaagatggctgctatactcagaatttccagagattaatatgctgaggtctgaaaattcaagtgtgcaataagcattgtctggtaaactataagcccttccatgtgaaattagtcttgggcttggttcgtaattggtcacccttttacttccatgcaatccttttctttacaatgagaaaatgagcatatcatttattcattcattcactgatcagatattcatgagagcctactgtaagccaagcatgattccagcaccgaaattaactgtggtgaatcaggcaggcaagctctcagctcttgggaagcttacaggctaatgagagagacagccaattaacaagacaacaataaataaagatcaaagtgctataaaaactacacaagggaatgtggaaaaggggagtctggggcacttcatcagatgggatagttaagagtggccactctctgtagatgacatttgagctgaaccctcaataatgagaaacaagaaactatgcaacgatcttggaaaattacctccagacagaggaagtagcaaggcaaagattctgtgcctgtgattccttaccatttgcattttctgctttgttaggggttctttacataaacatttatccacaccaatagggcatagtaacatctgttcttgttaattttactcagaggactgagtagtttagaggaaaaatcaattggtgatccatctctctactgcaaggataacatactttgttttactggtgtaaaaagtttgggttggactttcttgtgttttcaaaactggttcccctcttgggattagtggcactgagagtcatcatatagaaagcaatagagaaaaaaaagtggctgttgtgaataagagaaaacgggagaaatgctggcctctggtctaaagcaagaacaaaaacctgatatatcttggttttgttttgtaagaaaaatcaatgagtttatcttattttctgacatgttggtgttatattgctgagttgtcatcttaatttctgttcttagaggcaatcagatgcatggatccttaaaaaacagtaatcctgggccgggcgcggtggctcacgcctgtaatcccagcactttgggaggccgaggcgggcggatcatgaggtcaggagatcgagaccatcctggctaacacggtgaaaccccatctctactaaaaatacaaaaaattatccgggcgtggtggcgggcgccggtagttccagctactcgggaggctgaggcgggagaatggcgtgaacccgggaggcggagcttgcagtgaaccgagatcagccactgcactccagagtgcagactccatctcaaaaaaaataaaaaaaataataaaaaatcctgattatcgttctagcggttctcaaactgacttgtgtgtacaaaaaggtgcttcctgtaagtaattgttcatcaccttataaggcttattaggatatatgttataactgtataaatctattatatatatctttatataaacacactcatatatacatagttatatacatacatacttttcatcagaattactgaaatcaactaataccaccaaaccaaactaaggagatagtccccccataaaacttgaggctatgatgtgtctgataagccatggccagaagcttgcacatgcactcaagcacgagcactagtgcacaaccagccaaagtgagaaaaccagtgagataaagaggcctgcctaaggtcacacagaagggcggcgggtagtctgagaacacagccacgactctgggctgccaattcagtccagtgcttcctcctggggaaaattacagaccagctcagacggtacctgcacagacaatggccttattctttctttactctcctaatttgattatttttttcttgccgtaggacttaagtaagacattttggcaggcacttaaaaagaggagtgccaggcacaatgaaagagtccatgggtgattctgctgcaagaccaaggagaaataagttattgatgatgtttaaaggcagagaggcccatggcttactgagtacccagtgttgctgataactctcatcttcttattcctctgttggaaaaaaattatagggttgaattgctccttaactgttttctaaggagaaaaaagggatagtgtttattgcattgatttttttgctttatttaatttatttttcaaaattcttctttaatagcacattgaaacatggatgtgtaaattgttttatgtcttcttatcttcaagtgcagtaactaacaatgacaatttttccagttgcttatcactctgctgcaaccaataatagttattcataagttactctttttaatgcataaggctattgaataatgttagtcttaaactaggtatcttattccatagttgaagactgtagactgtttttgaacattctttgaaccatttcttgtggttcaaatgagttcagccaccactatagtttcaccaagtcttccttagagtgagagtaccttgtcagccttctggacttcagtgtaaatggcaaattgtaaggggtaaataagtgtatgtgtgctttgtaggaaggcaccagaggtctgtgcaagttttgtttgtttgtttgtttgtttgtttttggagacagagttttgctcttgttgcccaagctggagtgcaatggtgcgatcttggctcactgcaacttccacctcctgggttcaagcaattctcctgcctcagcttcctgagcagctgggatgacaggcgcgtgcctccatgcctgactagttttttgtatttttagcagaaacgggcttcaccatgttacccaggctggtcttgaactcctgacctcaggtgatctgcccgcctcagcctcccaaagtgctgggattacaggcgtgagccaccgcgcccggccaagtatttttaaatgtactgtccttgtggaggatttctttgtcatagagctccttcctctagtgaccctttgttaatctgggacagtgtaaactcagccataaactgtcaactcctggagaggggctagagatcattggtctttttatacccaaggcgttgcctggaggccggccccagtgcagattctcaatgaatgtgtgtttgattcataatcatgtatgtactatctctcttctaaaggaacacctttaatcaagcaaaggaaatatagctgtataagtggagtatctagtcggatcaatcatctcgtatagaattttgtgtgtttattcctctttcagtagctgaattgatgcaaatgataaacactaaggtcgctgaacggacataaggtaatgattttcacggtgttttggttatacaatctccaaaacatgcagctttatctataataccattcataagtttaaaaataattggtaaaaaggctgcaactatactttccattgccctaaatatcttccagaactcatcttgaatgacttctccatcccccaccctcctgtgccttctctctgccagaggcttcccagttcgccggcccagactcatcttacaaagaaaatactccgaatcaattggcaagtgcttacaagtcattagcttcttgctgagttaattagaagtcattaacttcaagggttaggacacacagaatacccttgcctggggtttctgaaccgaatttaaagttgtacatggaagacaatatctaaatatccttagtttaagaaatatgtttaagaaatagtaagagtttaagcccccaaaagccccagtgatgttccctctaaaaataagtaaacatgtaaaactaaaaactcacatttgaaaactgtgacctcccaaggagttggactgtagccaaaaagcacattggatccattcctgtatccaaggtagtttttccattggccaccaggtactaaagttccaactcccctgccctagaaatgtcgtggctggcggagcctgggggcattgtcagcctcacatgcaggaggcatggacatgttcaccgcatgcacacacaccttcacaatcagtgcacttacaaacacacatgcacacctaatttctattacttgataatgtgagaataagagccagagtatacctaaaaaggaaaagtcaagctttagaaagtaaccacctaagtaaattccaagtacttgagtctgtacttagtatttgataacttaaatactcatttgtaccacaggcaagctaattttgttagatactcactgggaggtagttctgtaatagtattattgtttgtatgctgagaaatttattcattcaaagagacagtctgtatgcaaatctgacaaagagatttgaaattgtaatgatttcagacatagaaatgttgtaagtatttccaattctgcttcagaacttacctatttagatctttgcatcttgctctcaatcagtgtgtgtgtatctctctcaaaaaatgtatgcaatgaaccaatgctatattctttgattaaaaatagagacatggtaggtttttgatttaaatgataggctggggaatttgacaaccctgctttttatattgagaaattcagttaattcttctaagtcctaatttcttcttgtaaaagatgagaataataaaacatagatgatagtgaaatgaattaatatgtaaaagcacctaaaatagtgcctcgcacataacaaacatcaataaatattaatatcaacgatgtcaattgttgtttgtagagctaacctattctgtcttcatacggatatttttgtactgagccatggttaagaattctaaaacagatttgatttatcccaaatatgaatatgtaggaagatgaagctaggcaatgtagatatttcctgtgactataatctatatagaggtaaaagcttgcattttaacttcaccttattgataatgacttacattatttcctctgtctcccatttattccgtcacattctttgtgatcactgacaatttccacacttgattgggtaccaccttattggaatctatacttgacattgtccttaagctaatgtgtgaacttaaatgagctttagcaaagctttcttcagtatcaatagcaaaaacaacctcacctgccataaaataagcagtttcgggtgtctcgtgaacgtatgtatgtatggccagacacggtggctcacacctgtaatctcagcactttgggaggctgaggcaagaggacaccttaaggccaggagtttgagtccagcctgggcaacataggaagactctgtctctacaaaaaaaaaaaaattaaaaaattaaaaaacacatttttaatgacataaatacttaaatgacagcatttaaaagcaatgctgtcaaacacaccaaatacctaggaataaattaaatgatagatatgaagagtttgtatgctaaatattatgtaacactgaaaaatttaaaaatgattctgaacatcacattcctagattgaagatgataaagatggcaattctgatgagattgattgtattcactgaatgtaatctcagtcaaaatcatgggagaatttgcagaaattgaaaaaatgattccaaaatttacatgggagtacaaaagactacacataaccaagataatgttagttttaaaaactacttaaaatgattatttaaaagttaaaaaattgttcattaaaaattttaattgcaaatattataaaaattgattaaacatgcaattaaaaattttaagttaaaattgtataaattttccaaaccttcatgaatttttactcatatataagcactatgaagtttaagatgtagagttttttcagaggtcaggatggctccctcatgctgccatctcccagtcaaaatcccccttccaatgcctgctcttccaatgcctatcaccatagcatactttcatttgctgttggacttcatatgaatggaatcacgtagaatttactcttttgggtctggatacatttactcaacatggtgtttgagatgtattcatgttgttgtatatagcagttgtattgttgcattgtatatagcagtatatgttgttgtatatagcagttacattgctttatattgtatgtgtgccattccattgtagagtttattacatttaatatatgtactgtactgttaataaacattgtaattgtctccaatacatacctaggagcagaattgctaggtgatagagtaagcatatgttaacatttttcagaatgtgtcagtttttgaagtggttgtaccgatctactgtcccactagaaatatgtaaaattcaccccaaatgcttgccagtacttgttaactggtctttataactgtagccatatcatgggtgtataatggcgtattgttatgatgtgaatttgcttttctctgataactaatgctgttgagcacttttgcatatgcttattgaccattggaatatactcttttgtaaagttcctgttcaagacttttgctcataaaaaaaaattctcattgatttgaagaagttcttttctattctggggaaaagcgctttgtcagatttatatgttgcaaatatcttctcccagtatatggcttatctttgtcactttcttaccagttctgctttgataaacataagttctaaattttactttattttatttatttatttttagacaaggtctgcctctgtcacctaggctggagtgcagttgcacaacctcggctcactgcagcctccgcctcccgggttccagcaattctctcgcctcagcgtcccaagtagctggaattacaggcacctgctaccacgcccggctaatttttatattttttagtagaaacgcagtttcaccatgttgatcaggctggacttgaactgacctcaagtgatctacccacctcggcctcacaaagtgatgagattacaggcatgagccactgcaccgggccaggagttctaaattttaataaagtttatttcatcagtcttttatttttgtggtcaggactttttatgtcctgcacagtcctaagtttataaaaatattgtactatattttcttccagaaactttactgtattttcttgcatattaaggtctatgattcatgtcaaattaatttttgtgtatggtgagcgttagagttctttttttccaataagatattaatgcaacaggatctattaaaaagaatcatgtttgcttccccaactgcatttcactcatgcgtttattgtaaatcaggcagtgatttatgtgagcatctgtttctaaataccttccaatagtgtatttgtctatccttgtaccaataccacaccattttaaacttacagcacttttatagtaagtcttcacatttactaatctgtgtgctattcaattttatttcagtatttcattgggtattgtatttctacatacatatcagaatcatattatacatttctttttaaaaagcctgctgagattttaattagaattgcgctgaatatgtagaacactgacattttatcaatattgactcctctagtctctccttttatttaggtcgtccttatgctgcagatttctagaggtactgtatacttttcatttgattattctcaatatttttattgtttaaattattgcaaatgatagtatattaatttattttcttttcatcaattgctagtgtctagaaatataattgattttttaatattgactttgtatccaggaacttgttgttatagtcacttaatcattgtaacagattctttgtaattcttctggcttctctccattcacaatcctgtcataactgaaatttacctccttttcaaacttcgtaactttcattccttttcgttgcttaagtgaactgcataacttaagctctgctacaatgctgactggctgtggtgttagtggacatcttagtcttatttccaaactcatggagaaagcattcaggttttctacaatacatatgatgttatcaatagtttgtttttgtcaatgcccaggctggtctcaaacttccgggctcaagcgaccctcttgtctcagcttcctaaggtgctgggattacaggcatgagccaccacacccggcctgtaagtaaagtttcattggagcacggccatactcattcatgtatgtatcatctatggctgcttttgagttattatggcagattgaggagttgcttatagagaccctgtagtccatcaaggcaaaaatatttacaatctggacttttagaaaaatagttggatgactcttgatttatcacatgtccaaggtgagaggcataaggctgcttattagagcactgtttcatagtaaaaaaaaaaaaaaagcaagaacagttttaaattctcattaataagggagtagacaactggactgtggaatattcaatcacagagaaattctgtacagcagttaaagtgactgagccatgtttcaacactgacaaatttcaaaagaatgactaaaagaaaattccattgatataaaataactataaaacactttaagtaaacttttaaacacacaaataatacagtatgtatttttctgagacatgtatccatttcactgcctttagtctccacgtgtagtatgtatttcatgtttacaaataccatgcccccactgaattgcacgtctgtgggagggctcagtatcacctaaagtggacccctcccaaattgtgattcaggaagaagcagtgcagtgtagtgattcaatgcataaccctagagatgagctgcctccattagaaaattggctctgccactttgtagtcctgtgactttaggcaatttactcttgggcctcagtttcctaatctgagaatagaaaccaaggcttctctctctaaactcagataacattagaatggaaggactggacaaaggtcatctagttgatttgcatggatatttcctgggggcctaaggattccttgaaaaacctcagatgttctttatgtctgcagattaagagacacaagaggtatcctaaggggcatacgtgtacatgtgtgtacgattccgcctctacgccaggagaagtaatgctactgaacactttatatatttgacttccacacactcatttatttgaatgttttaggaaatctctttctgacttggctgtctcttttctctcttgtctgtcatcattctaccaatgccctgtgttcctccaaactacatggtttaatgagctttttcttctatcaaagtacagtatgcatgtagaaaatatacacaccatgaggtagggctagaaggattttcacaagctaaacacccccatgtaatcttcatttgagtaaagaatagtataaccttagaagtttccttcatgctccttcccagtctctgatcttctcccaaaataattgttatcctgacttctaacatcattgattacttttgccttttcaaattcttacagacatttaatatgaataaattgtttatctgctttatcgtatctgtcacgttctgctcaatattatgtttatgagactcatcagtgttatagtgcgtggcattattttattcattttcactactgtatggtactcctttttatgactgtcaatttatgtatctattatgctatttaagtacatttttattgtttacattgttggctattacaaacaatgctcatgtaaacattcttgtatatggcctttaataaacacaggtataaacttttgttaggaatatattagaaatggaattgatgagttcttgatgttttgctaatgtcaattttaataaattctactacactcttcctcaaggtgttgttaccaacttaccctcctaccaaaaaatggatgagagttccaattactacataaccttgcccacatttggtattgtggttctttttaacttttgcccttctgttagatatttagtggtattctatcctcaatgtgggcaactccctccaaagaaacaaaaaggaacacccctcacccacaattttcacactgtagcttgccttttcattcccttaccggtcttagcttgctaaacagaggtttgtaattttaatgaagtttaattttaaaatgatttttcttatatttagtgcttttcaagttctgtttaagaagtctttgcctacaccaggataattaagatattttcttatgttaacttctagaagctttatcattctataatttacatttagatctatgattcatctgaaattgactttttgcataatatgaggtaggtgtagagattttttttcaaaatatatatttccaatagccctgtgccagtttttgaaaggagtgtccttttccctgtgatttgcagtaccatcttttccttcaatatagccatctacgtgtgtctattcttgactctcttctattctatttgtgcatttttcttccttacaccacaccagatggtctttattgctataactttatcataaatcttgaaatccagagttgagttcctcagctttgaattttctccttaaagaatgcgcggctgacttactgttcactatccctcctgctgacaataggaggaaaatcttgacaaaatagcaagaaaataactctttgaatataatggacagcaaccaacacagagagtactaaagaaaaaaaatcacagaataaccttggtttatttcctcaaagcatttctcaattccctgcatggggaaatagccccagtagacattaagagctattccaagctgtggaagcaaaggtaggtggccaaaattattgaaatctgaggggcaaaaacagaggaaaactcagaagtgagcctccaaatatgcatataaatattctttatatcttttgtatttacccacttatttatggtattagtccattctcacactgctataaagaaatacccaagactgggcaatttataaaaaaagaggtttaatttactcacagttccacatggctggggaggcctcaggaaacttagaattgtgatggaatgtgcctcttcacagggcagcaggagaaagaagtgcctagagaaggaggaagagcttgttataaaaccatcggatcccatgtgaactcactcacgatcacaagaacatcttgggggaaattctcttgaattgtaatccccataattcccacgtgtcaattacctccatctggtctctccttgacacgtgggaattatggggattacaattcaagatgagatttgtgtggggacacaaagcctaaccatatcatttatcattgcaggtatttgtcattacctctaaatttttgtttgatatgatttcccttcattctaaaaaattctttttatatttctcttagtgctggtatactggcaatggattctctcagattttgtttatctgaaactcattttattcacatttcaaacaatatttttacttaaaaaaatactattcttatggaaaatagaaattctgagtggtagttcttttcttaaacactttagaaatgccattccattgtcctctggacatcactgttttttattagaagtcatcactcattcaaaccattgttcccctgtctatatcttgatttctggctgcttttaagatattttgcttatctttgaatttcagtaatttgcttatgctgtgcctagatatggctacctttacgtttatctggctctgggtttgctgcaatttttggatctgggttgataattggatcatctttttcaattagtttttggatcattggtgctggcacagcaaatgttatgtatgttagagtgcttgatgtccttcaggtgactgcagtttttgtttgtttgttttttttttttggggtatcagattctcttcttcagattgggaaatttttaatattttatctttaattttcattgtcctttcttatataatctccattctgctataaagttctggtggatttttattttagatggtgtccttaaaagaactgtgttcatgcttggctttaatagatactaccaaatgctttcctaaagggtttacatcaatttatactctcctttatcaatttgcactctcaccagaaatgtgtgacagttacatatgtttcacatccttgctaacacttggtattgtcagtcttttcatttaggcaattctgatgcatgtgtgtagcagcagcacattgtaactaatgatatttatatacatattcagatttatgttcacattcattctgtatcaatttctacatatttttgtcattttagaatctagcctaagtataaattgttagaaaaccatcaaaagacatttgatattcatgcaaactaaagttgtaaataaggtggtaaatagggagcagtattaaacataagtgtatgttgttctataagtaagcaatagtccatttctaagggtaggagttgttttgtagaacagcaggaaaaaacaaaagtcagaaactgctccaacttatgacatgcaataaatgaaacaatctcagcagtagactcagaaggtacagtggaaagaatgagacataagaaggcacaatggaaaaaaatggtcttatcaagttctagacattcatttgatattttataatatatttaattactatgctaagatttctcatctgtttacttgttgacttttcttttactttcttgaacattcttatagctgttttaaaatcactgtctgctaattccaatatctaggttatattaaaatctgtttctactacttatttgtgtcttctgatcatgggtgatatggtttggaggtttgtcccctccaagtctcatgttgaaatatgattcccaatgttggaggtgggacctagtgggaggggttgggtgatggaggtggatcatgaatggctctgtgccttccctgcagtaatgagtgagttattactctattacttcaccctagagctggtcgtttaaaggagcctggtgccccctcctacctctctcttgctccctctcttgccttgtggtgtgtttgctccccattcaccttcctccatgattggaagcttcctgagatccttactgaaagcaaatgctggtgccatgctttttgtatatcttgcagaactgtgagccgaacaaacctcttttctttataaattagccagcctcaggtgttcctttatagtgatgcaaaatggactaagaccatggcataattttctgctttttagattatctaattattgttgattttgtacattacacatttttgatgacattgtaaagagtctggctactattgtcttctttaaagagtattaaaatttctctcttaggcagttaattactggtagatcctcttagtactgttgggctcagcttaattatttcttaaagcttgtcctcttttgtcctaaatcacagcctaagcatacagccttactctgggctgtatgtagccctttctcttaaactgtggcgtttctgaggtcttaattgaatggccaagggtctcagtgaggtttctcccctctgactggataggacttcttatctcccagcactgtggtgtcctcattcaaatcttgatcccatacagcactctttgctggcctcacagagatttacctgtgattaataacctagttctcagacaagaacctatgtaaaacctcactcggacgtctaagactcctttgtgtccaactgcctcctctatggagtcctgataagctccagtcattcctgtatctctgaactccagtttgtgcttactccgctcagcaaaaccactgtgctctgtttgtcctccgtgcactgtggtttagaaggtatctactcactaaaagcttgggtaagcactgggcttttatgtttccctttactcaacaaaaaatcttacactgcctgttgtccagtgcttgaaagagttgcttcatttttttcccccagctttacaaattgtttacagtggagggacaaatacagtactagttactgagtcatgaccagaatttgaaattccctgtttggataaccagtttatacaagcctgaatagagttggagtgtactttctccatttccattttctggaataatttttaaaatgtaaaaattgtttattattttaggaataatataaatcttttggtaaaattacatagattcagtaatttttaggtagattttgattatttatttgattaaatcattatatttcatgattattggcctattaagatttctatttccttataagtcattttcagtaaattataaggaaattatagatttcatctgaggctacaaatttattgacatgtgagcacattttaaatacattaaacctgttacaaatcaatataaaccaattatataaatggtaaagaatatggacaggcagttcagagataaatgactattgaaaatgttttaaaattttatctactttcataaaacaaaataaagataccttttttattgaccagattgtaaaaaaagttatataagctactaggtaagtaaacatgtggttaaccaggcattcatactctattggtaagagacaatattgccctagaatctgtcaagagaattttggtaagaattttcaaaatctgaaatattcacactctttgacttagcaattccacttgtagaaattgattctgtaatagacatatatataaggatatttattgaattgttatttaaataaaagagtctattcatacagataaaaacatgcaactactagaaaggtaataaatttataaatgatgatatatagaggtctcatatatatatataaatgaaaataaaataaaaatgaaacaaacaaaaacaacacacacacacacacacacacacacaccccccacacacacagtgcagagccatgagtatagtagtatctcactggaataaaaacgtactaaaacacacacacatatacctgaggaactggtatcagagagtacctctgaagaaggaattggggaactgagatcataggataattttttaaactgtatgcccttttgtactagtaagtttttttgacatgtgagtcagaacctatctactacattaagtgagcacttactgcgtagaggatttgaatgtgtggttaccaagagttactctaaacaaaagagctggacgagatttgacaggaaaggcaaaaaataaataaggaaagaattctgtcctctggccattcttaatgtaacagagaaaaataaggcataacaaattaagtaaaaagtcatttttgtttattgtgtatgtattactggaaaatagtaaaaaattgcatgatgtgttttagctatttagaatgatttattgaacaggagatgtaaagccaagattccaaattgacagataactattaaatcacttaaaaatcaaaaggataaaatgctccactaagcactgctgaaatacaacaatctgattcttgtctagaaacctgtatgagcacatgaaaaaattgccatagcattttgacaattgcataattgccctgctcagatcacttccacaaactctaatttctcttaattaaaatctaaattctttaaactaacttattatcttctcaaatctacatccaacttgtttttgtttctccctcttcctacctgtatgcttctaaaattttattatttacagtttttaaaacgttccactctcatttccaccactccactttctttcatgttattttgtgacatggattttttttgtcttgcactctgttaaaagctttctcaaattccttctgttaatacttgatttatactacttccactacaataaacaaaaacgactttatacttaattcgtgtatgtcttattttctctatattacattataaatagctggaggacagaattctttcttgatccatttttgccttccccatggaaaccagtccagtttcgcgtgctcagcagctctcagtaaccacacattcaaatcctctatatactaagtcctcacttcatctcagccattggttcatggaaaccgcgacctgaagcgaaacgaatgtaactaaaccaattttcccataggcttatataaagaagacttaaattcctagggcgtatttcttttccttttttcttaaatttaattttaagttccgggatacatgtgcagaacgtgcaggtttgttacgtaggtaaacatgtgccacggtggtttgctgcacctctcaacccatcgcctaggtattaagccccgcatgcattcgctatttatcccgattttctccctaccctcgtcctcccgacagacccagtgtgtgttcccttccctgcgttcctggggcatatgtctagtcacaaaacatcaccaacttatgcataaagactaaaacacttccagtattaaacattgaaatatgtgtgagctaaatgtactattaagatagagtcaaaaaacagagaattatttacgcaatttttggtgaatcggtaagtgatggcagtcgtagtggtggtgggtaaaatcaaagaataagtgtgtttgcaaagcattttaaaattccagttcagggtctagagtggccagagcctatccctatagctttggactcccagcaggcaccagcctggcctgaacaccctcccatcactggtgattcacatgcacactcacacactcacacccacattcacccacacacccacacccacactcacacactcacacttgctcacactcacccactcaaccacactcgctcacacttatccactcacactctcaccctcactcacccccacacactcacacccacacttgcccacactcatccacactcacactcacccacacttacctacacccacctcacactcacactcacactggggccatggaggatcaactcacaggtacagctttgggatgtgggaggaacccagaatgtatggagaaaacccacacagacgtggggagaacacacactccacacagacagggtccccaatgggaattcatttttttctcctcaattttagaacacagcgttgaatgaaatgttattcgaggacctgctatatataagattgacacttgggatagcagtgcttagtcatatatgaaggacaggaaggagcccattgtgcctgaaaagtaggaaataagccagacaatggaagatgtggttggaaaagtagcaacgcctggattacagggggcatgtcaccttggtaaagaatatggattcttatttacctgtatggtaatagtattggaaactattaatctgtccctgacaatctgctttgtgtttggttgttgtgtagagagaatgcactgaaggaggtgaagctgaaatgaaagcctggagaccaacatgaagttgatgcattaatacaaacaagagaacagtgacctggactaaacaagtagcagtaaagaagggagaagtggccgggcacggtggctcaagcctgtaatcccagcactttgggaggccgaggcaggcagattacctgaggtcgagagttcgagaccatcctggccaacatagtgaaaccacgtctctactaaaaatacaaaaattagccaggcatggtggtgcgtgcctgtaatcccagctacttgggaggctcaggcaggagaatcgcttgaacctaggaagcagaggttgcagtgagccgagatcgcaccattgcacagcctgggcaacaaaagcaaaactctgtctcaaaaaataaaaataaataaaaataaaagagaaagaagtgctccgattctggatatatttcagatgtagaatgcaaaggacttgctgatggattagaagtgggtggagagaaaaaggaggtgccaatgatgctcctagaatttgggtttgggcttctgggtggacagtggtgccatttactgagatggtgaaaagtcaggaagaaggtggccgtggcagatgagtggtcaagtcaagtttgaatttagaccaaatagaggtgccactgaaatatcaggagagaaggtaaggctaaggaatcataggctaaggaaacatctgggcattaaaagtcatagttatgggggagacagttaggcttagttatgcttaagaacagaagacaaaaaagagggcctgagactgagcttgccctgggagaggattatgttagaaaatgcaagcggagaaggtattttaaaagaaaaacagtacacgttccatccaatactggagggcagttgaaatcaggacagagaaaagatcactggatttggcaacatggaaatcaggtgatgatgatatgagtcctttcaatggggtagagagggcagaagctgacttgaatgggctaagaagggacatggagaggagagacagtagatagcagatacagacaagaattttgacacatttgcttttgaaaggaaacagagaaatgaggcagaggctagaccaggatttggtgtgaatagaatttttaaggtgggagactcacacacaatccagtattaaagggcttatttaatagaataggaggataatcaagaggggaaaacatacttcaatcatgcaattttgatggcttcagaaagagtggccctaccagcctgaaaatgtgtgaagaaaggcaatgaaagcctcatggtcatttgaccgaattttgccctcagaagtgtaaagtcattccctttgaatctattatagtgagacctctcagtgtttcaaattgttgtcaagctcctcaatttttaccaacaaacttgagatcaaggatctaatcttaggaaacacctacagacacagagggagttaaaggaggaatcacaaagagtaagactagctttaaggagaggagagggtcattaaattctgtctagggcagcgtacagatggcaggagaaatgctcttgactttgatctagaaaagatcacaggtttcagtaaatttggggaagatggaaaccaaattgcagaggaaagtgcatagtgagtaggaagaaaccatctgttcaaagaaatgttgtcaccatatgtaggagagagatggcatggcagaaggcaggggaagcaaagtcaatcaatcattgtcaccaaacaggcacacactggagtaaacaggtagacttgctggtatactgagaatattgctgctcaaggcacgtgttcataaaggcactttttacatcacatggagttagaaagccggttctaggagtaggtgaaaacatcctaacagcttttctcatcataaatcataataatttagaaagcaagaagacaagataaagataaattgggcataatgaaaatagaatttagctgtgaatcaggagttttgagttctactacaaaggaaggatttcctgtaggcttgagtttcttatctatagataggatacaagaatggttcagattaaaccactttgaaggtctaattgagatctaaaatgccatgattctaaaataattgcatttcaatttggaaagtgggtccaaagatagggaaaaaatctgaaggaatcagcagaagcaagcatggagatccacattgaatctcccaagccagaagaggaactgcaacccataggcattgtttgttgcctaaagatatgtgacatgtagataagtcagaacagagtaccttaattcttaatttatattgggtacagaatctgtgagtggaaccacatacactgtttttcctgtagtccctgtgattgccttatgattggtagcatgtgtggattagcataaagagatttattttttgagaacctggagacattatcagattatttaatacctccttgattgatgctgaaaccagataatggcaacctggtatttgtccctacccaaatcttactcaagtgcttttcaatataatctttgtaatcttagcaaagagttacaataaagatcaagctaacacctgacaactgttcaacatttgatttgttttttaaatacaaagcaaacattcagattgaattattgccttaatccacacggatcactttagtcctggataaactagatggaagtcagtaatactcaatactgtagctctaaaaagatgttgccaacccaatatttaataatatacctttcagactgccaaccatttttcatgcatgagctttgaaaaagcagtttccaacttgcggatcctttagtcatttcgtaaaggtcatgaggaagaatgtggcagacagagattaagtgtttgtcctggagtctctcattgatggaaaagcgaaattccctaggagctattttgactccaaggtaggtttctagcaactatagtggagctagctgcacgtagccccaagcaggccaattaattgtcaaaacccagaagggagtgtgcaaagggaactattagaaaggaaacccctcaattttcacatcctaatcacagcagtctgatctctagaaagacctctataaaagcagttttgtgtttctctagatcctttcaggcaaataaccctagggctctgatttctgcatcgacatttctttggccaccgtgaactgtgcagccctttgacaagcccaagtacagttgcactgtttttcataaaatcagctttcatttgtaaagcacaatgtaaatgtcagaaatgggaaatttttaggacaaaacaggtcacagtcttccaacttttcccacacagcagagattttccctaattgtgttcaagtgcctacctgaacaaaaaggaacacttcatttcactctgtgacagtggctgtggggttactatcatgctctgggaattaaagaaaagaaattagagcgctctgctcttttatcacctcctgagagttggcctcatggctagagtaaacttggccttgaaatggagttcaaataacttaaggaacagaggtatcatggtattaagcacctgtaggaaagcaacatatggcaaaatggtgcataggttggtgataagtattgtaggagtcatatatctcaagagaggatggcctgatttgatgactttcacatcattctctgggttcatcataaatatacaagccatgtttgtttatgagaaagtttgtttgttatgcagattggcactagttttatattttaaaaagttctctacaattattccaatcaagtttaaactttcagagagaccattgttaaggctagatttattccttctcttcctttttttgttgggacatagctcaacttagttctctttcagaacacaaatttataataatcaaattttaaaaggttttaatgtttttattatataattcatgatgaataatgattaaatttatggcaagagaaattggaaattgatcatgcatatgctgacatttttagtcaattgaatcatatacgttaggctgggtctgtccactatatatcataaaatactcacacatttatgacgggcaaggctttcaaaatttaccatatcccagaaaaccaagccaaaattgagcatatgtttttcttttaattatcacttaataataattctgggccttatttttaaagagcattggcaggataacttggcgtaggaatcgacatgctttgttgactggcaagttcttgctagcgtctttcctgcattgctgtgtttccttaaacaaatctatcagtatttgcagaattagatcaattggagctggaaacatcttcctggatgatggagcctttcctctgactcacaaccagttgctgtgtgcagcttctcctgtacactttggcctagttttaccacagtaagaaaaacgtatgtgactccactttcagtttccaacgctcatgtctgcccaggattccctaattaacagttgactatttttaactttttgcgttttgtgtcttaccatgtagttttcaaaattggttctggtaaagtcacatctggtacctttagttgccttttggtttctagactcactttctccactgtgaaatctgcatgtgctggtactgctggcagctcctccaacagacctgctgaaatagctgcagaatcctttaggacaggaaaggaagttgcccgaattattttctagagcaaagtaagttagaaaatgtgtaaacaggtaaagctttgtcacctataaggtgaaccaaagttgtggggttcatctctcctctgctgtccttcccttcctcacccagcctccttctcctcatattaatgtcacattgaaatctgtgctacttgcaggaacttgaacttctgtctcaagcatctttggacacattcttttctttcttcctgaagtggtcttccctctatagccttcaaattcatgtgttaatttacccttaaatttattttccttctctccttttttagccatatttcttttatttatgtttcttgctgtgtatatgcatagatacacacatatatgctgtatgtgtatatataatataagctacttcatttcctctttacaaggcaaatatgcaatatgaaaagataccacacaggatattaagcattggtgaactgctgccctgaagttatttatactccatttggagaaagtcttaaaaaattatctactaaaaattctgcagtacagatttagaagtgaagtatattcaggcccagaggtaacaaaaaagtgagaataatcatttctgcacatggacagggagaaatgtgttgctagaacactacaaaagtgatgctatttgcatcttgaatcttcaagaataagaaagaacatcagagaaaaatgggaccttgttatttagcttggttctgtattcaagtgcaatgacattgagcctttctttccttcattttttcctgctgcagaatgctagttatgtcttatcccctagatctacataggtgaatctgatcagattataataattgccacaaaaatatcatgtggatatatgctctggggttgtacaatactcttgctgaaacaatacagataaaaactggttaaaataaattatgagggttatttgatgaagaataggtattatataacgggtctttatgaaaaaaactgctcttatagtttctcctttgtgacaatatatgcagatttgaggatgatatttttaatgtgtaatgatcagtcctttgtcataccagttagtggccctacctccttctttgtaatcagctactattctaaaagactgcatgtcagtaaataatctgttaatgcaatagcctcaacttctcaaattctaaatatgatttggtaatcacatatcacataaagattttatgagagaattggaaaagaaaaatccgtcatggataatcggtgtggtcttttggctaacactttatactgtgcttgcggcttgtactttttcatattttgaattcattaattgtgcatttctttttcccctgttagattataagcaccccgtgggcagggactgctaggttcttgatatctacacaaggctcagtaagcattgagctgaatggagaggctggcccagctagaaagcatacagattatgctgatggtgccagctggatggaattgaactgaggaaattagcattgattctagaattagaaccacctcctctcagtctgccatgtagccaaatcttaaaccaagggttattttgattttttaaaaaatcgcattacttaagtttactaggtagaagattttctgaattggaaccatgtttttcatatttttcctgtgcaaataattctcagttgataatgtaattagacataacccagctaatttctttggtattcctaacatttaattagcatgttgttcttattcattaatactgtggtgatattttcagtgctattcttgagcattcaaggtggtatcaaagaaatgatttttcatgacatgaccaccatgctatttggaagaaggaatgtttgtgcttgaatacaccatgcctgcgagagtagactgcctctgtgtccagccatccccacaggggagacgcctcgcagtggcgagaatcctgatacagacctacagggaatgactggcattggctgctttcgattctgctgtgattgctgatgtcccctgcggttcaaaggataattcagtttcaccaagtgttctcttgttttggactccatggtggagccaccaattttgctatctcataggaaattatttttgtgaggcctcttttattggttatccagcctctctctgaagcccgttcaccctcagagcatctggaaggagacaggacaaatacagtttgagaaaaaagaggatatgatatagggagaattccttctacactggaaagaaaaaaaaatggaaaatctgccccttacactctggtggtgatgaggaagagaaacaagaaaggaaaagaaaattggaaaaagaaaagtggacagacatgtttatgtctcagtccactcttctgggatgaaacggagggagtgtgggaagatgttagatcctttgaagggaaggctgaagtcagagacatggaaagaacccagaagcagaaggtccctgagctgagggcaacaggtctggcacagaagcatcctcaggagagacccactgctgggtacagagccctggaggaggcaccctgaggatagggcggagactcggaggcatctacagcaccagatgccaaagacaggccacaatgcttcactgagtgcttcacggagtaaatagaacaaggaacaattcaccaggtactttggagcaaagacgagtgaagatgcaggtaaaactccttgacttaagctccttttccccctttgctcgtagggcattagatgtcctcttcattcacctggatgtcaccctgtggaggagctgagtgcgttgtgcatgtccacttaacgtttgcacgcatgtgtgcagatacgtgtgctatgtatatgctggtggagggtggcatgggctgtcatccaatagaaggggcttttacctggaacagttgaagttaatgaacaattactaattaaatactactgctgggcaccgtggctcatgcctgtaatcccaggactttgagaggcctaggcgggcagattacttgaggtcaggagtttgagaccagcctggccaacacggcaaaaccccatctctacaaaaatacaaaaattagctgggtgtgatggcggcatctgtaatcccagctactggggaggctgaggcagaagaatcgcttgaacccgggaggtggagtttgcagtgagccaagatcgcgccactggactccagcctgggtgacagagggagacttcatctcaataaataaataaataaataccagaagaatggcagatactgtgaatggttgtattagtcggagttctccagagaaacagaaccagtaggatacagagagagatgtgtaagaggggatttattatgggaattagttcatgcaattatggaggccaagaaatcccacagcatactgtcttcaagctggagatcaggaaagtgaaatttagtttgagtctaaaggctaaactcagacagccaggagcagccatgtctaagggcgggagagacagttgacccagatccagatgagagagtgaatttgctcttcctcctttttttcactctatccaggccctcaataaatgggctgatgcccagccatgttgatgaaagtggatctcctttactcagtctctcaaactgattgcttatgtcttccagaaacatcctcaaagacacacccagaaatactatttttccagttatctgggtatcctataaccgtatcatgttgacatttaaaattaaccatcacaatgtaccaggaaaggtagacctctgttctactctctagttggatgatgctggagggaatattaggacctgttgtagagtataaagaaagaacattttatttgcaaatatgcataattgtagttgacaccctgctacccataggttaaatacacaatttattctgggaaagaagagtaaaactatattaaaagttttaaatgtgctgctttctaatcatggaatacattatttttgccacttccattcaattatctgtcatggtattcatgttctctccatactagtcattataggatctcggccaagcacggtggctcacacctgtaatcctagcactttgggaggctgaggcgggcggatcacgaggtcaggagatgaagaccatcctggccaacatggtgaaaccccgtctctactgaaaatacaaaaattagctgggcgtggtggtggcgggcgcctgtaatcccagctacttgggaggctgaggcaggagaatcacttgaactcgggaggtggaggttgcagtgagctgagatctcgccacggcactccagcctggcgacacagcgagactccgtctcaaaaaaaaaaaaaacaacaacaaaaaaaaaaaaaaaaaagaagaagaagaaattgtctttataggttttctctaaatagccattaatgtctgaaaaggagatgaagagcttctctctgtgacaaagttttgttttacactggctgtgcttttgcagatccagcttctctcgccaaatttggtcctccttaaggatctattgcacgtggaagaagacaagttgaatccgacaaagttcttttgctcaagagtgatatgccctattaagggagataacagggacacaggtaaatctgtaagtcagcagtagaacagtgtgtgacaactgccatgtaagtggagcaaatggggcatatgcctcagacaagggaggctgagtcttactgcgtttatttttacttaacttatattgcaagcattacgtctgtatacagtggggaaagaaataaatgatgaaggaagacttgtaagtctttaggaacttagcgttctaacagtccctcacacctctaatcccagcacttcgggagcccgaggtgggtggattgcatgagtccaggagttcaagaccagcctgggcaacatggtgaaactccatctctacaaacaattaactgggcatggtggcgtgcacctgtggtcccagctacctgggaggctgaggtgggaggatcacctgagcccaggaggccaaggttgccatgaatgctaatgcatgccagcctgaatgacagagggagatcctgtctcaaaaaaataaaaggaattagtaaaaagaaaatattttggcttcacggtgatagctatagggaaactaggttttcccagtctttctagatagtatttgatcctatatgctccagaatccacgggctttgactttgactttcttttgtcttctttccattcctaccgacctactcacatagctccttagttatgtcagaccagcaatgtctctgggtcacctcttcggacaaaaccatattattgcttatgtttgaagcagcatcaaagtcaccagcttctctcaaagaagaaggtgacatgtgactatgatccctgatggctggatttttgatgccaggatccctgtagtcagaaacttcttatttttggaacactatatggctatttcaagtggaggctcagttctttctgggagttgtactacgcagcattttcttgtgtgagaaaggaagctaatccccttggggcggctgtggggctaataacctcgttgttataactaatctactttaaagtataattcttcaaagatgcgttttacaatttttaaagcatattattttcacagttgaagcactcagaggaaaggggtattcagggtattttgaagagattagacacgtattttttcacgacatttttcccccatgattttgtagcctctccctacagaaaggaataaaaagacgtttctctttgttccccctgttcctgctcttgtaattggacttggagttcttgcggaagggaaagagattgaagatgcaccaatgatttgctaatcaatagttatatatatatatatatatatatatatatatatatatatatatatttccattctaaatgtgcagtgctctgtaactgaacccacatcttggctcaatgcccagtggaaatttcaggaacaagggacagtgtgtctcagtccattgtttcaaataactctccttggcttctttagggggatgaaacaggcattcacattaggccagaaggttattagatctccacgagatgctgcccaggtctggctgcacaccgtgaatattattctgtcaacgcaaatgtccttagaatctgctagaattgaatgactcttagcagctttacagctgtcttacaacatttgacatctcccaaaaaacgcttcttggcaccaatgagaattagtcactgggctgatttatatctaaaaagtatggaaaatgaagtgggataacagtatcactgtttccatgtatcatgtttataaaataagtattgtgttttccccccgaaggctgggattgattttttacgccacccacagccatcccccaacttttatagcccgggcaactataaataagtttaggaaaattactcctctacggtttcacaaagcatttcttatctgactgccacagctgtcactgatccaaatgctcttatttgggatgtctacggctggaaatattattgcttatgttcttcaggggctaaagaacgttatcatattattttgtgaatttaattcatttctcctgtttgtgtcaggggtttttaatgtctagtgatttctcaaacataccaaaatagatgatcttcagcctcttctatgttgttcccttttctactgttaatgtttatttataaactaaatttctgattttaagggacgactttgagcttcataatttacttattatatttcaatattcctaatgtgaacccagaaactaattatcatcctgttcaatactattaatagtaataaattcttcaaggtagttattcgggctttcaaaatattaaactataaatatttctaccagttcttctttatgttcttctgtttgttttctttaaaattagatgtctttaaaatgtgcatagacaatgaaatattgcctagaacaaaacacaatggtatccacttgaaaacctgtaggatttaagacattgtatgcagttaattctgcatgccaatatttcctttactataattcagttttctccttagttgatactatttattccatctgagagcccttgttatttaaggtgtatattttgaaattgaataaaaaagaatatagtcaaatactatttagggtacaataattaatattttataatatgttattcaagatccagaaagatctacacaaatacaaatttcattaaatattatttctcatatatgtaatcaattctgtttttattttttgaagatgtgacttttggttttctagtatactttgatgacattctgaaataaataaaaatcatttttaacattatttttcccttgttacaagtcttaaaattaggtaaaattgaactcagacttgtcacagggatgaagaaagactatttgtaaagtctttggaagaaaaggcagaatttcatttgaagcaccccaaggtttctgcttcaaacaatttcccccaaattacttgcctgagaaatacatcagctattaagtaaatgtcaaatattggagaaaaagtcaaaattattttgcaaacaccgaaagtcatggtgaaaaatatgacagatcttataatgggcaggaatgtattttacatgcatttttcacaactctctaaagactgaaaaaaaaaaaaagcccacagagtcagatagaaagaaatagaaagcccagcaattaatttgaggatttgatcaaaatagacgtcaatgtacataccttcagccaaacttttcattttttccacaatagtactattctttaactaagttcttttctccctctgaattgtcagaataattttttcaactcaagcctttcccaactgcagattaaccgtggattatttccagtacctacctacctaaactttttctgagtatctcagtgtcatgttgtgattggtttaaaatgacttcttctttttctattcacatcaaaccggggaacaatatgatcaagcatctttcaaaatagaaaattgctggtattgctagagacaatcgtgttcatattgcaggatcatgttaatattgcaggaagtctttggatgagttctgaaaagtcaggaaggaatcacaagaataggtgctgcaaagggagcatcaccaaatgaaacttttctttctttggatcaagaggccttggtttaaaattagctagtgattacagaagtaatcaagtcaaataaaaggttgagacaataaaattcaattagatttcatactaaaggtaatgggaagctactggaaggtctatactaaaacaatggaaagagaatttaaggagatggtttttacaagacaaattagaaaggatgataccaagggtagaaatagactgaaagtactgccatgatccaggcatggagtgcttggtgctcaggctgtggcaatagctgtgtaaaagcagaggaagagatgaatctcagagacatttaaaaaggaaatacctatagaagctggagatgaagtttttttttcttctctttacctaggaactgagacgcctgggaaatggtatcattgacagccaaggatggttaagcattttttgatgttccaactttgtatttatgcaacaaataattggaaagtatctgtgtgccagggtctaggtgagggcaataggagtaattaaaaacaatgaatgtggcattgttcgtgccgtgaaggagctcagtatgtgtgggacttacaagcctatgaaaatagaaatattcgcatccaagtgcctctagaacacagtactctgtttattcttaaaaatatatatcctaaggtttaataaggcagaagaattttaaaattatctcggttgttttgctttaatagtaatcattgtttcaagaactaaaagttgcaatgaaattcctaaaaagagatatgaatataaaatcaaaaacttaaaaccctgtaatgttaaattaagttgaaagtactgtcatccaaaagaccatcaggatggtgaaataatagaaaagagagttttatcggtgatgtcagcttcaaactgtctcaagagagagaatctgcagcatggacccaggctgctctctttgaagagggaaagggcaggttgggttttatgcctcacagggcctgtaccacacaatagagtcagagatattcggcaggtttggggataagttatacatgtcgatgagggcagctggaaaggcaaaaacatgcacgaagggtaagtagatatgtaacatacatcccatgttcactttggggctgggttttagcatgaaaatgagatggaatttggctctttatgttaaaaagatgcatgacaggacaggaagacaatttgcacacagtctctacaagctggctgaaactgccttaagatctgcagttgtttatcagaaaagaatgtgtgtaacgccggacctctgtctaatcagtgttgtagccatctgggttataaatcggagttaggaatttgcctgatgtctcctgttgttaaggagtaagagggtggtttatagctgtaggaatttaggaagttgccaggccagccaagccctgaaccctcgacccataggtaacttttgttttcttaaacttagggcccgtcttagttgatagatgtctattttgatctctcaaattgcaataccaaattataattttgaaagttaaattttctagccctccatattgaaaaagcccaaaaacaacaataatgcttcgtgtaggaatcagcacttctcacacacatgtttcgtttgtttggttttatgttgttattgttttcttttacagacagggcctcactctgtctctcagggtgaagtgcagtggtatcatcatggctcactgcagcctggaactcctgggctcaagtgacctgcccatctcagcctccaaagtggctgggactacagctgcatgcccccacatctggctaatttttaataaatttttgtgaagactgggtttcactgtgttgcccagactggtctcaaactcctggccttaagtgatcctcccaaagcactggaattaaaggcgggaaccactgtgcccagcctcgtattttgtttttaaattatcattccacactgaaggaagcagggcccattagggagtaggtgattcttgatggagaaatagggagacagagatgggggtggggccagctgagtcttatacatcatgagtgtcttaaataccacgagaaaggaaagtctaggactcccgagattatgtaaaaaggacacagtggcagcctgacaggtcttcctgtagttcaaactaattccagcatcaacaacaacaataacaaaatagctataactcattgaaattcattacatacatacacatcattggtcaatggtaatgctaaaaaaagataatgtaatcaaacagataaataatataccaattctttatatgctttcttggtatattctttctgtactttgaaagttggtaattaaaagatgagaacaaaatattcattctgctttttaaataagaattttagtttcaaggttaaaaaaaggtgatcctaattgataaagaaagcttttatttgcagaagaatgccagttaaaaatgtaacaggaatagaattggataatcattttgctaatcataatgaaacaacttaaggaagaaacttagtggtgctaacatctttcataaaatgttgggaaacggaatattcacacaatgctgattatctctccacagactacttcatattttcagaggaggaaacatgtatttatagtggaaaggtctgactgtaacaaaattaatccagtattaccactaactaataggactccttagacattctgttaatgaaatgcaaccggaaacaccaattttctccatgaactattatattatgaaaatacaaccagacaaatacaggaaatagaacatcacacaatatctggctgatgtctttaaaaattaatagctcagggagaaaaaggatgtaaaaactatacttgacttaaaaagacaagtgacataacaaaaaaatgtattaaatgctttttgatcgaatcctgcttagaaaacaagagttaaaacagacattgaggaaacttgaatttgggccacgtatctggtattagggaattcctgctgattttgtggggtgggtacaataaagccatggcgatctcatgggagagcacttctgttcatactgaagaattcaggagaaagtgtcaggacatctggaagtaacttcaaatgatttagcaaacagataggaatagcaatataaatatggatattcatatagagtatagatctacaatatataccctactcatatagcgtacagatctacataagctaaatatcaataattgttgactctggatagtgagtatataggtttttttgtagtatattttttgttttcctgtttgttttaaaattactataataaaatttttttaaagaatgcatatgttcataatgccccagaaggtacttgggtaacaataaaaaagatacactggccccatggtctcaaggcctttgccctagagatgcaaataatctacttctgggaatgaaggtcaaagagataaaaatttaacttgggataattagtggttctaagggaaactccattattgcaaacactataataaatacctgtgaaatgaagagtatgcgactgttccaacatatatttttagggtttagagtgcttagatcctagaggatactcaactctggagattctctgggtgtgatttaagagtgggatggcccagattggacctatgatcctttccttgagctttcctggggccaggctgcccctgttgaagtcttccaggccagggaaggctgggatcctacctcccgatgcagatattgcaaggccaaagtaaaagcaccaattctcttgaaatttacttctgcttccaggacagcaggggagaacttccaaaggtctcagagactgggtcacactgtgccccacatcacagctccctggcatgtcaggtcatcctaataaatgcaatcagctcagtaacacctgggcactctgtaaataccctctcactgggaaattacatgagaaaaaacatcttgtccttaaacttccacctcgagtccaagttctgtaaatcagtcgtgcattcaacagcctctttttagccattccagtcttatgactgactctctgcttcctacttctttgaatatgaatttcagtgagaatcaattattttacaggaaaaatatttttcactaggcaggaaattcttttcatcttactaaagctggcacataatagtttagacatttccattctctaaagcagaaaacatctagtgcatggccattaccccaaccactaaagcataatgctcttgaggtagaatgtgctagtatttaggaaactcattaagtcagaaagtactcactgagcccctatagcctggaaagtacagcactgatcacttaaggaaatcatcaatatcagactaactccaggtccttagggagttgcaaatatttatgagagagaaggtaatcagcctaagatcagtcttccttgaatgtagccataaaatatttattttgctcatatagattttatgctttgtttctttaaaagctaaattctgaaagttaaaacaatgctgtttctgataatgctatggttgtactttctgatatcttttatttttagatactatgaatgaaatcttaccaagtgtcatatttagttactaaacaaactatgaataaaccatcagcatttccagcatgtggatgttagcattaaagagtaaattctgattcttttaggtcaaagctgttgaattgaggccatagtttcagaaaatggatcacgtagtctttatgtgtttcatttcaaattatgtctctatcaacctttactagatcatgtatattgaagcttccatacaatctccatttagtatccgctgtggtacaaatgtctgtgtcccccggtacttggccattttcacacagctataaagaactacctgaaactgggtaatttataaagaaaagaggttaattgactcacagtccgcatggctggggagacctcaggaaacttacaatcatggcagaaggcaaagaggaagcaagacacatcttacatggcagcaggagagagagagaaagcaaagtggtaagtgccacacacttttaagcaatcagatctcgtgagaactcactcactgtcatgagaacagcaagggggagactgcccccatgattcaatcacgcctctcccccaagacatggggattaaaattccagatgagatttgggtgtagacacagagtggaaccatattaccccctcaatttcatatactgtaatcctaactcctaggtggtggtattcgttgggagggctgtctagggggtaattaggtcatgagcacagacctgtcatgagtgggattagtgtccttataaatgaagccctggaaaagctctcttgcctcttccttctgccatgtgaagttagagtgagatggctgtctatttcatgctgggatcttaatcttgatcttccctgccttcagaactgtgagaaataaattcccactatttataagccatccagtctatggtattttgtggtagtagcccaaaggtggtacccatgtgatacttcataaataaaaagttgattatgccactcccctgttaaaatgctgttattgatttgtactgagaacaggattaaaaaaaaaacaacctcttcaatgtggcctctttaacgtggtttaccactgtggctgcaccgaaatcacacttgttcttacccctcactccagctacccaggttctctttagcaaagacaggctacagggtcttggcaggtcgtgttcgatccactgggaaggaaaaactcttttttccccagttagtgcctgcttatttattagctctcagctgagtaattcctttctcccttactcccttgccctgtgtgtgggcattgctctctcctcgaaggcctgcagtcatctccctgtgcctcatgcaaaaccaacctgcagcagtggccctggtgatggttcacagaagctcagtttgcgctagctggaaagtgacctcaggtggttcctataagcttggaagcagcgatacctctggggcttcaaggaagtgcctatcatcagagacatatttcccccaagtctgcctcttttatattttatgtcatttcccattttaacgcattcatattcctctgtatctctttcaggttaaattccagattccatatctgacccaatctattaggttggtgcaaaagattttgtcattaaaagtaatggcaaaaaccaagattacttttgcatcaacctaatacaaccttctgcaatatgtaatcaatctctcaactaatcaagttataagattaagctcagtgattttgagggagcctgctggaaatcctctaaagatgtttcaaatattatttttgtggctagttttgtattgttggtaataaaagtttttgagagactttccatttctaaacacaaatcaaatatctctaattcttctaggaaagagaccataaaatctcttgattataataaaattttgctctctcaatttctaatgagaaccatggtagtgaaaataattttgacatatagaaattgttttgatgttttaataactagttatctgtatagtgtctggcttccagaatttctttataaataattctgatgttgattagccatgtggttgctaaccttgttccaagtgcatcacaaattcaaattttacaaaaaattaggaggaattatgtgatccacatgaatcactgatgccccggggaaagttttcgatggaaacctcacaatgtgggagatttggagaagaaactgactacataaggtatctgcttttgaaaggaatagttctattttgggaaaatttttcatgccatagagaggatgttccataactcactgcagagacagaaaatcatgagagttcctttgtgtttctatcataagacagaagaatgtgtaccatccgcaacataaaccctaagtcctacactgggataacttccctgaagtcttggaacagcggttcataataattatagctgagcgaggggcaccctctgcttgaggcggagaaactaatactgaccttacagaccaggttctcttgttttgtgttgttgaaaggctttttgctaccatcattctccaccatgatgagaaattttagatctagttcataaatgcaattaatgatagaaatgagaacttattgttagattcagaatttctaaagtacctagtgagaacctagtaagaaacacaatcattcttgactgtgcatacagttaagatcgtctaatagtggagagaaacaaagatggaagggaaggagggagagagaagaggggaggggtagaggaggagggagagaaagggagtggagagagagagagagggagacaggagagaaattccttttgatccctgaatattatagaactaatgatattattaaaatttaattttaaatctgcgtgtgctttttttataagatgaaaggaaaattttgattaagtttcttaaagaagaattcaatgaaaatatataagatgaatgctctggactaattaaataaaataaatatatatgcaacagcacacacttctcaagggtcctaaaaggtattctgttacttaaaagcaaaatattcagtgatctgcatgtatttacagagtgaatagcttctttactgtggaagaatgtttgatttttttacattataagattttagaaattacaataacattttatacttctatgaatgttgacagtattttgttataatttcattaattattaaaaaaatcaactgactcataaattatgattcctaaataatagcagaacctatttttttcctactgggcatttacatttacttagtttcattcttgtaagttgactgttaatctccttctttgttctcttccaatttgtcattaaatattgggatcttcctttagggcatacaatcataaataagaggaaattctccctgaaatcaaaggaagcctgctggaagatgttcatttgtctgttgctggttctgacagattccttatacttgatgcttgtttacacatcggggttccccatgttaatacgtctgaaaagctcttttgatacaatcaattctgctgttatagaaatgaactgatcaaaagtatcttttaaaagacatcagtcatctggcatattatttcccttatggtttttcccattatgatttttaaatattctgagaaataaaaattgctttactatatgcatgctaccacatatttctatgtcactcttcattgagtgtgttaggtcctatattaagcattttgcattaagttctatttaattcttacgagaaccaagtatactgtgtattaacaggtcaatattacaaataaagaaacaaagtctcacaggtgcatttcagttacctgcatggccacaaaaccaggagtagtaatggagtcagcatttattctacattggtctgacttcagcaactgcattcttccaaataaagcagttaataataaaataatacaaataactggtaaaatatacttaaataattatctccatctatttaaataaaataatttacataaagtgcttggtacggtgtctaatataatcatataattaaaacaaaaagtggtcacaacttctatttgaacagttacaaaaactgggttttacagttgtatttaccagaaaaggtcaattgctataacaacacatccacaatctcaattatttaacaaaataaaggtttgattcttgcagccgttagagtccaatggctatcaacaaggtcagaatgaaggggggaggcttgccaagcagttactcagggacttaggttccttccacagagaggacctgaaatccttgaaaccctccactgaaagattctatcttttcccagcagatatggaatcacaggacatcttgcgagacattgtaggggtcaggcctgaaagtagtatatatcactcccactcatatcacattggatggaattcagttgtatggcctgccctagctgaaagcaaagctcagataccttgtgtaaacatagagctttgtgtctgccccagtaagcaaaatacatcatcctccaaatgagtggcgattggagttttggcagtgtagttgaaaccttagtgaatagaaattatgttagagataaaaaaaaaattcccccctttgagaagaaacttagtttcagcacccaaattacaaaatgaactaccaaagattatgcatttattttagcattataaatgtgtgttactagtttgatctcctttgcaatgccagggtaagctgagtgttttaattacaatggtaatttttgtagcacattttaataaaactgtagcgtttcataaatttcccaattatgacatcattctaaagcactatttaattcacacttaattaaattggaggattatgaaattcgagctcatttttaagaataaaaaactaattttcttaaaattatagacagtgacattcttgaaaggaagaaaaagactaatgatactatctcatatccaaatatactagaagcagcagttgaagaattgtcttcctggagcttggccaatgtatatgattcgtaagatacattaccacaccctgtttacaatccttggcctggattcaactggagactgccgattccttctgaaacagccagagacttgtggcaaccttattacaaatggcctcttttttttttcccacagaaacattttatcccctttttcccagtactatgactctgggaagagctttgtttcaagatggtggctgtttgaccattctaatgactaagctctcagaaaggagttctagaagggaatgtataactttactaccactgacatttttaactcaaatcacaaatttcattcatctaggcatttattctttcactccagagtatttttgtcttatcttctgtattagtccatttcacactcctgataaagacataaccaagactgagaggaaaaagaggtttaattggacttacagttccacatggctggggaggcctcagaatcatggcgggaggtgaaaggtatttcttacatggtggcggcaagagaaaatgaggaaaaagcaaaagcagaatcccctggtaaacccatcagatctcatgagacttattcactttcataagaatagcatgtgaaagacaggcctccatgatttaattacctcccactgagtcccttccacaacacatgggaattctgggagatacaattcaagttgagatttgggtggggtcacagccaaactatgtcattccacccctggcccctccaaatctcatgtcctcacatttcaaaaccaatcatgccttcccaacagtcccccaaagtcttaactcatttcagcattaacccaaaaggccacagtccaaagtctcatctgagacaaggcaagtcccttccgcctatgagcctgtaaaatcaaaagcaagctagttatttcctatgtacaatggcggtacaggtattgggtaaatacagccattccaaatgggagaaattggtcaaaacaaaggagttacaaggcacatgcaagtccaaaatccagcagggcagtcaaatttcaaagccctaaatggttctcctttgactacaggtctcccatccaggtcatgctgatgcaatgggtaggttcccatggccttgagctgctccgcccctgtggtttcacagggtacagctgccctctggctgctttcatgggctggtgttgagtacctgtggtttttccaggtgcacagtgcaagctgtcagtggatctaccattctggggtctggaggacggtggccctcttctcacagctccagtaggcagtgccccagcaggaactctgtgtgggggctccagccccacatttcccttatccactgtcctagcagaggttctccatgagggccccacccccacagcaaacttctgcctgggcatccaggagtttccatacatcttctgaaatctaggcggaggttcccaaaactcaattcctgacttctctgcaccctcaggctcaacaccaggtggaagctgccaagtcttggggctttcaccctctgaagccacagtctaagctgtatgttggcccctttcagccacggctggatcggctgggacacagggcaccaagtccctaggctgcacacagtatggggaacttgggcctggcccatgaaaccactttttcctcctgggcctccaggcctgtaatgggaggtgctgccatgaaggtctctgacttggcctggagacattttccccatggtcttggggattaacactaggctccttgttacttatgcagatttctggaactggcttgaatttctgcccagaaaatgggttttacttttctatcatatagtcaggcttcaaattttccaaacttttatactctacttcccttctaaaactgaatgcctttaacagcacccaagtcacctcttgaatgttttgctgcttagaaatttcatccaccagatatcctaaattatttctctcaagttcaaagtcctacaaatctccagggcaggggcaaaatgatgccagtctctttgctaaaacatagcaagagtcgcctttcctccagttcccaacaagctcttcatctccatctgagaccacctcagcctagagtttattgtccatatcactatcagcattttgggcaaagccattcaacatgtctctaggaagctccaaactttcccacgttttcctgtcttcttctgagccctccaacctgttgcaacctttgtctactacccaattccaaagttgttttcacattttcaggtatcttttcagcagtgccccactctactggtaccaatttagtgtattagttcgttttcacactgctgataaacacatacttgagactggggaaaaaaaagacatttaattggacttacagttccacatggctggggaggcctcagaatcatggcaggaagtgaaaggcacttcttacatggtggcagcaagagaaaatgaggaagaagcaaaagtggaaacccctgagaaacccatcagatcttgagacatattcaccctcatgagaatagcatgggaaagacccacccccatgattcaattatctccccctgggtccctcctatgacacgtggggattctgggggataccattcaagttgagatttgagtgggcacacagccaaaccatatcatcttctatgccacaggtactggaatataacttgaagagatcctggatcccaactcacattattttggggaagagaaacaagtagttgaataaacaaaataaaatccagtttatgaaaagtgctataaagaacacaaatggggatgctgggtctttatgtaataacaatggggcctttaaaatagagtatggaagaagctactttagatggctgcaagtgggaagccctccacggaggttcaagctgagatataaaggatgagaaaagtccagtcacatgaaagcacaggaaaagagaaaccttggaggcccagcaatgggggagattggagtgtgactgctgcagtgagccagtggctggggaaatgcgtgattggaaaggagaacaaaagccaggccatgcaaaggctcgatgtgtcatggaaacctgtggaaagatgttaggttgggacatgttttgttcctgggatatgaattacatttttaaaagtttatttttgtcacttaagagaatagattgaaaagggtaaaattaaacactaggagatcagttagtgaatgatctgggcaagagaaatctggcttgaatcatggtggtgagggtgcaggtagaaagaggtgagtctgagatctatctgggagtgtcacagagagcctgatgagaggaggtgagggatgggagaagggaggagtggaagtaggtgacttttaggttgttgcctggtaaccaagtggataatggtgctatttactgaaatgtaaagatgactctgctgggcgagggcaggagggaagtcatagaatgtacttgggatatgttgggatatctaaggctacttgaaatgcctatgagacattcaacataaatttcaaataaatagttggatataagcctagatctagggggaaagttggagctaaagacataattagcatttatcagattatagatggtagatagatctacattcatgggagtgtgtgagatcaactgcgaaaaagtacatatgtgtaagaaaagagtgcttaaaacctactcgtgagaaaattcaatatttaaagataagtaaaggaggaggctcatgtgtagagtctatatacaaattggaagtggtggtgactgaaaaaaatgcattaaaattaaccaaattttctcttttctaggcactgtcctaattgtagatgcttgagaaaatagagatgtaatcatggatacccaccaggtatttgagtcaggttcttcaatgcaaaagtcacatagaagctgctgctttaatgtttgtaacagacttccaaactaatgtctcttataatgtccctgtgtattaagatttccataaaaccattacaatttctatttattttgtctagatgtaaagcagacggcatatcatattacatatattgctaaaattcttgcagcctaatgtatacagatttgtgaattttgagtgatctgaagttcatgaatattttgaggttggtttgttttgtcttgttcaaagcctagatatcatgttttttcagtttaacatatttcttgagggaaaagaaatgtttagatttccagctagttataaaattgtcagaaagaatagaagttaaacatacagagaaacaaaggttacacatctgggaaaatagtagaaaagcctttatatagtcttggcaaatgaattcagaggttttatttttaatcacaactgtgaagaaagaaagattaccttttggggaaattaatgaatattgtgggcttagacataaaataattgttaattgctccatttattagaaatcatatgtcaaaagtgttttatcatcagtaatacaatagcaatagagataaaaatatatacggatatttgattttgatgattttaatctcctatgccatttccataacaacatgattattcacacctgtcaaactgatgggtgagaatgtcaacttgcccttgaatgccaaagactattttcagacccttgagttttctcaccaattcaatccattttgcatgcttctgacatgccttttagaagaccaatttgcttatatctctttacctatttactgaaaccctcatttattagcttggcattcaaagtcttctacagtcttgccatatctcactttaaatctgtttctccccctactcaccttctccaatgcaatccctatgttgtaatatggctaatctacttgtttttttaatgtatttcatgttactactatcttgaagtgttttctatgtatttctgtctctacactgtgatcctgcattgtgccatctacttagtgacatgcattcccttctttgacacatgtgtcttacgtgcctttgtcccccacatattacctagactggtgccatatcatagacagtaggttatcaataaatgcttcttggttagttagatgattagtatacagtatgcttttgatgagaagggtaaagaaaatcatcagagaagttaatggaattagactccaccctgggtgtctctgccttcaaaactcatgtctttcacattattccacgccaactcccacagaatagtatttgtcttagtccatttctgatgtcataacagaaaaccggagatcaggtaattaattatatgattagttagaaaaagattcataactagaacctagtgctccccatttccctcatgcttgataggtttttaaaaatttattgaaatagttgcaattttgtcaaattatttttgactcataattcataccttctgatatttcttactttgtaaaaatgattttcttctttccattttgtatctacaattcagcttcggtttctttcttttcatttctacttttcccttttgtttaaaatataacccattacaataaacttaggaaagactgtactgaatattgtctctataaagggcatgaaagtctccttaatgtgaagttgaggtagcgttaaatatacacttaattcagcaaactgacatctcaccaagcaatctttttgctatgtggacacatttgtgtgtttgtgtgcgtgtgtgtgcgtgtttgtgtgtgcgtgtgtgtatgtatgtattgcgcatgtgtgtctgcacattgtagagaatggcattttcacattaccacaaaaacactttatataagaaaataattctaaattggtccataggagagggagccataggatgggttagaactgacttctgtctctgacttctccatccccattattttgttttgtgtttctgaagccagttttacatcttagtagagccataaataatgacaataagctggaaaggctggcatctacgagggtggagagaagaggtcaataacatacatatatagtcttgggggtgctaaatgttgagtaaagctaactccaagcagagcacaatgagtggctggagaaaaatacctgtcagtctccacactttcaattccagggtgaggaagggtccttaccagacttgagggagcttttgaggtgttctagccaagctcttcaatgaattgtcattcaggctacctgcctactccttcggctactctacccaaagttcctgccccatgggtggggccactgcatcaaacaactctccagggagaaccattcacatcatcacctatgcctatctgaatggcacctatgcctatctgaatggagcctattcaaccacagtccatacggctttacctgcagccttgcataaaaccttgtagaaatatttcttcaaattcctttctattttctgattatcttttcttttcttttttttttttttttgcttatttttagggcgcaaatatttaaattttagattttctttacattaacaatgcaaaatacacacaattcattcacaagttagcaactcagctaatgtagacacttctgggcaatggctggtgttttgttttcagatatggttaagaaaatagccatacaatggctcctgtttgggctctgaagccaacagactccttcctctgtccccaaataggataacaaaagatttagggaatattcaatacttttctcaaagaagtaagtgatttgagtgtaagttgctacttccctgtaagaaataacagcaagcatagatacgcctaagggaaggcaggacgaagccgccactttccttggagtctaaaactctgacctgaaaagtgttcgcaagggattggaaccaaagccaggattgatttgctgagatttgcactctcacctaatggcctgaggaagcagtgctgctgtcttggtttgttctggcagctataacgaaataccatagactgggtggcttataaacaacggaaatttatttctcaccgttctggaagcgggaagtccgaaatcaaggcctgacagtttccgtgtctgtgggagggccgatttccttgttcacagagagcaccatcttgctgcatcctcacacggcgtgcggggcgaggcggttctctgggccctctttcatcagggcaccgatccccttactgatgggggctccgcccttacgatctaatcacctcccaacagccccccttcccaacactctcacactggtgactagatttcagcatgaattctaggggagccacaaacactcagaccacagcagtgaccaacgtagcattagtcaagaaagcccaagacactcagtctctgctagggaggaagatcttatcggtaaatgtgaacatgtatttcaggattcaagaggtgattagaagtgaacagttttaaagattacagaaagcacagtggcaatgctttaaaagaaagactgctttcctgtttgagtaagagcaagaatattaaatcaggagcattcgccaattgacattcctgtgctggtgtgaggagagggcagacgttcaagtcagagctcagctatccagctcatcttcactccactggactctgaggccagataattagattccttcttttctcccaaatttatatttcatcacaaagctgaatgacctttcctgtcagtgcaaccaacaaagatggctgggcaggaagtaaccagacgttgcaggccctcccacaccaaggaagttgtatattgcaaccacacagactgatttttgttttaatgccaagctatgcagctcggctgtcagagcaatgaagtgaaaataaaattaggggccaaatgtctaaaccctcaagaaatgtcatggataagaagaataaaacaagtaaaaggttttcctttttttgttttaatgtttaaatatatatgaattttgttatcagtgcactgaaaatggaatcagtgacccgttggaccaaatgcttatgttcaagaaatgccttgaactttaaataaactccatgttattttgctttggattaatttacttgcagatgtgtgacattgcttgggaatataggtccagctggaaaatacagacagaggcagggcagaacctaattttcttacgattcagactttgctgaacagacaacatagctttcaaaagaaacatgaacttctctttcttattcacttcagggacagagagattgaattgaaggcagaattcggagtttcctccaatgaccacaaaatagcattttaaaatcttgtcgtgtttgttttttgcggctgttttgatttttttttcttttcctcagcaggcttgtgaatttccaagtagccccatcctgctgcttcttcccttattcctgtatttattagcagagaggatgcagtcagcagctctgcagccatagggaattcacatcacctctctgagccttagctttctctctgtaaactgagagcattgggctaaataatttcttcctccagtggttggtctatttcctaggtctgtgtggagttactacttggatgtccctgagggggaggtagaatctcttcactatagcccccaatactagaggatcagttagtcagtcagccaaagagatcattcacgtcaatttgtgaaggaggccggggtggtggcctacctacgctccaagaacctagtacctcctttcccctctcctatcagatgacttttttttttctgttttcagtttgctcttctatagaattatactacacttttactggtatatatagaaaagcaattttcattaccataaaggattagaaagcaaaactttaaaaactaagctcatgcaagtatcttcacatcttagaatattaggggagatattcatatgggatgctgactgatgtcaaaaggccaaacatacaattatgggggttaccatcccatttgtatattacctccttgttagaaatcaatagtttattgattatttttcacattatttttaagaatatttttaattgtcagacagtaacagtaagacatttttaaattgttagtaaaataacttctatgtataaataacctctgtcttagtgaagtaacttttatttattagcaaaactaaatcttattcatgctcgtttaagcaaaatgaattacaggactatggggtctattaatttgctaggtctgctgcaagaaattaccataaaccaggtggcttaaaacaacaggagcttattctgacagtctgcaggccagaagtctgacacccaggtgtcagcaggccgcgctctctcggaaggctcagcggggggtccttgcttggctctctcccagcttctggtggctgcctggcagcccttggcggacctcggcccagcctgtctcagcatcactccaatctctgcctccgcctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgcctctgcctccgtctcctcctctgggtggccctgcctctgcctccgtctcctcctctgggtggccctgcctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtcttcccctttcagaccctgagaagcacacctgccagtggacctagggcctaccctaatccaggagggtctcatctccaaatctttaccttactgacatctacaaagactattccaaataagatcttattctgaggttccaggtggacatatcttttggaggtcaccgttcaacccaccacacagggagggtcatggagctcaagtgaagaaacagcacctgggctcagcagccaccgaaaatagcaattgcggaacccgttggaaaccaagctcattttcttggccctcctctcgccttccaggctgcatggctccttcatctgcttctctctgactggcagcatcaaccacttttctctgcagcctgtgtcagcttaggacagaagagaacccttacacttacatgcgtttagctccagagcacacggacagtggctaacctctgcctcatttctacattcctgagaaaaacaatctcatgggctagttttggttaagcttctgtcatggatcccatcagctgtagttgagacaatggtcaggtaagtaggtgctggaagggaaagacattctcagtttaacaaagtattttaaatgaagtcacaatagtgtaaaagttaataataatgaggtttctaaatactctttccaatgtttttcactaaagttcattaagtactattcaaatagtacttacgtttttaaaactatcccccaaatacttcagagccatctaaaatggttgctgggtttagacttccctgacacctatgatgagtcataatttagttatcaattttagtggtctactcttatcataagggcctgtgaggaaggtcaaggtagtttgcagtggcttttctagaaaatctttcagaaggctccaagctgtattgcctgcaattaggataataggcttggcttctgtcagaaggctcctttcagttctgtaaaagttcctgttggtgagtggtttattgggcctatgagatgtgatctctttcttctggaaagaggtccctatatggcagtaatggaggaatacgtcctggaaatgagagagcatatgtgcttggaagcgaggtggtggtggtggggggtgttaattagcatgacaggaagagaagacctattcagaaaacataatggtgagagagggaaatcagaagcgatatactggttggaaaccaaaaagcctcagggagacagagtcaaatatgatggccataattaaatcaaataatgtactccttttccttgacaaatcagtgagccttcagaagtgtgtgaagcttgagattcagacatgaaatgcgaacatgtgaggatatgagacagcccctgtggcccatcttccaaatctcagaagtgtgtgaagcttgagattcagacatgaaatgtgaacatgtgaggatatgagacagcccctgtggcccgtcttccagatctcagaaggacagaatgaacaacttcagaatcttagtgtcaaatgtaggcatggtgcttgatagcaaaagtgcatcaggttcaaatcttagaaaatagaattggcatggatagggtaaaaaattggtcgctatgagaaaagcagcattgttgatttcatttactaactgttgtaataatgctgtgtgtgtgttaactgaaccaactaggaggaaaatgtaaggaagagtgctcccttgttattgaaatgggcttggaagtcaaagagggaatgtctggtaaaggctatagcataagtaggatgacccaacaatagatttaacagattatatcaattatctggataaacttacataagagtggtactgatatggctattacatgcgagggactaaattgtgtccctacaaaattcatgtggaagccttaacccccagtgtgactgtatttggataccagaattttaggaggtaattaaagttaagtgaggtgataatggtggggtcctaacctgacgggtttggtggccttacgaggaaatgaagagagagagctctcagtctctcacataatttggaggcagaagatccagtctgagggctggtcacgtaggcattcttgggagagggcagtacaggcatgcctcagaaatattgtgagctcagtttcagatcactgcaataaagagaacatttcaataaagtgagtcacaagaagaatttgatttaccagtgcatataaaagctacgtttatactatactgtagtctactaagtgtgcaagacaccacatgtacttttctaatgttctctctctccatgcagatgcacacaggaaaggccatgtgaggacacagcaagaaggctgcctctacaagccaagaaaagagccctcatcaggaactggtctgctggagcttgatctgggaccttcagcctctagaattgtaagaaaataaacttctgttgttttgaccaccagacttacagtattttgttatggaagcctgagaagactagtacatatgaccatagccattttcacaatgtttagcatatgtttacatctcttttatttatgctatgaaattaccctgacataatgctcatatttaaagatattacctactatatttttctttttggatgggtgtagcattttgtgggtagctggattttttgatcagacaaagttcagaatcaaactgccaatataatagttctgtacgagaaaaaaaaaggtaaggaatggaagatagggatactataaagtaggagatatacgacaggaaatccatgccaataactctacatttacctcctaaatgaagatgtagccttgttgatcattggtttcaacaaagtatcaagagaggcactgatgtctgcccataagtgtgcaaacttttaggatgttcttcctgaatgggtataaaaaggctgaggaatagtaggaaactgagatactctgatcaagcaataccccttctgatgtgaaccacgtctgcctatatatttggctaaataaattgggaacttaatctaattttgtcttggttgtctttgtgtagtagttttttcctgctgaattctaagtccaccttaagtaataaactttaaaaatcatttgtcctttctgggttctatgctggggtcgagaaggtgtcattttagtatagataatgtaggcattttttttccaaggagtgaaatatttattgtgaataaaattgaagatattaatttccaaattccccttgttggtaaagacataggaagaaaacagaaatgcccttggcagatgaaagaaggattgctaggcactgcagactcagtacatggggaagtttaaaattaagagacaaaagaacaagtttgtaaagccagctttagaggtttcacaatgaaggagcttaaaagtgaaggctttggacattcagatgctggagcctcggtagaggcaacatgctgggtagtgctgagtacatttatttagaagtcattgaattgtcttttctatttatgatctgtgtattgaagctattcaccagattcttatttgtgcttttcttcatagcatgcattttacttgccattaattgattcaaaattatttttctagcaattattcatgctgatgtgctcaagctttattgttagatctagaaacagtgataggtaagatgtcctgagtacttgcccagggatattcactaaatcttcacagcaattctaggacagagtcaacattaccctgtcacagctggggatgctaggccttagagaagtttaggaacttgtccaaggtcacacacaattagtaaaaatagtagaattggaatttgaacctgggtagttgggctccaggcctcctcctcttatccattttatcaaaccaagtaacactgtacattgtttacgttgttttattggaattatacatagcattctggagtgcaacttagattcaagataccacatgtactttttatgttctgaagttttacatctaatctattcctacaaattaatgtattttaatcataatgtcagtgtagcatctagacataaaaaaatgggtatattaccttgaaccacccaaatttgaccagtaggttgaaaagaagtatggctgcattctgcgcttcctctctgacactctagcacagggcattgaggtataagagaatatcaatattggcacatatccaactcacagatgtttgtcttttcttgatgctccctggtgccttagctttggccacagtgcacataagcaaagtgacagggcaagagagccacaaggagaagaggctggaagtgcaagaaggctgaatgtacgtgagatgtagaccaagggccaggggcccagattcacaatagacatctgcagtgggaggttgctgcagctactagagattgcaagaaggcaactattagaatcgaagtctgtcatgcctgctacatgaactgcaaacataatttggaggcagaagatccagtctgagggctggtcacgtaggcattcttgggagagggcagtacaggcatgcctcagaaatattgtgagttcaatttcagaccactgcaataaagagaacatttcaataaagtgagtcacacgaagactttggtttcccagtgcatataaatctatgtttacactgtactgtagtctattaagtatgcagtagcattattaaaaaatactctacataccttaattaaaaatacttcattgctaaaaatgcaaccaacaatcagagcctccagcaaagtcataatctttttctggtgggaatcttgcctctatgttgatggcttctgacggatcaaggtgttgaatgctgaaggttaaggttgctgtggcaatttcttaacataagacaacagtgaagtttgctgcatcaattgacttttcctttcagacaatatttctttgttgcatatgatgctgcttgatagcatttttgtcatattagaacttctttcaaaattggagttaattctctcaagccctgccactgcttgatcaactaaatttatgtaatactttaaatcttttgttgtcatttcaacaatgtcacagcatcttcaccaggagaagattctgtcccaagaagccactttcttagctgatccataagttgcgattcctcatctgttatagtttgatcatgagattccagcaactcagtcacatcctcatgctccacttctaatttcagttctcttgctagttctacaacatctgcagttactttctccactgaagtcttcaatccctcaatattatctgtgacagttggaaccaacttcttccgaactcctgtgaatgttgacattttgacctcctcccatgaatttcgaatgtcctgaatagcatcccaaatgttaaattctttccagaaggtttccaacttacttttcccagatgcgtcagagcaatcactgtctatggcagctgtggctttatgaaatatatttcacaaataataagacttgaaagttgaaatgactccttgatccatgggctgcagaatagatgttgtgctagcagacatgaaaacaacattaatatctttgtacatctccatcacagctcttaagacaggtacattgtcaaagagcagtaatgttttgaaaagaatcctttttgtttttctgaaaagtagttctcaacagtgggcttaaaatattgagtataccatgctgttaaaagatgtgctgacatcctagcttccctgttccctttacatagcacaagaagagcagatttagcataattcttaagggtcctaggatttttagaatggtaaatgagcattggcttcaacttaaaaagtaacgagctaggttgggtgttgtggctcatgcctgtaatcccagcactttggaatgctgaggtgggaggattgcttgagcccaggagtttgagaccagcctgggcaacatagtgagaccttgtctctagtaaaaatgaaataaaatatttttgaaatttgaaaaaaaaatacagcagttacattagcccttcacaagaaagtcagcctgtcctttgaagctttgaagccatgcattgacttctttccagttatgaaagccttcttaaataggagatgccatttgcctctgatggctcttctttcagtaggagggtgttttgtatagattaaaaatcagttgtttagtgtagctacgttcatcaatgatcttaggtagatcctctggataacttactgcagcttctacgctagtatttgctgcatcacctagcactgttatgttatggagatggcttcttttcttaaacctcatgatccagcctttgctagcttgaaacttttcttctgccaattcctcacctctctcaggcttcatagaattgaatagagttagggccctgtgctggattaagcttcggcttaagaaaatattgtagctggtttgattttctgtgcagaccactcaaactttctttaaatcggcagttaggttgttttgctttcttaccatttgtgtgttcactggagtagcagttttaatatcattcaggaacttttcctttggattcacaacgtgggtaactgcttggtgcaagaggcccagcttttaacctgttttggctttggacattctatccccactaagctgaatcatttctagcttttgatttagggtaagagatgtgtgactcttcctctcacttgaaaacctagaggctactgtggggttattaattggcctaattcccgtcgttgtgtcttaggcctgaggagcgggagagagattggaaaatggctggtcagtggagcagtcggtgctcatgcaacatttctggattaaattctttgtcttacatgggtgcagttcatggtgcctcaagacaattacaatagtaatatcaaaggtcactgatcacagatcatcataagaaacacaataataacgacaatttgaaatcacaagaattaccaaaatgtgacatggtgatatgaagcgggacatgctgggaaaatggcactaatagacttgcttgaggccaggttgccacaaaccttcaatctgtaagaaatgtaatatctgcaaagcacaatagactgacatacaataatatgagctaggcctgtgttatcaaaccagagtttgctttagcaacagggacaccatcttggttagtccaattctcatcttcggagatctggagtgcatctctctgagagtctgtacaatccttgttagaaccctgagttcagagtaataaaaagggatgaaatgattaagggactggacttttgctagacagtagactcctctgtgtgccctaggttgttcttctcctctaacacatcagagtagattgtatcttaaaaaggagtatttgtgttcagagcaactgctgttgtgcctgctcttcaggtgacagatggtaggcttctctctgaaccaaaagcaatgtttgccatcctaaaaatgtggacataatatgttatatgaaagtttttatttgaggccacgtaatatggctttatagttttgtttcctggttattagtcttatcaaagttactgctggaatgcctgtgcagggaacaaaaagaggatgtcaaggaagcagtgaccagcaaatcctgatagaagtttaaattccctgacaatccaataggaataaagacataatcagctgcatattggagcacattattaaaacagccactcaggttttgaaatatccatttaaaatagttcaattaaaacccaattacagaaacgttccacacgaacactgaaacatctattttattatgattctgcatatcagtagcctttaaatcttaaagatgaaccaaaatgtcttttaaaatgagcactaaaaggggagacccacaacatagtctctgctgcttcaaaggggtttctgccttgatttaagaacatgagttccagttgtcccaattaccgtttacagtaaccgaaagaataataaatagaggatgcctgtgagtatctgttgtgatgcaagaaatattcatcttaggcacactaagcaactaaaccacaaaattggactttttgcaactgttcgaaaagttaactaaagatgaatatgcattttatgcatatcagtgcttttatcatatgccatttaattataggttattttaaactattcattcataaaaaattaatttatttagcactttagaatacctaagacatatagtaatataaatgtatgcaagattttcagaaagtcacttcttattttgcatttttggctagagttctctttcggcaaatataggtgtgagccagacctcacaatgtagcaattatgctttttttttttttttttgagacagaatctcactctgtcacccccagggtggagtgcagtggcatgatgtcggctcactgcaacctctgccctctgggttcaagcgatcctcctgcctcagcctccccagtagctgggattacaggtgcatgccaccaagctcagctaatttttgtatttttagtagagacggggtttcaccatcttggtcaggctggtattgaactcctgacctcatgatccacccgcctcggcctcccaaagtgctgggattacaggcgtgagccaccgcgcccatccacaattatgcctttttcccggctcactaaggatttagagattcatattcctcttcttgtcacagccatgaattcctttcagcatccacctgcatgctttgcctggcattgtctgcttgggaaccagagccctgttactgtcttacttgaaaggcaagttttcctaagctatctaccagattactttagatcatagccttctttagatttctctaaattatatgtctttggacctcagatatacatggtcttcttttgagaaatgtctattcaaattttttgctcatttttaaattggattgtttggtttcttcctattgagttgtttcttgtatatttcagatgttaatcccttattaaatgtagggtttgcaaatattttcttctattccacaggttctctcttcacttggatgattgtttcctcagatgtgcagaagcatttaaagttgatataatctcatttgtctatttttttttattttcttgcttgtgcttttgggttcatgtaaaagaaattattgctcagaccaaagttatagagcttttcccccatattttgcttcagcaggtttatagtttcaggccttacatttaggtctttaatctgctttgagtttacttctgtatgtggtgtgagatagcataagacatacaaaaggccagcaagtatacggaaaaagaagacttgcaaataaccaacaggcatatgaagagatgctcagcatcactaatcagcagagaaatgcaaatgaaagccacaacaaaatagcagctcacacctgttagaatggcttttatcaaagagatgaaagttaaatgttggcaaggatgtagaaaagacgaaggccttgcatactgctggtgggaatgtaaattagtacagacgtcatggaaaactgtacagagcttcctcaaaaagtaaaaatagacctaccatatgatccagcaatcccactagtgggtatatatccaaaggaaagtcaatagctctgtatgacaggtatttgcattctcatgtccattgcagcattattcccaatagccaagatatggagtcaaactaagtgtccattaatggttgaatcaataaagaaatgtagtatatatacacaatacaatgctatccaacctttaaaaagaaggatatctggtcatttgtgacaacatggataaacctggaggacattatgttatttgaagtaagccaggcacagaaagaaaaatattgcatgatcttacttacataattgcatattaaattgagagaagctgaactcatagaagtagagagaatggtggctaccagaggtttgggagatgttggacaaaacaaacaaacaagaaaagtaaggatgtaacttcaaaccaaaaataaaggagtaccaacggctttttgactgaatgcccacaaatacggcagctgtcactttgtttacctttgtcatactgattttgtagttggacctgtcatggccattgctggaattaacaaatgagtggaatgattacaaagaaaaattgaagaatctattttgttaatttttatggtaatgtatattgagagattatgggtttctcaagaatgccagtaacggccagatgcagtggctcatgcctgtaatcccagcactttgggaggctgaggcaggcggatcacctgaggtcagaagttcgagaccagcctgaccaacatggagaaaccccctctctactaaaaatacaaaattagccaggcgtggtgatgcatgcctgtaatcccagctactcaggaggctgaggcaggagaatcgcttaaacccgggaggcggaggttgcggtgagcccagattgcgccactgcactccagcctgggcaactagagtgaaactccattaaaaagagagagaggagagagagagagagaaagagaaggaaggaaggagaaaggaaaaaaataataccaataacatacttgtgcatggctcaacaaataatatttttattcaagatatatttacaatataagaatgcacaaacacttcagtgtgtttatacattggcatatcggggttttattattaatgttggcgtatagcttttcatcaggcctcttccttactcaaaaatatgtgaatttccccaattttctgctttatcaatccccagactcctctgtctggttgtcaattctctctccagttccgctccaccgtatgcattcaacaatatattttttgactccccaaggtgcacactctacttaaacttgccccctcttcacctgtgttaactccacccaaacttcaggcaactgtatcacatcagcaacggagcgttctctcaaatacctcagcccttacacactcagctccccaactgagcacttacttgaggacttaggtgtacatttatatcaatttgtggtatgacacccttttatcattttctacttgtcactctatctccctgcaactgctctgtaagcacaagcatctacatagtgaatagccaacaatgaagttcagactagcaaagtattgacaatgccattttctaggtcagtttctgagtgggctgagatgactgaaagtagaagtcaactccagaagcagctgatttccagcaaaaagagcgatgattactcctctgcttaccagcagttacacctattgatactggagcctccccctaccacgaggtagcttctgctgctattatcttgctgctctgggtgagtccctgagaattcggggttagggaagtaaagaggggagcaacagtctgtaatcaacttaggacatttcattgctataatctcattactcaagagtttttttttaaatatcatagaatataattaagtctggtcccaatttttgcccagatgggaagaaaaggaaaaattcatgaaatataagtctaaggtgactttttaaaaattgtattttctttttggaaataacaaagtctataataaaatgtttatgtaattttaattataagattgtaaataaaatgcatgcatatgaaatgcatttattacaacttttatacaattttgtgaagctaatcatatatatgtgtgtatatatatatatgtgtgtgtgtgtgtgtgtatatatatatatatatacacctctgtctttatatagatttctttgcatggatctatccagacagataccactctttaaagttttatatattttaatctccagtgagaaataccaaagtgaactaggtcatctctttccatggtggagctgatggctgactccaactgtgaccaaatgatctctccttgaggccagataagaaagatgaacatgggattatttttccttatgtgtattttcaagagctcattaataatttcagtttcatgttgatgagagttagctttcagaaacatttattttatacaaaaaaaaaagactaagagctcgttatctcttcatgatgatataacttttctgcagaatttctaaaaatcttaaaggacaattgtgtgtgtttgaggagaaatacagggcctgactcagaatcttccagttacattctctcttgttacgtttataaattctataccctgaaaacaggaaatatgttccaactgttggaaactttcagttacaactgatttgtgtttttctgctatgttcattatttcagtttgttattaccaacgatctctcttttcttaatagaccaaaacataaacaactcaggcttccttaagaaatcttggctcgctgcaacctctgcctccagggttcaagtgattttcctgcctccacctcccgagtagctgggattacaggtttccaccaccacacctggctaatttttgtatttttagtagagatggggtttcaccatgttgtccaagctggtctcgaactcctgacctcaggagatccacccgcctcggcctcccatagtgctgggattacaggtgtgagccactgcaccaggcccataatttctaataattatttatacctactctatgttctgcactgtgccaaattctttgtatggatcatctcatttaatcttcaaagaaactcagtgaggtcaatataattattatcactgttttctgagaagaggactgaagcttaaattgcctaatgatccatgaaaatgcactcatggacatcgacaccccccaccccaccccaacaccattgctgctgccactggtgcaaacacgcatgcagatgctcatggccaagcccccgccaatgaaccacccctgccgctgccagtgcatgcacatgcgggaagaccacagccctgttactgctggtaccccccagaagctaacacgtgtgcacctccccacaacacagctgctggcacacatgagcaagcatggatctcaaagccccaacaaagtgccttggtgggtaccacccaacaaagtgttgtggccagcagactgggaacatctctgcccctccagcacagcagcttccttacctggaacagacagagaacaaagcaggggcctggtaccagctcccagagttagagtacacaccctgggagtgctgagctgagctttggccccctaaaatcttccagaaatgaagccatttgattgaacccaccttataccacaagcaaaaccccaaggtcatcaaaagagataaaagcaaaaaatctccatccaaaagacagcaacttcaaaaactgaagaaacatcaactcacacacatgagaaagaaccagtacaagaactctggcaactcaaaaagtcagtgtcctcttacctccagacaatggcactagtttcccctcaatggttcttaacgtggctgaaatgacagaaatagaatccagactatggatatgaatgatgatcatcgagattcaggacaactttgaaactcaatccaaggaatctaaggaatacaataaaattttccaggagctgaaggatgaaatggccattttaagaaagaatcaaactgatctgatagagctgaaaaactcacttcgagatttcataatatgatggcaaggattaacagcagaattgaccaagctgcagaaataatcttagaactcaaaaaatatatgatttaaaataatcagacaaaaatttaaaaaaagaatcaagaagagtgaacaaaaccttcaagaaatatgggattatgtagatacaccaaatctatgactcattgacatcactgaaagagaggcggagaaagcaaacaatttggaaaacattttggtgatattgtccatgaaaaatttgccaacctcactattgaggccaacattcaagttcaggaaatgcagagaatccttgcaagatactatacaagcttaccatcatcaatacaatagtcattagagtccccaaggtcaaaatgaaagaaaaaatgttaaaggcagccagagagaaggagcagatcacctgcaaaaggaaccccattaggctaacagtggacctttaagcagaaccctacaaaccagaagagattgggagcctatatttagcatcttaaagaaaagaaattctaaccaagatttttatagatagccaaattaagcatcataagcaaaagataaataagattctttccagagaagcaaatactaagggaactcattaccaccagatctgccttataggaggcccttaaggaagtacttaatatggaaaaattactggccaccacaaaagcacacttaagtacatagaccatcaacactgcaaagcaactgcacaatcaagtctgcataataactagctaacaacatgacagaatcagatctgcacatatcaatattaactttgtaattgggtgaaatgccccaattaaaaggcagagagtggcaagttggataaagaagcaagacccaaaggtatgctattttcaagagacccatttcacatgcactgacacctataggctcgaagtaaaagggtggagaaaaatctaccaagcaaatggaaaacagaaaaaagcaggggttgctattctaatttcagtcaaaacagactttaaaccaacaatgatcaaaaatacaaataagagcattacataaggataaagcgttcaattcaacaagaagacctaactatcctaaatacatatgcagccaacacaggaatacccacattcacaaagcaggttcttagagacctacaaagagacctagataaccacacaataatagtgcaagacatcaaaacaccactgacagtattagacagatcattgagacagaaaattaacaaagatattcagtacctgaacttgacacttgaacaaataaaggaagtaatggacatctacagaactttccactcaaaaccaacagaatatacattcttctcatttgtacatggcacataccatatatcagccacacaatgggccatcacataattttcagaaaattaaaaaaaataattgaaatcataccaaccacactcaagaacacagcacaatataaacaaaaatcaacactaacgaaatcactcaaaaccatacaattacatggaaattaaacaacctgctcctgaatgactttggggtaaacaacaatattagggcagaaatcaagaaattctttgaaactaatgagaacaaagatataacatatgataatctctaggacacagctaaagcagtgttgagaggaaggtttatagcactaaatgcccacattcaaaagttaaaaagatcaaagtaatgacctaacattacacctgggagaactagaaaaacaagagtaagccaacctcaaagctatcagaagacaagaaataaccaaaatcaagagcggaactgaaagagattgagacagaaaaaacatatcaaaggtcaacaaatcaagaagttggtaatttcaaagaacaaaaaagattgatagaccactagataggctaatagagaaaaaaggagaagatctaaataaacacagtcagaaatgacaaaggggacagtatcaccaaacttacagaaatacaaaaaactctcagactactactacaaatacctctatgcacagaagctagaaaacctagatgaaatggataaatttctggaaacatacggcctcccaagattgaaccagagggaaattaagtccctgaacagaccaatgattggttctaaaatagaatctgtaataaaaagcttactaacaagaaaaagcccgggaccagacagattcacagctgaattttaccagatgtataaagaagagctggtaccatttacactaaaactattcctaaaaatggagaagagacttctccttaactcattctatgaggccagcatcatcctgatatcaaaacctggcagaaacacaacaaaagaaaacataaagccaataactttgatgaatatcagtgcaaaaatcctcaataaaatactagcaaactgaatccagcagcacatcaaaaagctaatctaccatgatcaagtaggttttattccagggttgcaaggttggttcaacatatgcaaatcagtaaatatgactcatcatataaacagtaataaaaacaaaaaccactcgatcatctcaatagatgcagaaaagacttttgataaaattcagcatcccttcatgttaaaaattctcaacaaattaggcactgaaggaacttacctcaaaataataagagccatctatgacaaacccacagccaacatcatacggaatgggcaaaagctggaagcatttcccttgaaaatcacaacaagacaaggacaccctctctcaccactcctattcaacacagtactagaaagtcctagccggagcaatcaggcaagagaaagaaataaaaggcatccaaataggaagagaggaaatcaaactatctctgttttcagatgatataattctatacctagaaaaccccatagtctctgcccaaaagcccctagatctgataaacaacttcagcaaagtttcaggatataaaatcaatgtacaaaaatccataacatttctctacaccaacagcttccacacttagagccaaatcaagaacacaaccccattcacaatagccacaaaaagaataacatacctaggaatacaactaaccagggtggtgaaagatctctacaatgagaattacaaaccactgctcaaagaaatcagagatgacacaaacaaatggaaaatcattcatgagtggataaaacatactccccgtctttaccttggctttccttcttcatgattctattttgaaactatgtgagctgtggttaggctccttattttgagaaactgctcaagataagacaagttattaaaataaaatattattggcaaaaggatgaaaagctagaaaacagagcaagatagataatgcaacggatagctgagggctttgaaaacatatattatataaagttctgttttcttgttcttaaggaaaagttttttaaccaaaaaacacaagctactactcctagagtggataaaattctcaaatgcattttcagaaccttacaatgtggcttcaaaatgggcattatcaataattactcaaaggcctgatgctatttaatagcagacagaggaaggtcactgtcttttcctgatccagaaagtttttcctattttgactccatttttttcagatgtagtttgactccagtgatcaatacaaattcaaattgaataccgtgcagcaacaaatatgccatagtgccttttcctttctttttggcctttttttgaacaacattaatcgacagaagaaagtcaaatggttatagctaagagaaaaaaataaataaaaaggcttctgagccataaaagtacaaataaaaatgtgaaaataatttttggaaggcttgatgaattttatcttttagatttagtgcattagtttacattatgttgggactttggtttatgtaaaaactggatagtcaaaattattaataataaaataatgtgttctcaagagtaaatctcatgtctttaaatcatatgaatcattcatcatcataggaagccatgaatttccattacatagctgaacagttggagcatcccacaacaatggaaatgtataagtggggatgataatcggagggttcatgtggtagagtacagtctaaccagctggaggttcagtgaggcatgtgtctttccccctgtggtcacacaatgaccatgcagttggcatgacaactcttttttcctaccctacgaacttcaggcactgctactatttgtcagatatctttaaactaagtcaacaagatctatacttaggaatatttaattaattagatgtccttactaaagttaattaatttatgagatatgaaggatactttgtaataagaatagttttttaaaaatatgaaacaatttccaatccagatatggacaataaaattaaactgaatgtgaactgtttggtaaaagacacagtgagatttggatgatatgaaactttttcttggaaaaaagtcttttttgatatgtatgtgaatgaccctatataaatggtaattacatgtactaacacttgaaatgataagtgagcaaaaataagtgagtggttttataatatattttatttcaatagtttaatacacatactttttgataaatcacaataatatattttatccatatgaactaaaaggcaatactttgaatagtagaaaaaattaaatttccctgcattatagggtatctaaccttttcaactaattttttgagctactgagccatgatatttttccttaaaaagcatttttagaagcataaagtaaacgtaggtgataaattaggtgtacacacaggcatgtattaatgacagcacccttctccagaactttaggatgtttcacgagtgggacatcatctctcttaaattactatggagaaattaaggattagtttctcatgatgttaactgatttctttaatcagctaggggttggcatttggcattatggtgtgcatgtgaatcttgggtagaatgcattgtattgttgtaaaatttgaattaatgtggacatatcttcctttctcgctgtcgtatagtaggaaaagttttgagcttacactttgttctccaaaggattcagatgtgtttggtcatgtacaagtgactcaggaagagttcacggcaggagagagagtttctaggtgttcaaattgggtcccaggataataagttgccgtgaaagaccttgcttatgtgcctttctttctccactttgtccctgcctgacccataccagaggcttgtgttggagctcttaaaagggtagacgacagtaaaatatatagaaaaactgtttcactaaaggctctgtgagattttgcagaagttcagggcagcctataccgggtaagcatgctgggttgtataatataatgaaatgcggcccagggattgggtgtcataaaacgataacctttgatcaagctaatatctgaaacaggagtgggactcctgaaccgtgaggcacatcagccgcatcataatcaaattagaaaaagatattatttttgtcacttgcattacctctgaaaaagataccgttggctacattggcctctttctgagttttgttacagatatctgagatagaagcacagccaaggaaacgttgctttatacttatttataaggacatttttaatctgcttaacatatagcctgtacaacataggttgtgtgtgtatacatatatacatacagatgcacacatttatatacgtatatatttgtatacacacacatctgcctggtcttctaattagaggggctgaaacccagtttcaggcataaaaacgatcactgatgtcacagtgctgttcagagagtgtcagtaaagctgaggaataacgccgtgcttacaacgcaaacagggcatcctgtgtggaaaacaaacaaaaattgtcaaatatcaaatatctaaaatattatccttcatacgttgttaattttgttacattaaactttcatcattctatttaattgggtatcgaatcaccttttaaaattcttaaattcttagtatttcaagctcttctggagaaaaaaatgaatgacaagtacagaaataaaatacaatcctcagcaggtgcggtggctcacgccagtaatcccagtactttgggaggctgaggcgggaagaccatgaggtcaggagatcaagatcatcctggctaacagggtgaaaccccatctctactaaaaataaaattagctggacgtggtggcacgtgcctgtagtgccagctactggggatgctgaggcaggaaaattgcttgaacccaggaggcggaggttgcagcaagccgagattacgccactgcactctagcctaggtgagagagtaagactctgtctcaaaataaatgaaagaaggaaagaaagaaagaaagaaagaaagaaagaaagaaagaaagaaagaaagaaagaaagaaagagagaataaaattctcaaatgaatcagcattctaatccattttcgattttagtagaagttgagaagatgtcccttttcaaaacctagcaactcagatattctacactaatagaaaacttagtactaactttgacttctgatagccctaaaaaataatacagctatatcagaggtacgtgggtaacaataaggtaatgttatcaaatacaaagtctttactacgttcaaaactgcactcaagtttcttttatctgttcctttgaacaaagattttgcagtcttttaggaaccaactctacctctataaagtattctgcttctgacctggtactgtattctccttgaagtgtttcacacactgattttgtgttgatttcccccctttcttacacccccaggatttttctcagttagatatgctgagtttataagtcagaaatttcaaggattattcctctaggctatcaaccaataagcacatacagcagaacagagggaagcaattgtttcatcatgaggaccacattgtgagtcctatctgccttcagagctaattgcccttgaactttgccatacttgcttgctatgttcctgttcccattcaaatatccatcttcctgcatcccacaacacctacccacctctgcttacctagtagtaatacagcagggattcacatgaatagggcactggtacatgtgaaaatgcacctggaataaatatagggatgggtctgcggagcctcttgctgctcatcgagcccagggtaagattccttgagctacgtcacacatcaccatcctgcagatatttattataatagaaaccaaaatctcctgttttattgcgtttcaggcaaatgacccattcatccagttgctactgttttaaaacacattcctccatgtttgtgttttccatggccacgagcagattgagtgaagtaataagaaattgtggaaataatttctcatcacatacatcaatctatgtgagttttcttccaggcatgttgctgagcattttggaaaattggttgataattatccatgtagtaaaagagcatctctctgtacatctttgatgggaattatgcaagagaggtcatctcattaaatttgatctagctaaaggtatctcggccttaaaagggtggaagtgaattttgcaaatcaggaaaaatagtgacgatgtatggctcacaggtgcttcattatttgaaaaacaaacacaacaaatgaggtcaaatgttaactactgagcttatagataggatgactatattacatgtgtgaataatgaaataactagtcagaacttctaagctgagataaaatcacagtgtgagaaaagcctgggatttttgtagcatttagttgtggccattcacttgattctaattcaatcgttgtattactcggttttcacgctgctgataaagacatacctgagactgggtaatttataaagaaaaagaggcttaatggactcagttccacatggttggagaggcctcataatcatggcagaaggcgaaaggcacaagccacgtcttacacggcagcagacaagagggaatgagaacgaagcgaaaggggtttcaccttttaaaaccatcagatcttgtaagatttattcgctaccatgagaacagtatgggggaaactgcccccatgagtcaatcgtctcccactgggtccctcccacaacacatgggaattatgagagctacaatttaagatgagattgggggggacacagccgaaccatatcaatcattacattcagaaatatattgaacccatcagttaaatcagttccttagtgtgtgcatacaagacatgggaagatgtcctttttcctctttaagagttttcaggggtcattgcaaacaagagaccctacattgtctctacaaacatggcgtgtggctctttttatctcatttttttccctctaaccataaatacctcttgttttctagggggcctttctagtacacgtgtgtgtttgtggcacagggagaagggtgcgaagagagaggagattatcaattaggctttaaatcttacactaatttaaatttatggatttcatcaactctgaaaaaaatgaatcatttcaaagttgtcagtaaataagtcatgccatgttattactaaagttatgatggcattgcttggatattaagtctatttccggatacaatttaaagagtgatgtgaatttctattttggaaaatatataactgtcttccattgatcactgccattaggtgagcaaggattgccatggacatgggactgcctgggaggctgactaggcaagagtaactggtaactagaagtgggtaactctccctcctttcctatatcactactcttttccctccactcctgtctccctaagtttacactccctaacaaaagagtagcatatgccaacacaacctttgctttatggggacccaaattaagacaatggcactaaaatttattttgcaccttgcacttgggttcacagccaaagtgcattgaaaaaaacatagcaaaattttgatgtgataattaaactctcctctgtgttactgaagactttcttatctgggtcatggtaaagctgcatcataactgcagtcttatgggtcatgttaaaactgcatatatcttctcacagagatggagacatttataacatctgcctggtggcttgcccagccttgattgcaaaagggaataaaagcaccttagagagtaacaaagatgacatgaagttttgaaagagaaaaagagagatgggattgattgagaaataatattctcataaaatctcagtgtcatgaaaaatatcaaggatttcagcaaagccttttacaaatatagactcatttccatggaatcagagcaggctcctataaagccttcagcctttttaggttagaggtggaaaatttgggtgcagaggagaaacccctaactatagagcactgctctggggccttggggatctccatacacatccagagagggtcagaaatttgcgaaagatgaaggcttgcactgtctccatcagcagcttctgttaggaaagagacgagtgagccaggcaagggagagcatcatgaacccagggggcggcttgagccaagcagtccacaaggccaggtggcccataggcatgtgctatgtctattataaaagccaccacagagtccacggtagattccttgagaaataatggctggaatttaaaaccataactatgtcttaaggcacagagatactacggtttttcctccaggaagagcagtataaatctgtgttggcatcatggtaactttaaaatacatgatcacggtcagagaaggttggggccaaaggtttctaaaacaattccttgtgactccttgctgctgggaatgcaggaaaatgtgctatctgtccagagtaggcttagttcttagagtaacattctgaagtttcaaaaaaaaaaaaagtatttgatggttttgaattccagggagtcaaaggaagctcaatgaagttttccatgtagcctcttcattcattctgcagtcagtgcaaatactttgcacaaaggtttctgcaggagaagtggaatgaagaagtcagctgaggatgatcagatacagcagcctcctaaagtagatgccaaactagcaggtgtagggcagcgtgattccgcactcctccgttgcatgcatggatagatatctactattagaaaatgtaaatgatgattgctattttccccttcatatttgtgaaaacaatagccagtagtttgttagatgacagatagatgaggatactttgagacaagaaaagcatggtttgttattatggaactgggttaaaaggctatgctaaaatattgagcaaaatgtaaactttagtgcattacaaactgcccaagccattttaggctttcttatcagtattacaaagataaatggttgttttcacattttccccagtcagatcaatattgtatcaagaatgtattcggtaatgcttagttgccctcaaagggttattgaaaagaataacaaaaatgatggctgtgaaccagttttgtagaaatatgtgtactatactaatgtcggttattgttatttctgttacaataatagttttgattttaacccaatcttaaggggaaaattttagaatatgaattgcagttattctcagtagcctaactacaccttgcgtgttagaggaatcccttttcaatctcattctgctcagtcttgctattaaatacttggtaaattgagttgagagtgtgctaattgaatttgcggacaatccacagccaagagtaaatgctttaggagagaactgaagtataataggactctgataaactgtaggaaataggccaactgtccaccaaatgagatttcctaaagctgtctacaaagctccaaagcatacaataaaataaaatgccaaaaataacaaatgcatttatctctaagcaatattatacacgcacacacacacacagaattttcattcttctacatttttgctaattctaaagtcaagttttctgccgctccattctcctctttgtcttctccatgtttctgagtatttctcctataccatattttctcctttgtgactctccctatttgagttaaaatgtgattctgcatagatcggattagctatagtgaagagcagcattggctatttctggaaaagctgtcacatggttccaagcttagtgccacaagaagatcaccaggaaaaccgtaggcctttccatggatcatgggatcaggagagccccacaccatgagcctgacacactcgggaccaagggagggagaaaccacttagccatcttgttcatctgcacctctaacatcggagacttgattgttgctaggttcacttcttgaatcgtctcaccctttccctacagtccaagatcttcacttacatttcagtttcttgagatattgaaatttttgagtcagtgtaggatgttgccactgaatatttggttataatcgttgactgtcaattcctatagcactaaaacggttttggttttctttttttttttttaattttgtgtgtatctaattttgatctcacaatgtaaccacttttgttattgcttttaagggttatctttcaaggtcttttgataatgatgtctaacacttgcaatagtgaggccacactctcaggcataatcactaaggtgtgtgcaatctctgtctcctttttcactaaatctgacaggctcctcctataattatctaaaactagtactgattgaggtttctttagactaatgtgttttcccgaagagaattttgtttttaaaataaatgagagtgtgtagtagcaaaacaatccaccaccagatcgcccttcaaggaaggctgtaatgccttccctgctgaggtgctgatttgagagatagtctccagctctccgccatctacagggatagacagcttcctgtgtcttacttctggaccagagccagttttcagacttagaaccccttgattgaagaagaatgaggtctccaggaggaaggaccctgtaacaccatggcaagtggttataaggaatgattctctctgtccttccccagaagaacctagggccattaactcagcttacctcacactggagaatggacgttaaaaatggggaatgctggtaacaaagcctgacttgatattaatacctggagacctgaaacagcattagagtccctttgctagtgtgaggcaatatgaggggcagggagaaaatgatattctgttcaacaccagcctcatagtgggtccacatggtctgctaacccactcaagagtaatttttccagccctcaaatatataattggaatagacatatttggtattagttacagtcccacattggatcctttgcctacagaaaaagaacaatgattgtgggaagactaggcgaatgtccctgaaactagtctcctatacagccaaaatagtaaattagtattgcacctcagggtgaggagggggagaacagaaattagtgcccccccatgagatctgaaggataattctcatatctctgtttaactcaacagtctggctcctccagaaaccagaggatcccgaggatgacacatcatcgtctgaattgcagcctccatgcttacatctttaatagaactgacgaataggacctgaagtacatgctatgtgaccttgatttagccaatgattgtttttctatttctatcagaaaagagaatcctaaacagtttgcattcacatgtaacgtacaaaagtgtctatctacagttttgcctgggacaatgttaattcccctccccctgtcataacataatctgcagtgatctgaactgtcaggataacccgcagattatcacatttatccaccatatcacgttagtcagagcggatatgcaagtggctagtatgttggatgccttgtttggacatatgggcttcagagggtgagagatgaaccatgtgaatattcagaattcttttgacatcagtaaaaattttaagcatagtcacaggcatgccatgaaaattaaaagataaattatttcatcttacaccccatgaagaaatttcagtctctttgggttttggaggtcacataatccacacctgagaatactgatcgggcccatttattactgacaagaagggctgccagcttaaagtagacacaggcaagaaacctctgcatcacatccagacttcggtgcatgcagccctgccacttgggccactcagctcaggagaccctatgatattagagttttctgcagtaggaaaatatgccatgtggaatatatggcaagccccgtgaggaaatcacagcacaggcccccagaggtgtgaagcattgccaagccgtctgcagtggagaaggaaaccactgaagaaacaattcctggcatattactgggccctgctacagtaagagaacctgaccatggtacatcaagtgcagcatgtcaactggatcaggtggacccagaaaaaacgccatcatctgatgaaagtgatacattcaggatcgaatatgagcagaaccagcgagtacaagcaaattgcacaaccaggcatcccagatttccatgtttccctcatcacgcagcacctctctctcatgtcatacttatgtccctgtggcgggagagggaaatttcttgtaaatatctgacgggaggaaaaagaaaatccaaggttgaattatagatgagttgactgggagcgtggatgcaacccaaaattagagaagagctacccattacagcatgacttaggcatagccttaaaacactgtggtgaggaaatattcccacagtgggcagagtttcaggcagaaaagtggcccaatggtagattatatacagattcatgaacagtggcggatggcctggccaagctgttcagacacctggaagaagacatctaaattatcaaagacgaagatgtctgagatagaggcatgtaggtggccaaatgggcatgaacactaagtataaagatcacacattaacacctacaagagaacatccacatacaaacgacactagaccccaagtagacagaataacttggttaatggacgtcagtgagcctccgtcagtggccactccagccctggcacaaagagcacaactacaaagtgatcacagtgaaataaacggaggcgatgtatgggcttctgctcagcaagtctggtcaagctatttcttcaccaaacgtccaacttgctagcaacagaggcccacacaaggtacccaagatggcaccatctctgaagatgaccaaatggccacttagagaaaaggatctgttttactatggaaagagaaacaatgcattctcacagaagtagacatatattccatgtttgggtttgcctttcctactccaagggcttacagactgtttgatccactgtcacaggattccacacagcattatatcagataagtggatccacttcatagcaaagggcatttgaaagcaggatggcatgggatccatctttcatattacacaatatgcccctgaaagctgcaggtacagtagaacattagaaggcctgctaacagtaaagcggaagcaccagctcagtggtgacgttttataaagatgagtcacaatcctccagaatgcagcatccacattgcagcaaagactttaaatagcactgtgtcccaaataggaacaatacataggtcagataagccaggagcgaaatcagaagtgaacttgcttaccatcattctctgtaggcactaggagactttgggctttccattctggcgactctaggctctacagggttagagatcctagtcctcaaagggtagcactttcatcagaagacacaagagtcctattcagcaataagttgtgattgctgcttggccactttgggttccaagccactttgggttcactaggaagtagcagccaagcaaaaaaatcaccaactcggcaaatgtaactgacactatcatcaagagaaagtagggcttctgttccacaaaggggcagggaggatggcgtgtgggactcgggtgctctacttgagttctctcttgtccctcagaactgagagagtacagtcactaagctcatgtagtgaaatccgtccatggacaccagctagctctctttagtggcagagatggctgtagcttgagctaagtcatcttgtaaatggtatgtcctggtcataaacaagactagataggaatggaattgcccatctgtcattgaacctaaaaacaaaacatcaaacacaacatacttaaataatgtgccctactaacaacaggagtatttaatcaaccaccaataattccacctcatactgaggcttcttcctaatgtggaaggatgagaacaatatgaggaattccagagcccgaggtatgagatctatgaaattgaaaccctgagctccttctttcacccaaactgtgaaccactctttcctaaagggtttggataatgggagaacacatctatctgttgtaggagagcccgtaaacctcacaaggctggacattcaagacagcactgagcaggaggctgtgagttgctttagctgaagatgggagctgcctgacagctgccaagttatctactgccaaaatctctcctggatgcaacagcccagatgttagagaatttgtatttgatcccaaaactgagggtgccttgtaaatttcacatatagttcactaaatccttgcgtgtgtggattgagcgaaagaagcaatgaacttagagtcagagatcatgggcttaagtcttagttctgcacttaagagctggtgaaattcaatatattttttcactgacacacacaaaaattaattaaccaaccaaaaaaattttaaaagaagagttaatggaaaaacaaggaagtaaaactatctattgcagtacctgacagttagtagagctcaatgtctgctagttagttttttaggtgaatttcaattattggtcttaggctgatctctctctctctcaatctctctctctctctccccctccaccccccccattccccaacccctctacaaaacatgctaaatttctacttctaattctctttagtaaatagccatgcacaacctctattgttacctgtgacctcctgatcataaggagctctgctcctgctctccctcatctgcggttgggcgctggtctttaatgagctactgctctgcatgtaaacacaaccgtatctaatagctgaagcgacaagagcatgtggattagaagggttgtgaaaatacagattctttgatgaacttttctagtaatgagtatttcaatttcttatttcgtagtaatatagtttggttaaaaaatgaaaacacagaaatatataaggaggtaaaagaaagaaacctataattctattctccaaaggtgtcatacataccttatgaaatgtttagtatccatttttctattttgccatgcgtatattaatatatttaaacaaaatggtatcatttaataaattctgttccaagttgaactattctatctgtcaatataccttgatagtgaagacgtttatgaatcactcatatcttaaggttcttccattaaaaaaaaaaagaaaaacaagaaattgattccagttacagtaacaagaaaaacactgttaggatattgggtagctcatagaattagtcgaatttgaaaacaggttgaggcaggaaacaacgaagacaaagccagagttggaaccggccctaggaatcctgcccgggacctcgcagccctgcctcccagcccgtgcgactgccctgggccctgaccgcttgtcaggaccttgcctgcacttggaaatgcgatgctgatgagtgaagaggcagcgcttactgtattcgctcacgtaggaaaggagctgtgtcctagatagtagaggtgaattatcttttcatcagtctctcaagtcattttaaggacctctgggccttgagtgcttctcggtttctggcagtttgggggcagcatgaccttcctgcaaaatggccttatgcacgagtgaccctttaagaatcactgttggttttctaggtttatcggtgaagtggaccatgtaatctgtgttctattcttagccgtccctgggcctgaccttgggggtggttcaaggtgtgtgaaactggctcttcacctgaggatgtttcacactgatgagctggggaagacgctctgcagcaactcagaagaaagcacttagttctgagagtcagatatttttctctcaggaccaatttgattctgtgctgttaaaccttatcttcattatcaagtagcactgattaaatgttcaaatgctcatagcgccgctctaggaaccatacaaaaagaattatcctgcccggtaggactttaaaatcaaaatcagagatttattacttacaaggcgtcacttggcaccccgacacggtaagaaggggccttccaatcacctcgacgctgcaggcccttgagaacactggttcagttcgtggaagtcttttccgtttttctcttccatgccatttaatcccacaatttggggacagaactgagtatacggagaaaacacacattagatgtacactatgattttattttgttgatttatttcattttcatagaatataatacaacagaatctttgcttcattggttttgaaccaatgttttcccaggcaagtcgcactgggtagttatatacagcgacagtgactataaaagagtttccgtgggccttgtccattgtcacaatcacagcagtctcacctcgtctttttggctccatgctctttgtaagccattcagagaaaacctggaagcggttcttcaataaacctgcaagcagttcttcaaataaacctggaagcagttcttcaataaacctggaagcagttcttcaataaacctggaagcagttcttcaataaacctggaagcagttcttcaataaacctggaagcagttcttcaataaactgttgccctgtacactacacccacggtgactctgtgctctgaatacaccgacgtgaccctgagttttctgaaatacttttttatattattggccccaaaaactatgatattatcttggaaattccaatattttgatactcaagcctcatctgccaagatttatttttatacttagaagtggcatacacattctttactgaatgatatgtcctcattttggtttagtgctacagattacactatacctttgctatcaatagcttctttctctccctactgccatcacaataaaaacccaaccttcagaaaaatcaatgcaatcaaagcataacagaataggattgacggagttgtggttatccaaggagatttcagatatgtcaaaaataacatgataaggtttcaataattttgtgcccaaagtgaaatgctttgctgtgttgtggatgctccctcggggaggtgttttctttcattttttgttattgtgaaagttcattattcctatgcccagggtgtctgtgtctctgtttcttttttactttttctttctttactttttttttttttttttaagatggagtctcactctgtcacccaggctggagttcagtggcacgatctctgctcactgcaacctctgcctcctgagttcaagtgattctcctgcctcagcctcccatgtagctggaattacaggcacccacgaccacgcctggctaattttttgtatttttagtagagacagggtttcactgtgttagccaggaccgtctccatctcctgacctagtaatccacccgcctcagccccccaaagtgctgggattacaggcgcgagccaccgcagcccgccctctgttccgttttatataatcagtgacaaatagtctgagggttgagatttggggcatttagaataatttttgtctcctccatctccttaggaaagatgtctgcccttttctcctattggagagggacaccgtggggatctttgagcagagtcaggcaaatccatgccgaagaggtgggcccgtgccacctttgcacagcaaagtagaagaaaccattggcagttggtgggcggctgttgcggggaattgagaagtccgcctataacagttttggagctgccatattcttgggcatggtttcagactaagaataataagaataatagccctcaaaatgagggctgtggctcttcatcatactagctctgctgtctggtgtcagggatctgatactgccaccaagcagcccagtgctttatgaataggatgaaactcttcacagtgtgaaagcctcaggcagcactactctccacactgtcctacagaacaatgtcaagattatttatagtcttcaaaggtacagtaagcctttttattccattcttaagataaacaaataaatcacaagcactttggggtttgtgtaaacagatacaaaagcaacataaattacagaccgaaaacttaatttataaataggagctataaatttaataatcgataatcataagtaatttcaaaatgaaataaaaagaaaagccccactagagaatattatgcaaatttttattaaattatctattctattctacctcatttcaggtcttaagaatgtgtttttcttatccataatcataaatagggagataaagggagataaactcatttcctcattttttattaaattcacctttcctccttgggtggaattttatgagcatctagagtgtcagtttttctcccaacacactgaaatgtttatagtatggctatttacttcatcaagctagaacatttttctattaaacacacctcagtttcaaagttatacaaaatatacctctactttgactttttgatgtatttcaaactatggccttatctgaaaacttaaaatagtagtcagctattatttttaagaagtacttaaggtagctgtcaatatttaacaatatataaaccatttaaagagtcacgtacctactcattgcaattttgagcacctaatatgtgctattataaagtatagaatgatgtcagagtaactactatcagaataacctgccgtaaggaaaaaaaaactattttaatactatttttaaaatatttgaagccactggcaaatggccaatgttgggtagacaacggagggaaaacaacccttgaaagaggtggactatactgggtgatatttgcatttgtgtggtttttttttttttgcctcagggcaccaccttgtccacatcatatgggacaaccaggattgaagaagatagccacagtttacaagcttgaaaaatcagacagcagttagaggtctgactttggggctgttataggagcctgaaaataaggtataaaattccagaagagaggagcagcaaaggtgggagcccctcaaatatacatgtgaacttcatctaaacttttctttggctgctctctcaactatgtttatgcacagcatggtgactatcattaacaatactatattgtacatgcctatagtcccaactactcatgagtctgaagtggaaggatcatttgagcctaggaggtcgaggttgcagtgagccatgattgtcactgcactcaggctggatgctgtctctacgtaatactactaataataagaataaaatatacatgactttttaaacaaaaattacagtagtgtttggtggagtttgtaaccaatacaggcatactttagagatattgcaggttcagttccagcccacctcaataagagtatcacaataaagtgagccaaataatttttggtttcctggtgcatataaaagttatctttacactatactgctgtctattatgtgtgtgagagcattatgtctaaaaaacccaatcaatatgtattaatttaaaaatacttaattgctaaaaaatgctaataatcatctgagccttcagagagttgtaatcactttgcttgtgaagggtcttgtctcaatgtcgatggctgctgactgatcagggtggcgattgctgaaggttgcggtggcagtggcaattttaagaaacaagacaacaatgaagtttgccacagcaattcttcctttcatgaaagatttctttgtagcatttgatgctgtttaacagcatttaacctagagtagaacttctttcaaaattggcatcaataatctcatacactgctactgctgtgtcaattaagtttatgtaatattctaaaccctttgctgtcatttcaacaatattcacagcatcatcaccaggagtcatttccatctcaggaaaccactttcttggcttgcgcataacaaacaacttcaagttttatcatcacattgtagcaattcagtcacatcgacttctaattctagttcccttgctattcccaccacatctgcagatactttctccactttagtcttgaacttcaatatcatccatgagtttaggaatcaacttcttccaaactgctattaatgttgataaattgacctcctcccatgaatcatgaatgctcttagtggcatttagaatggtgaatcctttccagaaggttttcaatttacttttcccagatccatcagcggaatcactatctatggcagctatagccttatgaaatgtagttctcaaataataagacttgaaagtcaaattactccttgatccatgggctacagaatggatattgtattagcaggcaagaaaacacattaatctccttgtacatcgctatcagaactctcagatcattaaagtgcccagatggcccaaagcaatatataaatccaattcaattcgtatcaaattaccaatgtcatttttcacagaatttagaaacagatcctaaagttcatatggaacaaaaaagagtcataataaccaaaacagtcctaaacaaaaagaacaaatctagtggcatcacactgtctgacatcaaattataatactagcctatagtaactaaaacagcatgatttttgcataaaatagatacatagagcaatggaatggaatagaaaatgcagaaataaagccacatacctacaattaagtggtctttgacagagttgaaaaaataaacaataaaaaaagacagtaaatggtactgggaaaattggctaaccacatgcagataaataaaactggaccactatctctcaccatatacaataattaactcaagataaattaaagacataaatgtaaaacttaaaactataaaattcctagaagaaaacctaggaaaaactcctctagatgtgggtctaaacaaaaaatttatgacaaagacaccaaagcaaatataacaaaaataaaaaagatagatcagaattaattaaactaaaaagcttctgtacagcaacaaaataatcaacagagtaaactaatatacagtataggagaaaataattgcaaattatgtcttcaacaaaagactaacatccagaatctacaggaaactcaaacaactcaaccagaaaaaacaatcccattaaaaggtgggcaaaggacataaacagacatttctcaaaagaagatatacaagcagctaacaaacacatgaaaaaatgctcaacatcactaatcatcagggaaatgcaaattaaaaccacactgaggtatcactttacaccagtcagaatggctactattaaccagatgcagacaaagggaaaacttgtacactcttagtgagaatgtagattggttcaatctccgtggaaaacaccatggaaatatctcaaggaactaaaaatagagcttccattcaacccagcagtcccaccagtgggtatctacccaaatgaaaaaaaaatatttatataaaaagacagctatacttgtttgtttattgaagcactattcacaatagccaagtcacagaaccaacctaagtgtcccatcaacagatgactagataagttttatatatatatatacacacacacacacacacacacacacacacacaccatggaatactacatagcagtaaaaaatgaaatatgtcttttgcagcaacaaggatggagcccttctgagaactgactgagaagcaaaaaatcaaatattgcatgttcttacttataagtgggagctaaacaatgggtacacatggatatagcaatggaaataacagacagtcggaactccaaaaggagggatggaatagaggggtagaggggtgaggtttgaaagattacctattgaatacaatgttcagtatttgagtgacagttacaccagatgcccaatccccagcattacacaatatacctatataatgaatatgtacatgtattcattaaatctaaaattaaaaagataaataaaatatactggaaaaaagaactcaagttactaggtgctttgtctgtgagcagaaatattttgaaagaaattttttttcctgagcagtaggtctcaacagtgggctgaaaatattcagtaaaccaggctgtaaagagatgtgctgtcatccagactatgctgttccatttataaagcacaggaagagtagctgtagcatgattctaaagggccctaggattttcagaatggtaagtgaacactggcttccactacatttgcccctaccaagagagttagcctgttccttgaagctttgaagccaggcattcgtttctcctcttcactaagaaagtcctagatggcatcttctttcaataggaggttgttttgtctacactgtgaatttgttgtttagtgtggccaccttcatcaatgatcattacaagatcttctggataacttgctacagcttctccactagcacttgctgctttaccttgcactgttatgttatggagatggcttatttccttatctcatgaactgacctctgctagcttcagacttttcttctgcagcttcctcacctctctcagccttcatagaatcgaagacagttaggactttactatggattaggctttggattaaaggaatgttgtgcctggtttgatcttctgtccggaccactaaaacttctaacattaatgaagctgtgtctctttctcatcatttctgtgttccttggagttgaacttttccctcaggaacttttcctttgcattcacaacttcactaactgcttggtgcaagagggccagttttcatcctattttggcttttgacgtgccctcctcattaagcttaatcatgtctagcttttgatttaaaatgagagacatgcaactcttcttctcacgtgaacacttagaggccattgtggggttatcaattggcctgatttcaatattgttctgtttcagggaatagggaggcctgaagagaggaagagagagagagagagatgggggaacagactgtcatcagagcagtcagaacacacacacatcatttattgaccatttgctgtcttatatggatgcagtttgtggtgacccaaaacagttacaatagtaacaccaaagatcactgatcaaagatccccataacagatgataatttaaaagtttgaaatgctatgagaattattaaagtaggacacagagacatgaagtgggcacaaaatgttggaaaaatgtaaccaaatgagttgcttgatgcagggttgccacaaaccttcaatttgtaaaaaatgcagtgtctgtgaagctcaataaagcaaagcacaataaaatgaggtgtgcctgaatatatcatatatagtaacaagaatacaaataccagataaatgcatgtatacagatgcaaaattttcatatattacatgctacagcacaatattaactgcataaactataataatttaagggtgcatatggtaatctctggaataatttccaaaaatatataataacaatgcaaagaattgtagctaaaagaccacaaaacaaaaacaagaaacatgtgggacaaacagaaaccgaacagtaatatagtgaacttaaatccaaccataacaagagttacattaagtataaggtgactaagccttacaattaaagggtatgggttgtcagacagggttgaaaaagaataattttctttttgctttcctgtatggagactaccagttttaattcatagtatttgaattatctttcaatgtttcatacattttaattctcattttgatttattctttgatccataaattaagcagaattgttctgacatttacaatcatatgaaatgttttccttatcttttatgacaatttcaaatttaactgcaatcacataatgtagtctctgtgttacgcattttttgaaatgtattgaagtttactttgtgatttaattaatggtcgcattttgttaatgtacacctgaaataacacatattttctagtagtcagtttcagggtatgatacatttctgttcaaccaaattttggaattgtgtgattcaaatctgctatgtgtttactaatatttttctgttatctatggctaagagaggtatgtcagagtttcccagcaagatggcaaatgtgtccatttctctttgtccatcttccaatatctgctgcatatctgcagagcttgttttcttaggggtctttgagtggaaaattcctcctggtcatttaaattcttcatattcctacatgtaataatgcttttcaccttcaagattatgatattttacttattattaataataatattgctgctcagctttgttttgtctattatggaagcatctgtttgtgtccattctcttcagctgtttagccatgtcttgacaatagtgtatagtggttcttatttaatcctatctaaaaaacctcagattgttcaatttgcttagtccactctcaatttgtgtgatcatcgctatatctgaatttgtttaatacaagctttctttttatcttccacttgtttcacgttttctgtgcttctttttttctcttttgtaacctatttagaagaaggaggtagattctcaaattactcatttgtttttagggttttttttctacctttttatttccttttgtctactggtttggaaataatactcatctttatttctgtggttttacctgaaaattttcctacatacttaactaaataaatcaaagttggtatcttaacccctcccaaacagtgctaagaacttagagcaattaacactgatcagcctcctctcaattaatgttccattgttgtgcatagttttagttctgtttttgttccccatcacaaattaaacctttttgtaactatttcatatgaacgttttgggagtttttgtggtgcaagtttaccagtgtctttgttcaccatttcttctttttggtccttcttttctttagaccttccttctgggaccacagtccaccttctagatatacaatctttagggtttctaaaggtatgttggttgtaaaccctctcacattattttttcactcctgtattctgcatgcctatagccctcaataaataagagagagtcggtgctcaagtcactggaataatgagaatctctccacatccccacatcccacaacacactggaatttccctcagtcttggtgataccacccatagtaaaaggcaatctttttaccagcattaggcctaaggaacccatatggccagattagctattggcttcctccctagggctgggcatctgacctataaattaaacacaccatgtactatagtagcaagaggctgccatgctaatatgcccactttaaagtcataaaggctaatctcaagcaggttaatgatgctcagaaatcatatcacattttcctgatacattccttttcatactcacgagatggctgtttcatgccctccatttgctcatcaaatcttctgtacccttccccatcctacatccatctgatgacctatgccactgataaaacagaagccatcaggagaagccttccacaagctccctccaccacatacttgcatccccagcacctgctttccaatactatgcttgtcccctatttctgaactactcatgctgccgtttacagccacccactacgcaggaacaccaaaatatggcaaaagcactgctccctgcagcccttcccacccttcccatcgcctttcccagctctggcccaggtcattcccctcagcgtgcaaatgtgttgtcatttctcccatgtggaaacaaacccgctatggaccccactttcttctcttggttccaattatctgcccctctgctcagcaaaatccttgaaagctgtccgtccactttccacttccttgacttccttttctctttaacccagtccaatcaggcttatacccccactacaccacaaaaactgtgaagctcacaaatggccgcgccattgctgactcctgtggttattctgcagtctgcatgtcatctatgtcgtttgcagtctccatgacataggtgggcaggtcttcccttcctcactcagtgtctatggtcccaacctcctctagctttcttcctgcctcactggccactctttctgtctcctttgctggttcctctgtgtttctcagactttatatgttttgagtgtctctagtccggtccttgaatttctttcctgtgttttcctctgtgaagatcttattcagccgcatggctttaaaatcatctacatactgatctctctcaaactggtaactccaaccttgtcctctcataagactccaaagtcatttatttaattgcgttcttgtccttgccaccaatacgtatctcaaattcaacaggtccgaaaatgagctcccatgttaccctaatcctcaaaaataggaaaaaataaactgatctcttcggtcttccctgtctcagttgatagcaattccttccttctagttgctttaatccaaaattgtagtctccttgagtcttctaattctctcatatattcaatccgttagcaaacctgctagctctgtcttcaaaacacacccagctattttaatatgcccgtttctacccacgcttgcctctctatggtctattcccatcaccgacagccagagtgtcccctgttacactggccaggtcacatcgcttctctgcccaaagccctgcaggggcttcaggtctccagtgaaaggccaccatggtctgatcccattctgcctctgtgcccggcccgagcttcctgctacccgtcccctcactcctgatccgaccacagccactgccttaccacgctgggtacactccttggggccttggcactgtcgtggtgctctctgcctgttacagtccttgccaatatattcacatctgcacgactagagcctttatagtggtatcaaaatctcaacttcttagtgaggactccatgaccacaaaaattacagttgccccccacccctacttccttcccccactgccacagcacgtgttatagatatcaactattttgtttattgtctgtctgccctaggactttattccagagtcagtgcttgaccacggtttggtgcataataaatattgaatgtggcattatcatttttctgaagtatcatcacacacaatttaccagtattatcatcatggaagcttaatagaaatacaaatacaaaacaaaaataattttcgggaaataagaacaataatgtatttctaaatttctacctctgattctgtaaagctgatgaacaaaaccatcatctatctattcacccatccatccatgcctccatccgtatatttgcatgtaagtagtttcaaatacaattattttagtttacatacagacatttcctacttaggtagtgaaattaattcttgcttaggtgtttataatactcctatgagaaaattctgtttcattagtttacatttaaaattctcatctttataagcattttaaaaaatgttatcatctgcctgggatagagataggcagttgattcttatattcaacttaattgcattttgttgtcttattgtgatgtaaattacatgatattataatgcatctaaatatctgggaattaaatattcattagtgtctgtaaatcagtataaacctgtatctgagtattttgtatcttgaaaatacacctcaaagtaataccaaatatggcactgaatctaatggaacaatagaaaaaaataggagataaatataatgtaaagtatgtatcgtatttgtataattgagtattcaaagtgttttattatgaacatttccagagtcaagttctaaaatgttcattatcactgaatatgttgattgcagaattgaattacataattaataaaagatgataaatttcacaaaatcatataaaagttttcttagtcttttctaggaactaaatgtgttaatggtttcatgtatccaatgagattttttttaataaattgaagaaaatttttgtgttactgatcaattttttcataccttttactttttcagtcattaatttttatttaattatcactgagtcatagaaacaattcacaactattaaaataagtacgtttttcatgatgcctctttattctcactcttgattacttcacaagagtctcaggagagcagcagggaaagtgagaggtaaatgaagccagaatcgcaccacatcttccctcctgttgagcactggacaacagtacttgtgtgccttgttatggtagtcggttacaatttagtactgaaattaatgactaattgtgcctaatatattttcctggagattttagttgaagaaaattgctttgagttccaaaatattttcagggatcacttaacattaggtaactgggaaaagatcctgaaattgtccctgtggttaaaaaacaaaacaaaacaaaacccacctttattttccctaatctatttttaactttatatagcctaaaacactaatgggtaaatatacctttctgaacataaataataatatagaatattcactaaaaatgtaaccatgtgaggtataaattaaaagacattttgattaaaatatgaatcttgtaggagcactgagatattttggttttggatcacttgttttttaaaaatctaattcgatttgatatacatttatggaacaatgtgttcatccatggcattacgttaagtgctgacaagataaagacgacgtagtctctcccctcaataagaacttaaagatacttctctcaagttatgaaattaacctcactgaaaaaaaaatgtgatgaaaagtttacttcagacaagggattttgagggtttgcactacttctccttgagcataaactaatgggttttccttgagtgatccatattctttggccagaaatttacatttgacctgtgagacatatttagcctaagttataagaaatagcttaatctttctgacaaatcaagagcaaatatttgagtaatttttttgcctgaaatatgataggtgaaaaagacactcatctatgagttttcaatcattagataaatttagctgaaatgggcttccaaaattttctctgttagagatagaggaaatggagcagccacaaggaagcaacttcaagtatgataaaatcacttatattttgaaaaccatttttcaaattcttactatggatcagtgataatatggtaaacttgtttattagtaagctccctctacactgcaaaatcataaaatgtaaaattataaataaaacaatacagaatgtgatcttgctatgtttatagtaggaagttcaaaattaataaaacaaagtagctgtattaaggacataacagtaatgaaatatgtataaactacactaaaaagataaccagataggaatggctccttcaaatgtgagaaagtttggacatccaagtataagagctgtgggtttcagtctgtaactggattttcattcaagcaatgataacccttccctggcatccatttcatgactgaatgctaattagataccccaagtttaaaatgtttctttttttttttttaagagatggagtcttgctctgtcaccccaggctgattctccctcctcagcctcttaagtagctaagaacaggcacgcaccaccacaactggctaaattgtataaaaatttttgcagagatatggtcttgctgttttgtccaggctgttcttgaaatcctgccctaaatcaatccttccacctcggcctcccaaagtgctgggattataggcatgagccattacacctggccttcttttgttctttagtctttaatgatttctgaatagcctgcttagatcctctctagccaacacatgcgcacagaccccaaatttatgtaccgtaaaaaatgccaacccctaaatcaatgacctaaattaaaatccttgctatgcccttagccagctatatgaagatgaataaatagaatcagcctctcttggcattccctatctgtaatacaagtttgctgaaaaagttcatctaaaacggtagtcttagccccgggctggtgtgcatatggctctgtgtatttcctcatctgcagtggggccaaaggtgttcatacagctattctcgtgatgctgatgggaaaatttacaacaaaagacttttgaaatggatataaacataaacataaatgtaagttaaaaagttttggttatcatatatgtatataaatttttctaataaatatgagtaactatcattacttataatatggtaattactaatgtttttatatctagaaatcatatataatatgtaattatataacatataatattatgcacattataaattgttactatgagaagatatataagtatggttgtatataatagagttaccacatataaatatatatgttgtatgtaatagagttactatatgtaaaatatatgtttactataaaaataagcaaacagatagctcaatatatagttattcttaaaactcaacgactttgggccgggcacggtggctcatgcctgtaatcccagcactttgggaggccaaggcggatggattacgaggtcaggagttcgagactagcgtggccaacatggtgaaaccccgtctctactaaaaatacaaaaaattacccagatgtggtggcatgcgcctgtagtctcatctactcaggaggctgagccagaagaatgacttgaactcgggaggcagaggttgcagtgagctgagatcgcgccactgcactctcgcctgggagacggagcgagacttcgaaaaatcaaaaacaaaaacaaacaaacaaaaaacttcaacaactttggagaaataaattattttttgaaattctgcttccagaaaatctcttatttgctttacactagcttaattttttgtttctgaacaagaattttaccatgtgggtgctgcctgtttccagcagtgattctctacgagtggattaaaatagccaaccctttggataaagaattatactccatggtttttcatgtgctaatgtgcttagtaacaatgtaatgaggatcaactacaagccacatactgtgtaatgtcaatgacacgaggctaaataagacaacattcctacacttgagccactcatcacctggccctactgaccatgccatcttggaataaaatctccagttcttacaaatttgaaatccatacttgtttattataaatggattataattcaaattaaaacaaaatatgaaattccaccattatttttatagttaactttgtttcatttaaactcaaataattttcagttaacagaaatcacattaattactcaagcaattcctctgaacacttagggaccctgctagactgtggggataaaaccagctatgctcataagccacctctttgaagaaaaaaaatgttcttatatgtggtgtctgcaaattttgtggtataaatactcctactgcagttgatttcaaataaccacaatgtaaccaccagctcacaaaatcctcaaatatttaatgatcatctctcacaagcttgtattagccagctttagcagaccactagataaatcataaatatgttctatggtagtcttcatatcttagtagggagaaacaggaagacatctaacaggatcattattttagtaaaagttctacgggaacccaagaggaaggaatgctagaggccagggaaggctttagagagatggggatatttgaattgtgtcttgagggatgagtaggacttccccagggtgacaatggttctccaggtcgagatggtgtagaaacacgaggatgggatgtcttgacagaaggggcaatgtagtagaggaaagtgtgtagagcatagtatgtttacattttgcaataatatgagatgaccagagagatgggaggggccaggaaagaagaggtacatacagtaagaattggggatgtgaggcagagcggctaagaaggcacttgtgtgtcatattaatgagttaaaggggctttggtaacttccccaattgagtagggcagtgccatgctgggcttttcattttaggaagaacactctagaagcagtatagaggatactttggaggtgagaagaggggtggcaggatgacttaggaggcagctgcagtgcactatgaaaaaataaatgaaagcttgacctgaaatgttaagtttgaggtgcttgtgaagatcctttattatttaaaacaaatctgcccaccctaaagaacaaccaagggggaaatatggttttaatgataacaataatgatgtttaagtacataagcatattctcctcaatctgttttcccttttcattatgggactttgttgtcagcagacaaatcttattgccttccctttcttggtgtaattaagatagtaaattgagtggaatattccttttttgtcatatctctatattatgttgcttcaatcaactgaaaatgtatttgactctagatgtagtaacaaatcagatgagaagataagaacaaaagggcatatttgattcacatgcacattctgaccagtccagcattcatcaaattacatattttatggaaattcaatgatcttgccaaatgtgtaaagaaagtgttaatcttaccttaaggggcaggccatgttttgtacaaaaaacaaaaactgctctttcaaagctaattcagtgcacaaaaaatctgtgtactgttcttatcatacatttatctccccatccaaatctttttccccagttttgaactaacacttgcatatttccaatgtagtgaaaattatttatgctctgtttgaaatctacagtgtcccagcccagtggtgatgtcagcacacataggtttcaaactgatgggtcttagctggcttctagttcttcatggcggttgtagtaaaggttccatgcagaagttttaaacttcaggcacttggaatcttacttccttgtggcatcctgccaaaccccaacagatctactgtttctttaggacatattagcaaaaatattagtgggggcagaatctgaacaccactcatgtatatgcctgcttgtaaagcttcttttctactaaggataaaagcattcattttttattatcagaggagataaagacaaacttttatttgaaggacaaattttaaacccatgtgaaaattattttaagagcatgtttatattagagcaattaaactaacgaagtagtatatcatgatgcagttacaagctggtgattttcaggaaaaattggttccctactgccctttttgggtaaacttaatattaaaaaaaatttttttggtactactgttagataggtaaagccctgtgaaagcccccttcctgccaactggagggtccacctcagaaattcccttcacatgtgctccctgggccgccaggtctttgagttagcgacgctcaggaacagagaagtgcagagacgtatgcgtcgcacaatgctggactggattcagcttttcttttttcttttttgaaactgatgatttctctgtcacccaggcttgagtgcagtacagtggtgcaatctctactcacttcaacctccaccttccgggttcaagcgattctcctgcctcaggctcctgagtagctgggactacaggcacccaccatcacctggctaatgtttgtacttttaatagagatgaggttttgccatcttggtcaggctggtctcaaactcctgacctcaggtgatccacccgcctcggcctcccaaagtactgggattacaggcatgaggcactgtgcccagcctggattcaaatcttaactcttctaattattagttctgtaacctctcagagattcatgtcttcattaatcacatgagaataatattgttcagtttatatagattttgagaaaacttcctaatcaccagtgacaaatgtttgtcatttagtgaatactcaaaatgttactttacttagcaagtataattgctaataaactccagattgaacggaaataattgagttaaactttcttgatattttcaagtagctcacttcttattttgtcttcgcaaccacaacttccttgccctttctctttttgtgtcccttattctattcttttacaaagttacagcagttaaagcatggagattcattctggagaagaatcagttttgtgcattctcctatgttctctgctcgtaatggaaccgtctccaaactgcatgcaacattgcaaacgcacagtgatgctacatatgtgatttcatgggataatatgatagtcaaatttttcaaagcaccaggaggaagagaaaacagttaacctatggtaaaccgtgtcaagataaactgatcttcaaatgacaaaattaatatataggcaaatgttagaaagaagcaattcaaggactgattgagaagctgatggtcattttctatgtatcttgaaaagcattacaaactagtatgatattctttcttcttgctcacaagtggaaacttctcctactgttcctaggctgccaatttttttcttttttccttcgcaaactagagcccattctgcactctctctccctgaggtacatgtgcctttccaaactaatatctctcactttttcccttcggttatattcttgtcctgtcttatttgtcctggtgccttaggggaacctttcaacacacctcataagggccagggagtccaagaacaatactcacttttatttccatacactccatccttcatccaaacagtcagttctaaaatatgttgaacttcaggtttaccagtgctgctggcagggacaggggagaaggaagatttgccagggagatttcagaagcacacagagcaagagggcagggagcgagggagcaccatgtcttggcttctcacctccctgtgtacgttaaacatcatgatgccagtttcttcagctctggctggtgacagtactggttcaaccatcccatgctttccccattctttcccttgtttgtcatcattgttaaccttgactttgggcagagacttcactatacaaaagctctttacaaaggaaatggatacaatgaaagaagagttttatttttttaagcgacgttgtagaagcaaagaaggtctagttttatctcccttccaccttttccgttctcattcttattctcatctctctcaggcaccatagacccatcagactccttccttgctgcctccctcacagggtcatgaagttttccttgtgcctggccccacagcacttcatgtttctctactgagaaacatatctaggacaagatacagtgcttgccttacacatatcgtatcctcaagattggtcaaatctaatcgtgcttttcccacatactagacataaattatttgagggtagggattgaatcttctcatctgtccataactttcagcactgagcacactgccctgagcaaggaaaatgccctatacattttagttgagttaaattgacaaagactgtcgttttttgctttgccagataaggataacgaaaagtccaaatccatcatgtcaatctcttcattaaagttcccatttccttaactaattctaattaaggcattaaggcaagtatagtggtaaaaatccagtctttggagccagaagaaaaaggtgtaaatttcagtattcagtagaggcttaggtctccacatctgtgaaatgaggtaaggccgtcttcatggaaatgctgtgcagaatggaagggtttcatgtactaacgtgtatcccaatcccaggagggtttatgtgtagaagaggaactggaaacagcctagtacattcacaatagaggaacaattcaaagggtgaggtctcattccagaaactcagctggatccctgtctcccacatttaaacacttgatttccctctcatttattttttcttatgtcacttaagatattaattacaaaaagcatgcagtacataatttgttaggatattttctaccaagtgggcctaaaaccagacttaattgaaaatgatccaaggttcattttccatgaaatttttctgagataaagcaagagagcaaagaaagaaagattaaatcatagaaaataaggcaaatctacatcgctccctactctgcttactttttgcataactccaaggttatgagcaatacaatgctgagaacctgcaaatgaacaatttggggtgggtgttcgctctatgtgtaactccaacagggaacatctaacatctttttcaaatacttaagcgaatttaaagaatcatgcccaagggttgactaaagctattttattgtaaagaattatttaagcagctcttattcccactcagtgaagtcaagacattctaaaacataatcttgcaagctaggttgagtcattctgccaagggggctactgacaggatatattcttgaaaatactcctttatcaaccctataggaatgctgtgcaccctttttgattatcacaaatttgtgtttaaaatcttgatatttatgtactatgtactttgaatacatgagcatgatactttaaatttgctaaagtatttgaaaaagatgttacaggtattcactgttaagagttaaacacagagtaaacacccattccaaattgtccattaacagctctcagtattttattgttctttggtattcttgtatataatatgatatatacgaacaggttaaatacattagttctttgcttttgtaagtaactcattacaaatgatttgagaaaattaaggtagacttttacatttaaagcatccttaagagatttttaaagtaaattgacccagaaggtcctttaaatggaaacagttgggattctaaagtaaattgacccagaaggtccttcatatggagatggtggattctaatgcagacactggaaagaatgtcaagggagctgtaatcaaatactatattttggctgttggtaatttactgaacagttgacttttggtaatttatgccaaaggtgctttgatgtataagtaatctattttcttttcacttgcagttcaagtactttgggaaacacattcactatttcagaccattcaggcagcttattgctgcaatacctcagggaacagtttattctttaagaaaatttggtggagtgttcttgaatttttgttttctaaggacctctgtacctataatctaaaattttagtatctctatttttctagaataaaagataccatgcactaaagccaccagttcaaatactcttgtcaccctaagagctcttgaaattgcacctggcggaaagcatttcccagctaactggaaataaggaagagttccctttcccttaccctgtttgttcctgaaatgctcaagaagcttcatttctaccttcagaaaacaattgcaagactgcttgtactttccttagctgttgaagttcctatgtctaaggatgtaaacatttgttttgagacagtatttcttttaattatatatcttagaagagcaaatagcctacctagcatatttaactcaatcccttcagaggtccccagtgagaatttatacacctgagccctaaaagtctggggtcattcagtgtttctgaagggcaggcaggtggatatcaagtccacatctttttaggcattacttttaattactttaaaagtaaacacacttcccatttgagttgtgtttcttccactaatgagataacagagcagtgttcctaggacactggctgctcctcagtgatagcaagtaaactgcacaagctacatctgtaattggttttctgatccagcctcagcaaacacacgtgagtgaagttcatggaagggataaacggatttagttaccttcacgagctaccttcaaacagcagtttaattttgtttccttatagcagcttccctcccccagcccattagagcttcttgatttatgatacagtagttgtagctttcccaatcaagacaggattttctcctgtcagaaaatgtggctccctaggataccgccctgggagagtaaatgagattctaatagttccagattatcactaaaggcagggtcaaggaaataacttttattttctttctattaaccgcacatagcaatgaaaattctcaattaataggttaatttatatgatttatagttcaatatacagaatattaatcatgagacattaaaagaaatgcttcctgttaatatcacttttctatagtatctaagtcgctttataagctacatgatttgttacaattaggcaggcatgttacttatgaaggtcaacataatattggaagggcccaagggccatttgtttttactaatactgtacaattttcacttaatatctagaatttgcttccttggtcttacaaagtcaaattcgtttacaatggaatctgttgctattttttgagtattttgtgtatcagagcctccttgtaagtggtttgctatcaacaaataatcaaacaatgacaagctggaggtcattacccttgaaaaacttcattggtttagaaattcaattcaaattttgtaccttattgttatcaataaaatttatggctaaatagcagtaacattacatgtgggatgtctacttgaactaagcacggaatctgttcccaagatcttaggatctaaaaggggaaaccaacaagaagctagaccatttgcaacacaatgtgaccagcggtgcaagccatgtatgaacatgcgtcctgatagtgccccagctgggagtgtctctttgagtgacctttaggccagcacctcctagatacttggtcattttactgggaactccttaagttcagtcactggttacctgcataattggaaaagagtttttatggatgactttaggagccatagcagagaattagctcctaaagtcattcttgactcttctgcaatcagaaaagcaccatgattaagtaacagtctctatgatgaagccacctagaacaagcagatcttgaagaggagtgagtctagaaagtgaggttagtttttggcctctgtggagaagggaggtgctggcgcaacccttcacctgcaccccagttatgtgtatttccatttctaggtgcaagaatggccctgcagcatgtaaagaaagtctacgtagaaaatattttaatttataaatttttaatctaaaaaatgtatgttattctccattacaagttgtagggtgggatatttaatcccacagattttactctattgtgtattagaaaaacggagaaggttaatgccctagatttaattcagatgatttaacatttgaagttcctatcccgtgagttctgttctttgcatgagagagccagtgcacacacacctatgttaatagcagcaatattcacaataggcaagaagtggaagcaacacaaatgttgattgacagaggaatggagcaacaacatgtgatatacacttacaagggaatattactcagccttgacatcatagaaaatcctgtcccatgctgcagcatgagtgtaccttgagaacattatgctaagtgaaataagccagtcacaagttgacaaatactgtacatttcacttatgtaaactatctaaaatagtcaaattcatagaaacagaaagtagaacgctggttaccaggggctaggggaggaggaaaagataaattgttgtttaataggtacagagcatcagatttactagatgaaaaggttctggagatctgtttcacaacaatatgaatacatttgacactactaaactatatacttaaaaatagttaagatagtaaattgtgttatgtgctttttcaacaaagagatagtctactgttttcacattttaaaacattactatgtcagaaatcttgactattgaaatccactatatatatagatgtaggctcgaagaaatatagtaccaagtaagcagtgcatggcacacatttctgtcacgcaactttaacagagggcctgcagaaaaggcagtgaaaatagaccaaatatgatgatttaatcctgacctggaaaatgatttagatgaactcataaggttccctctttctcacttatctgataacaaaattgaaatacccttaaaaaggaaatataagctcaccattgcatataacagatctgttgtttggaaaatcagatctcataattgtatttggggagggaagaagggagggagggaaagaaggaagaaaagaaaggaaagaggaagagaaggaaggaaaggagggaggaagacagggaaggaaggaaggaaagaaaggagggaggaaggaaggaaggaagggatggaagggggagggagggaaggaaggaaggaaagaaagaaaataaagagaggaggggtagagaatagagggcagaaagaaggaaaaaaggtaggaaatgaagcctggatgcaaaacctaattcttaaagaaagctttatgacattctcattattcctacagaacctgccattggaaagacacatattgcaaatgacgtggaacttacaaagaaggaaacaaactttctgagatctaaagtgtagttctagaggcccacgtatttcattctctgcaaatgaaaaccagagtgtttttattcattccgcatttttccctagagatttatttggctccagaggagacctatactatatgcttaaaatgattggtattaatgttgactttcagacagccaaaacgtttgagatgtaacagggaaggactggcaagcttcacacacgtaggcattattctatttgctatcatatttgtgtgagatatgtttattgcaaaatgcagattaccaagtgaaatctgggcaagtgtttcgaggcaatcttgagcatatgcttatggtaccagttaaaacattttagactgagaatgagaagggcttaagagagctactctgctgggcgcggtggctcacgcctggaatcccagcattttgggaggccgagacaggcggatcacaaggtcaggagttcgagaccatcctggctaacatggtgaaaccccatctctactgaaaatacaaaaaaaaaattagctgggtgtggtggagggcgcctgtagtcccagttactcgggaggctgaggcaggagaatggcgtgaatctgggaggcagggcttgcagtgagccaagatctcgccactgcagcactccagcctgggagacacagcgagactccgtctcaaaaaaaaaaaaaaaaagcgagagctactccaagaataatgactgtgaatatcagaaggacatatttaggcatgtttcattctaccagtgaccaagaagtgattatcctttacatggtcatttcactgagaaagacaacaaagaaaatggctgagaaaaaagatggttgataataaatagaatggaatgttggcacccacagaaaacaaatctagaattggaagactatgaatgtgcacatttttagattgaggtgagtgagactgtggggaaagcaaatgcctttcttgagtttgtgagtttgaatatctctttgcctctctgtactctattgtcttttaatctattaaagaaaatagtttcattatactttctccttttaaaaccaagaatagttgttcttttctttcctgatggaagaaatctgtcaaatgatagtttggatgtgtttgctgttttgatataaagactcgtcatgactagatgacaaaacagagcagcaatttcacattctcctatgaaagacttaagcagttgttttctgttgccaaaaacacccatacagacttaaaagcagatcataactttcgtagttacgggctttaataatggaaggggtgtggctatatctgaggaaaatatattttttatcttatctttatgatgcaggttaactcttttagtgaactttgcctgaattattatgctttttacttgattgcactgtatttgaagatataatttgtatttcaaatagcactcagcaaatgtatgttaaacattcagttctggcctggggtgatgtctcacacctgcaatcccagcactttgggaggccaaagcgggcggatcacgaggtcaagagatcgagaccagcctagtgaacatggtgaaaccctgtgtctactaataatacaaaaattagttgggcatggtggtgggcacctgtagtcccagctactcgggaggctgaggcaggagaatcacttgaatccagcaggcggaggttgcagtgagccgagatcacaccattgcactccagcctgggcgacagagcgagactccatctcaaaaaaacaaaaacaaaaacaacaaacaaacattcagttctataatatttgttgaaagctaacactatagggaaggatgttttgtttttgaaattttctctcactttctattttttaattgctaggaaattacctgactgacagaacactttctagtgttttttcttagaattacataaattacagaattgaattatttccgttcaatacaagctaatgtaaatcttgactccactcaggaagttaagtagcagtgttctaggtatttacgcttcatcgtgctatctggagagtaactcatacctgtcctgaacagaaaaaaaatagtggtgatacaaataagatgttgtataccacttttaacttttcacagttttttcttgtgtgacttttaattctcacaacagtggtgtaaattaacttgggtgtacagtgaaaatcaaagtgtttaaatgcctgagcttgcacacatatgtagtcactatggaatccaggattttgtatttaaatgggaatatgtactcagctaaggctcagggaaaaacaaaggaaagctgatatacaccaggcgcacatacacactgacacccaggcacacacacacacacagacgcccaggcccgcacacacgctgacacccaggcctacacacacgctgacgcccgggcgcgcatacacactgatgcccaggcaaacacacactgacgcccaggcccacacacacacggacgcccaggcgcacacacacactgacgcccaggcgtgcacacgcactgacgcccaggcacacatgcactgacgcccaggcgcacacacgcactgacgcccaggcccacacaaaccctgacgcccagacacacaaacgcccaagagatttcgcatgtaatttgcaatctggctgtgtctgttctcagtttggagtttgcatatatccatacttatgtttgtaatcccatgatagactttatctttttcccattactcttctcaattctttacccttcttggatgcgtaccctttgccatttgactagtgacagagcagacttgcctgctttggtgcggctgggcatggccgtgtgtttggctcggcacatggtcagtggatgggtgttagtcacagtgtgccagctctgagcatcagcgctgggaggcattgcaagccacagagctgtccctattcttctggtcttgggtagcctgctggtccaaggagaatgaaagacaagtggagcgtaactacatctaatatgaagcttggagccagcctggctgactcagtccaggtcagctggctcccagatgaccccagacacatggaaagagtgccaagtgtggttttaagatgctaagttgtgggttgtttgtttcctggcactattgttacactagctaatatcctacgtattatgtactatcagcagccatgaaatatgttctaattcatacatgattgtgaatcctcatgcaaaaaagctctttttcttttctattcttagggtatagtaaagtagcctcttggatccaaataaagtgagctcaataatattcattgttacataacaaatagccacgctaagaatgtgccatcataatttaatcacactatactgatcatcaggattcttctttacaaaacagagaagataataccttttcattccaccccttggaattcatttgttcatttactagcttattcaattattagctgttgagaacctcttattttcctaggatataccatggaataagataaagcccttaatgacacaggcttctaatctattcggtgacatagcaaaaggaatggctacttttcaatacaatgaacacgataatgaagctaagttcttggtagtgtaggcagacagtggagaatattttaggcagggaaagcaatatttgagttaagccttagaggactggaggaggggaggacatacaaacttatattctcataagcttaataagtacaattagaaaaaaaataacttgacactagacaatctgtttaaacaattttaaccaaataatcaaggttaatttaactaatagtgagacaaatgaacgtcttctacctcctgatccgaagcactgagaacacagtattacttatgcagtgctttttgctaaaaatgcataacctgaatctaatcgtgaggaagtagctgacaaatctgaattgacagacattctacaaaataactggcctgtacccttttaaaatgtcagtgtcatggaagacaaaggaacacggtggaactgttccgcattagaggagacttaacagcacgatatcttaatgagtttgcagcataggacgtcattgggacaattggcaaaatatgaataaaatctatagggtgtataatagtattatataaatgttgattttctaattttgatatttgtactatggttaagaaacagaatattcttgttttgaaataaacactgaagtatttaggagtaaaggggaaaaatctgcgtgtatgtatcagaaaaaccaacacttcttcttcccttgcacagtcaacacaacagaacgttctgtgaccaaagtgtggtggatttctccaagccaacaactcattgtccagcagacaccaactgggtgtcctgcaagttatctggatcctgacactcgccggagtcagtgcagaacccacaggggaagagcccagtcttgtaagatgccctcacttcagcagcccatcgcaagtcccacgtggcgaccttgtgacctgtgcttctgactgcccagctatccacagggttttctggaccctctcctcaggtttaatagtttgtgagaacagctcatagaactcaggaaaatatttaacttatatttacctacttattatgaaggatacagatgaacagccagacggaagagatgcacaggacaagacgtgggaaggggcagagcttccatgtgtctccgggtgcagcaacctccaggcacctccgcgtgttcagcaatccagaagctgaatcccaaccccacagtgcaggggtttttattaaggcttcatcacataggagtgatgggtcatcaacgccatctccagcccctctccccacttcctggaggatgggtgatggggcttaaagttctaaacttctaattctggcttgttctttctaggggccagtgcacctcacccccagaaaccccccaagatttgttgcattcaaataaaagtgctcctgttactcaggaaattgcaagggatgagaaactctgcatcagaaacctgggtcaaagaacaatgattagaaaacaaaatgcacctaccacccccatggctcaaaaaaatcaaagggttttaggatctctgtgccagaaaacagaggacagagaccaaatatttattttgtattgtaccacaacatcactgtgtgtgtgtgtgcagatggataaagaggaagaagtgtggatagagcaaatgtggcaaaatgcaaatatttgaggaatctgggtaaatgatatgtgtgggaatttcttgtataattcttgcaacttttatgtgattctgaaattatgtcaaaataaaaattaaagtaaaacaagacaaaaggatggggaaaagggttgatcctagggtaaaatgatgacagaattaaaggtaccagaaatagtatgtatcaagtcgtgggtacatgcccaaacttgacatggaaaaataaagactaacggctctctcttttctgcatttagatgcagcattttactgtactaacttttctacatgaaaataaaactcacaaaatcagaatgggctctgaaggttgtaccaatgtcaatttcctggttttgatattgtgccataattacataagctgttaccattgggggatactgggtgaagggtacacaggacctcctagacatttctttgcaacttcctgtgaatctataattacttgaaaatgaaggtttgggttttttaaaaatacttttctaactcccccatacaaaggaaaatttattttgttaacctcatattgatgtgaataacttcgtgtactgagacttttacctctaaacaggactaagatttttcacatttatgttagtaaaaaaaattagtaaattttaaatttagtataaaatttccaagacccatttatttaatattccattttaggatggcagagattctctccttgactgaaatccagccagcctcctctgagctctcttctccactagggcccgaccttggcctatcaagacttgaacaaacactagcacagtttcccacagctgaaggccgcaaccctcaggtgaccccagtcccccataagtgcctgcctgagcaaactcaaggctgccaaaagaatttactgtttgttccagcccacacctgaagctggagcccctgcttcccagcctctgtgtgagggtaggagcctaacgttaactcatgtccagctttggcaaagagtacattttatttttatttgctctgtcactagggcatccacattagccatagtgctgcaggatttcacatttcagaaaatctcaagcaaaatgtaatcatagctcctgtgaattgtgcatctgctgtgacccagacattgtgctttcctttactcccacccattcctcatcacagccctgcaaaaagaaaacaacagcaacaccgtgcacaggccaagtggcttggtgatagggctagtacacggtggcggagactgcggacccagcgtggcacatcacgggatgtatcattctgctcagctcgtcaggctggcctgcaccagtgagcgctttgtgtgctaccaactgtcataattattgagctaaggagctcgataattatcagtggagaaaattccaaggctgatcatattagagctttacttaatttttgatacctgattgccgacagttttgaagcctgacctctccctcctcctctttgctcacatctgcgcaagctgatgagaatgtgtgggctgctgtcttttggcacccacaggaaggctctgccccaccagggaaccctcaccccagccccaccttcaagccaccacaccagtctcctttcctggctcgttcaagacatttttggatctgcctgggaattgctccctgatctccccaaaagctctcattatgtgagaaataaagcttttcctgttctcttggtgtatgtgtggaatcaccagtcttgacctctcaatcaaattttgtgtggggagtctcttgtacttcttcagagtggccacaaaaggatgaaccactgaaatgtttaaatataaagaaatctgtattttcaattcagttaatcttcaggccatagaatataacttgtctctcatatggagcttaaagttagcatttagttgacataaatgctccaaaattcacggtacacgttgatgctaatacctcgcacaccgtccagtaactaggcacatttcaactttcattctcaaagatgcaaagatttctggtttgtaaaagcagcttggaatgttctttctgtgaaaataacacatttacgaaaacacacttggtgtgcatttcttctgaagggaatatatatttctttatggagcttagaattgcttatgaaaacaatataaaacctgtccgtattctattatggccctatttataccttcattcctaataaatattttgcattcattactgacttttgactttgggtgtaatataaagaaaacataaaagcatgaaatggtggttacaattttcagttttaaaaagtcatcttaatgtttctttggaaaaacatgtctcctcatgaaaagaaatagtcaacaagttcatattttttagaaaaagttaaaagcacatactgccagaaaaactaaattctctcaaattatattaagcaaagacaaataaacttttatacattccttgctttagcattcccacaaatgcatacttgctgttttaaagaaaaatgatcagagagcacaagaaagttagtagaaagtaaaattttatacagaagtgtagctgcacatttcagtattaacagaagtcctgtaatagaattaccatgccatatttcaatattaataccaataaaaagaaataccagttttcagaagcagtataacagccctctgctgtaattgggccctccttagtgggagacagttttgactccctgttcttgatacacacaaagctgtaaatatggccacttccctgttcaaacccagaatggaaaagcccctgataagaaagtctcgcttagcatgaatttttaaattattatcctccagctatacttttcacctccatgcacagtatctatatcaaacaagctaaacagattcaatttctttcctccaagaatttgttcaggccatactcaaatgtataggctttaagtggggtgggtcagcaagagaacagccaacccaacatgggtaaatcttgtttatgagggtggaaagttttaatgctttacttgattcattgctagacaacctttccatccaagaggccactatttttacaggtagcttcaaagtatatcaaatataaaagaaacagaaataatataaagaaaataagaagccataaataatttcaatgtacttatttaaaattttattaagtagtcatcattaatttcttagatgtttgagagcaaaccgtgcataacgtgcctgagcgtaagaaactagcagtacagaagaggagatagaaatctgaatgcaaaataaataaaaataaataaaagaaatctgaatgcacgccggcaacagggtgtgatgagttcaattacagaattctctaccagacacagtagaactcgttagctttgccttaactacttacggtcaccaaagcagacattttagttggacatagaagaaaaggagtcagggagggcagggagagggtaaggaaaagggggtgggacactttttaggagtaaatggcctgtccgaagcacagaaatacggaagaccttgatagattctagacagtgtaataagagcaaactgttggcaagaggactgcgagataagactgccgggctgacggaatccatatacagagactggtgatggaggtccctggaaggccaattttctgtataagcaatggggaagtgtatcagtcagatttttttttttttcagagtcttgctcatcacccaggctgcagtgcaatagtagcatctcagctcactgcaatctatgcctcccaggattaagtgattctcctgcctcagcctcccgagtagctgggactacaggtgcgcgccaccacgcccagctaatttttgtagttttagtagagatggggtttcaccatgttggccaggatggtctcgatctcctgaccttgtgatccgcccgccttggcctcccaaagtgctgggattacaggcgtgagccaccgcacctggcccagtcagggttttctacaagaatcacaaacaattccagtcattttaagtggaaagacatgtaacacacaaagtaaaatattttcaggatctgtagaaggtctaaggagtaggtctgagattagcctcttggaatcgcattacacttcaaacaacacagactggagtaatagagctattctctctgaggccaccacactggaactatgctggaaataaggggttaaaactggcatctctgccaccaccacctgtcaatattcaggagcctatgtaacagacgctggctggctgctggaggaacatcatatttccatggactttcttataaacggcaccctccaaaactttcacagagacggactctgctcactcctgcattccaaatatctcatgagttcatcaatacagaattctagcatcaaaagaatctaggaagtgtaactgaactttccaatcttcccaaagagagaaaagatgcaagggagactgagtgaaccaacataaataatacagcagaaataccattaacaatgctatgcaaaaaaattgtatatttgaaatcttctaatatttcttatctgtcaatatagaaatatggatgtcatagaaaaggcataaattagaatagaagttttgcatatatatttctaacctgagtgcttatttataatatggaaatcggtttctaggacaaggaagaaaagagaaatcgctcttttatttaatcaggaaagtttatgaaaggcaggagattctgagacctctccataaaggaaaaggaagcttctttgcaaacaaagaataatgattcacttcagctctagagaaatgtatgaaggaagggaggaaaagagttgaaattcagaataagagtgtgattccattacctgaagaggcaaaagagcaggaggaaattggacaatctagggtgggtgaactccacagtatgcagaagctggtgttcttgcctgtgagggtgaggttatttaaagtagttcatcaggggaagacacagggtatctcccaggtccacgggaactggggtgtggaaatagtgtcaacactgttcattgaaataatgtgtcagctggaggggaatggtcagcctggaaaagcagaagtaaagttggtgggagttcagcaccatctgagcagaagtgaacccagaggcctccctaaagcagaattctttcagtacagcaggattgttgcagtgagcttacccaacaccaccttgatgacattcacactcatcacttttcccctcttgctataaaaagctaatacacagtcagtgacacagtgtttgacctttcagttacctgaacatcaggaagcacatgttgtgggtggggtgagaaggagacaagccctattgtgcatatgcatgtctatattatcttctatacataccttttcatgatgtcaaaagatctttcatctacagctacataatgttgaagtgtacagaaaaggaagctgagattgaaatactggagtgtgatgaatgaaacccagagaccaatgtcccaaacatagcccagtctgcatctcccacatgaaggaacccaaggaatgggtaggaatattgtgatactccttaaatcatagttaggtaaattattccaacacctgctacctaagtagcatttacccatgcctttcataggaaagagagtctgccaactatctattggaatagaaagtgaggcaggtggaagaatcttatttgtcagtgttagattcctttgcaatgacaaaaacacatctatacaggaagaaagctattttatcccaaatactgaatgcaactttgttttccttttgtcttattagtcacgtttccatatatccccacttaagtgacatgagatggatgggtttccacaaggatcagctggaggagtttcacatccatctggcaaagctgcatgaagataagcctcgtgttttccagggaactgcattgctctacagaggcaatgccgaattattcaattgctttatgaatatttcctcccattaacctctctctgaaaatttgctgatacgcattaagtgtctcttaaccaaaatgcttggaaccgggagtgttttgaattttttcagattttggaatatttgcatagacataatgagaactcttagggatgggacccaagtctaaacgcaaaattcattactgtttcatatgtatcctatacatatagcctcaaagtaattttataaaatattttaaataatattgtgcataaaacaaagttttgactgtatgttgactgtgatccgtcatgtgaaatcaggtgtggaattgtccacttgtgttatcatgttggtgctcaaaaatttcatatcttggagcacttcacatttcagatttttggattaggaatgctaaacctatattgccctgtgtcatgggtccctaacacaatccatttactctttacttatttatttatttattttaaaaatgtttactgaattcacactatgagcaagacattgtttggtacaaaagaccaaatttggtaaaacaaacaaacaaaaaacatgctcttatggctaagaaaaataagcgaggaataaaatggatcttaagatgaggaggatgatgaatgacaaatgtcacaattaatatatagaaggtactgtcacttcacctagggaaactgagaaagcttccttagctttggagccatgaaggatggctaacatttacacaggcataggtatgagtctcagtagagagccaagaagagcaggagcctgttgtgaaaagcagtgaattacttatttggctagtgggtaggaggcaggaaaagtaaacctgaagcctttggggatgtttgcaggtagctgtatctattgctgtttggtgcccagagtatatgactgtgtggcgtcatttaataatgctttagtggaacatttcaaagtagccccgcataaaatcgttcagcgtaagccagataatcctacctagtttgagaggcatttccaaactagactcctgggccaatttgccatattgctacattgtgctggggctaggatctgggccaatatgaatctagctttctttaaaccagttattatatctttgcatagtatgtgttgcatcctgggctgaaactgagccttggagggagcctaaaagagagtgaagaatagcaaggtctctaaagtcagactgcctaacatttcagttctggctggagactccagaataagtcaccaactttatgcaaatatcacctgtaaaaacaggacaataacagcacctgtctcatggagtcattattagaaatcactgaagtgagagctcaatagatattacctgtgatgatgacatttgagatgctcatggagttagtctgttctcaacattgctataaagacatactggagactgggtaatttataaagaaaagaggtttaatcagctcatagttctgcaggctgtacaggcttctgtttctgggtaggcctcaggaaacttacaatcatggcagaagttgaaagggaagcaagcccatcttcatatggctggcaggaagtgtggggaaggtgcctttaaacacacttttaaacaagcagatataaggaaaattctatcacaagaacagcaagggggaggtccacccccatgattcgatcacctcccactgggcccctcctgcaacactgggaattacaatttgatatgagatttggatgggaacacagagtcagaccatatcatgatgtaaggtgctggtagtttggctgacatttcaaacaaatctggctcaggcctagggtttgcagagtcacatgggcctacttgggaaattacaatagcagagcaaaccttctaaatacatttcacttccagaagctgcacttggatgaaatactgtctcctgaagctctgaaagtcccttttctgtgctgctcaaggaagctctaaagacaggttggttctgtgctactccaaatagctccaaagacaggtttggaacaatgacccataaaatgtccatacattttaggatactaatgaagagcaatactggtccaaagttcagtggtcagagtatgggtgtgtttgttttatttcagaacatctgtatagcattttcattgcttatacaatagcaggtatcttcagtattatttaaattgaacttctaaaccttctttgacaacataccacgtatccatttatacatacacactaaaaataagagggtgcatccttaattttaaatcagttgcatagatttcattgtatagatataattagtaattttcctgtttattggcatctcagttatttccaggcttctactagcaatattatcatgaataaattgtatgtatgttaaaaaataataagctcattcttagtccttgttgaaaaaattttgtgttacttttatgagcaggatgcaagactcagacaaacaaggcctaggtagctcatactttattctttttgcaacaacttttgaaaggcttggaatattctggttatagatgaaagatgctgttatttgctatttctcttcttctccaagtgaagttctaatgaaaccatgtgtggaagaaataaatcattggaaggtcaagaagcttcaaaaacaaagtttgaacaagttcctggtattgttgctgagtgttaaatattctcaacttatcatttgctcttctagctgcagttttgcacaaggaagacaagtgggagcaattaaatcctgcaccactcctcttgaattcaaggctgagccatttggacaaagaaaattggggaacaggagcaaagaccctcactgactgtgttcttttttccatgaattagaaggaaatttaagaaaatcactttgatcctttttctacctgtaatgttaaaaactgtaaatattttctttcattgagaattctgggatacagtagcagacttggtaaattttaaaccgaaaaatttatcagcgtttattgcacggacaaagcaataaaaaattgcatcatctaagatgccaagaaaccacatgtgatacagtccaaggacatccagaattcccatggtcctatgcagtagcttacaaacttaactctttttggaaaatatggacatacaatatgctgacgggcttcccattcattttaagtgtttttagtgcaagtctctccactctatgatttcttgataagttcctcataatgaaaattcttttgtcattatataccttgttagttctgattcttgtccttgggaatcaaagaatattagggttataggtgcaacatcactcagtcatttaggcaaaagcctttcattttaaagattaagaaagtaatctctgagcacacgaaaagacagtggagcattgcactttcatcttcatttcactcttttgcttgcaaactccttgagggtaggaatttgttttactcatcaataaatctgcagtaatacaacgtggagaatgcagttggtgcacaaacaatattgaaagattgtagatatctctgtccaaagtcacacagctgccagaaccagtggctcactgggatgagtcttgtgtctactgatcacccgttaaggatgttgcctctgaattattcctccaagggtttttttccccctgggatgaagaataaatatctgttgttttccttatcatgtaaaaaaagtgtatatgtttctgcaaatactagccaaagcatcctactttaaaacttctctttaaaattccggggagtgtcaccttgacaacaggcacagaatcttccaactgcaatagaaaattgacaaaattttttaaactcagtgaaaaaaataaaccccactaccagtaattaaataaacaaaatgaaacaattccttgccataaatttcagaagggcaggggaatgagaggagaaaataataataattttttaaaaaggcaaggaaagaagtagaagattgaggcttagctctgggaatctcgtaacctagtctccactctttgacaggtggtactgaggatatcaacagaattaagaaggaacatccaagactttacactaaataagtattcaagttgaagatgaattatcaccaggggaatagagtaattcatggtagagaatattcaacaaaatcgcagaaaagagtaaaaaacaggttcagtaaagatctactcttagtttagctttccccttcttacttgtgcctttcatagcctcactatatagaaatctatggctcagaagaaaaggtaaacaggtccagataagaagataaagatgttggggtttccagtttcatctcagacatgtaaataacctggaagtcattattcctgttcttacaacaataaaacacagaattaactgaaaataaatgacttctttgacccatcataaaattgaggttgcatggcgaaactccaccccgaaatctagaagacaggtaaatacagaaaatcatagtcaagatcagtttacccggagtggaagcccctgaagccatgcctggcatgcacattgagaagtgaccgggcaaattgctggaggctgagtgtggactgcatgagactgaaaaactctcggaactcatagtctcagggacaccccactgcccctgccacgcttttgtgattagacctccaaaaaaactctctctcctctctcttcccaacctaggttcttaaagtaaaaacgaaacaaaaatcctttcatgtttctgacaggaggagaggaaaagtatgtattttgaaatacgtccaaagcgttctgtataacaacacctactccatagaggaaaacttgaccatagccttatctgacttgtgaaaagggcaactaagcaactccagctactctagccttcttgtctcttctaaaggaaggttgggcgaaaaagctaagaaatacttttaagtcagagaccagggaacagattagggaacaagactaagatataattgtagagtacagaatgcttctgtagtcccgaaccttatcaccacctcagcagggcttccaagtaataacagtgggctgtaactgaaagagaggcaagatgcagactccagttaaggagggaagcagggtctaaagaagcccaaagacatcaggagagacaaaaataaaaacattagacatatttgaagcctctggaacctgaagctaaagtaaacagtaaacataagcaggattcctaggcagaacaacaaaacttcacactgaaggtctacttacctcagtttcaattctccaatacattaagtccagcttttcacaaaaaattttatgacatgttaaaaaggcaggaaaaaaacacagcctgaaaagacaaagcaaatgtaagaactaggctcagatataacacacactgtggaattgtcagataggaaattaactgtgatcaacatgttaatagttctaataaaaaaagtagacaaaaaacaaatgggaagtataaacagagagatggaacccctgtgaaactaccaaaaataacctgttagaaataaaaaattatccaataaagatgaaaaattcatttgacgagattatcaataaactggatttggcccaggaaaaattaatgagcttgaagatatgtcaacagaaactattcaagctgaaatacaaacagaaaagatttttaaaaagaacaaaattgtggaacaatttcaaatgtataacatgtatagttggaatatcagaaatagaagcaagagaaaacagatcagaagaaatatatgaagtaatagtggctgagaatttcccaaagttaatgacagaaacaaccagctacaaagccaagaatctcagaaaatactgaggggaataaatatatatttaaaattctattgggcatattatattcacatgatacaaaataaatcacaaaatcaaaaatgaaaaaggccagggaatgaaacattaaaaatattttaaaatatatgtctaaattacccacagaggaaagaatttcaaaagaaattacaaatattttgaagtaaatgaaaatgaaaatacagcttgtcaaaatctgtgagatgcagaaaaagcagagcttacagggaaatttaaaacattaagtacatatattaagaaagacagaatgtaacattaataatttgagcttccatgttagcaaactagataaagaatagtttaattctaaatcaagcaatgtaaataaaattagagcagagataatgaaacttaaaatagaaaacaaaacccagaaaatcagtaacccaaaaattgatctttgacaagatcaataaaattcataaacctctgactaggataactaagataaacacagaaaaaaaaagagtatcaataaggattcacccagtatataaatgcaagtagaacttctggctcaagctgccaaattttaaggtctctgaccttaaaagtatttcttagctttttcacccaaccttcttttagatgagacaagaagactagagtagctggagttgcttcattgcccttctcacaagccagataaggctatggtcaagtttttccctaaggagtaggtctcgttatagagaatgctttggacatatttcaaaatacatatttttcttctcccccgattagaaacatgagaggatttttctttcctttttactctgagaacctaggttgggaagggagagtagagagagtttacttggaggtctaatcacaaaagcgtggcaggggcagaaggggcatccctgagactatcagttctgagagtttctcaagtctcatgcagtccacactcagcctccagcgatttgcccaatcaccttctcaatgtgcatgccagtcatggcttcaggggcttccactgcaggtaaactgatcttgactatgattttctgtattagaaaggtgagaaaaagaaaaactatttgacaatttttcaaatataccaaagcagattttttttggagattagaaaagaatggagtatgcaaaatacacacactcctgtctggaagagtgaataaccagggaagagaagagcatcctgcaagacagtgtaataattaaaggaaataagaagcatgcaagttcaatcaaatacgttctgaaaggtaaaatcccaatgaaatgaagaggaatattggaaagctatcatcataaaacaaggaagaacaaaactatttttattaccaaataaattgggatgaaaggcaaaatgggcatagataagactaagtgatcaagtaaaaggaattttatagattagagaatacaaaataaaaacacaaattaaatcaattagagagtatttaatagagaggattagggcacaggctgaggcatggaaatagaagtggaattggtggccccgaagtaaagacaataaccacataaactttaaaaaaatgtaaagatatatttgagtagttttctttgagatgattgaatctgaagaacaaaaaatatatcacattgatttctaggaaaaactgatatagaaactgatatgcattcacctagtttttaaagtttaatattaaagtaaagaaaaaactttacagaaacccaggcataatatgtaagcaactgacacggaattttttcttttactgacttatactgaaaaatcttctaagtcaatagctaatgtccctagtgaaggatttgtaaccttcctttacacaggcagcctcattatagttcagacataaaggcagtagtcagacattctcaaatatgagagaacttagcattaggagaccaaaaaagtagtgaaaataaagaattaaagaaaacagaaatcatcccaaaagtctgataaataagaaacattcctattaaaaaacagaagcagaactagataaccaagatgattttggttataaaacagaatgccaccaatttataataccagtttagaccattctatatcacagactatagatacaataatataaataatttttcaaaagaactgtatttttaaacatataaaactttaaatttatattttaaaagcataaataataaaatttagcaattagataaaataatttcatcatctatccatgggtagtgaataagattcaaatatatttttaagtgattccattattatttttataattttacatagaaatttacaagaatctttaatggcttatatttttataattatacaattttaaaattttttccttttttaaaatttggtcatgtattcattattcactcagtcaaaataatattgagttttaaactgaacatagcatgtatagtaaagtcttctaacaattgatgattttcaactataacacacaactacaaaacctcagtggcaaacaacaaaaaagacctaagcttacgagtctgtgggttcagctgatacagtacaggttcagctcagctgagctcagtggctcaccctgcaggcagctgtgaattgcctaagagctctgctgacttctgctgggcttccttatgtctaggggctggcttactgctctgatatagaaaggtctcaaccagtatgactgggcaactccattctattccatgtgtctccttcttcagcagcccagcccagcctattcttgcggtgactgcagacgggaaagagcaagccagcctattcaagtaaacactgttcaagttttccgtgtgtcatgtttgcttatattcaattggctgcagcaaatcacaaggctgaggccatagtcacagggcaggtcagaccagtgttacatggtgaaagggcctaaatatagggaaagataaagaatggagaccagggccaggcacggtggctcatgcctgtaatcccagttctttgggaggctgaggcaggcagatcgcctgaggtcaggagtccaagaccagcctggtcaatatgatgaaaccttgtctctactaaaaatacaaaaagttagcctggcatggtggcgtgcgcctgtaatcgcagctactcgggaggctgaggcatgagaattgcttgtacattaggggacagaggttgcagtgagctgaggtcatgccactgcactccagcctggacaatagagtgagactctgtctcaaaaacaaaacaaacaaaaagagaattaggccatttaaaactctacatatttttttctctcactgagtacctattcatttaacaagctcctatctagctatctatctatatgcatattgagataaataaaatattctcagaagattgagtaacctaatataagtaataattcctaaacaaatacatttatatattgaagatacattaaatcatattttgacatccaggcaaccattatttaaagtcagaattggccaagtgtggtagctcacacctgtacgcccagcactttggaaagctgaggcgggcggatcacgaggtcaggagttcgagaccagcctgaccaacatggtgaaacctcctctctactaaaaatacaaaattagcagggcatggtggtgcacgcctgtaatcccagctacttgggaggctgaggcaggagaatcacttgaatccaggaggcagaggttgcagtgagccaaggtcatgcaattgcactctagcctgtgcaacaagagtgaaactctgtcacaaaaaaataaaaaataaaaacaataaagtcagtgttaaattcagattggagatccaattccagaattgtggcaagaaggactccacagacccactagtcttgccataattggtgaaagtctttttttttttaaagaagtttgttggttttttcttttttctttttaaaaataatttcaacttttatgttagattgagaaggtccatgtataggtgtgctgtattagtcagggttctcttagaaggacagaactaataggatatatatatatatatatatatatatatatatatatatatatataatatatgtaaaggggagttaatattaagtattaactcacatgatcacaaggtcccacaataggccatctgcaagctgagaagcaagaagagccaatatgagtcccaaaactgaagaacctggagtccgatgttcgagggcaggaagcatccagtatgggacaaagatgtaggctgggaggctaggtctgtcttgctgcttcatatttttctgcctgctttatatttgctggcagctgattagatggtgtccacccgattaagggtgggtctgtctttcccagcccattgactcaactattaatctcctttggcaacaccctcacagacacacccaggaccaatattgcatcctttaatccactgaagttgtaactcagtattaaccatcacatgtgctatgtgagtatattgtgtgatgctgatgtttgggatataattgatccagtcaccaggtagtgatcatagtacccaatggttagtttttcaatccttgccccctcgcttctcccgagtagttcttagtttctattgttgctatctatctttatgccacatgtccccaatgtttagttcccacttataagtgaaaacatgtggtacttgaaaaccaacaatttaaagtttttgaaaattgtcctaaagatatatagcaaatggagaaacttttttttatttttttattttattttattttgttttgagacagagtcttactctgtagcccaggatggagggcagtggggagattttggctcactgcaacctttgcttcccaggttcaagcgattctcatgcctcagtctttcgagtacctaggattacaggtgcatgttgtcacacccagctaatttttgtatttttttgtagagatggggtttttccatgttagccaggctggtctcgaactcctgacctcagatgatctgcccaccttggcctcccaaagtgctgggattacaggtatgagccactgggcccagccaaatgaagaaacatttattcaaggatgtctactcatcttggtaggaatagcaagagtctgacactgggtccacaacctactcttatctttctcacccccagcttagcatgacagaagctccactccaggtagacgtgatcaaaaaaaaaaaaaagaaagaaaaaagacagagtttctctctcctctaccttcaaactccataggaagagatatggtatcttcctgggagagtcaggagccagcatttcttagctccatctccctccctactttcagccctctattgcagaaggtaaatttcaagcaagtttggctaaaggttgggggctaccttgcttcatccagcccttattcgtaggacaaaggctctacaccaggtgtggcaggcccagaatattggaaccataactgcctacctccctgatcaatcatagggtggaggttgcatattgggagagacaagtcaagaagaccaaccaggggagtgaggagggctgccaccaccaaccaggagagtgaggagggtctgtggatggaaaattattaaaaggaacttgattaggggtacagggattcttgctcaacttgcttagcaagattccttattaaaactgttcttggcaagccagaggaaggtagcagactaagtttgaggcctagctgggaaaagggcctagaggagggtgactcaagtttggtcaaggaatgagtccttattagttgagagtaatatctggagacatcaataccccactttgaaaaatgaatgaataataatgcagaagaacaacaaagaaacagaatgcttgaataagattgtaaaccaatcacacctaagagataactacaggaattccagccaacaacagcagaatacatgttctcaagcacacatggaacatttgctaggatagatctatgccataaaataagcctcaataaatgtaaaaggtttgaaaccatagtttcttctccaaccatgatttttttctctaattttgaaattgggcattaaaaacagaaagaaatgagagaaagccataaatatgcagaaattaacatgtttctaaataattaataggtcaagaaaatcacaagagaaattaatatgaatattaatataaattaaaatacacaacacaccaaaatttatgatctactgctaaaatcttgcttagaagaaatttgtggatataaatatctttttttaaaaaaagatcattaatcaagaatctcaattttactgtaagacattggtagaagagcaaatgaaaccaaaaacaagcagaataagagactaagaaagatcagagaggaaattaatgacatggaggatagaaaaacaacagagaaaatccacactgccaaaagttggctttgaaaaggtctttgaaaagatcaacaaaattgggaaaaaaaaaaaaaacaccttttaagctcagcaagaaaaaatgagaaacagccaaattatcaaaaccagggataaaagaggatattattactgactttaaaagaaaacaaaaaggattataaggaaatactttggataatggagcaccaacaaattaggtaacttgcatgaaatggagaaattcctataaagatacatactaccaaaactaatgccatctgaagactatacactgtatgattccaattacagcctgtgcttcaaaattcatccctaccctgaccctaaactatggcaaccactgatttgttttactatctgtatagttttgcctcttgccctacaggtgattggttccaggagccctgtgtataccaaaatccatgtgcacttgagtcttgcagtcagcactggagaacctgtgtatctaaagtcaaccctctatatacacaggtttcacatctcatgaatattgtattttccatctgtgtttagttgaaaaaatacacacattagtggacctctgcagttcaaacccatgttgttcaagggtcaactgtatatgacattctggaaaaggcaaaactatagagacagtaaaaaatatcagtgcttgctgggagttggggtgggggtagggatgaattttggagcacagagaatttttagggccataaaaattcttcgtatgatactataataatggatacaagtcattatacattggtccaaacccacagaacatacaataccaagagtgaaccctaatgtgaactatggactttgagtgatttataatgtgtcagtgtaggattatcagttgtaacaaatataccagtcttttaggggatgttgacaatgagactggctatgtgtgagagcaggggaaatatgggaaatctctgtaccatcctcccaattttcctgtgaacctaaaattgctctaaaaaaaagtctttaagaaaaggaaagaaaatggcacatcaatatctcttatgaatacatacacaaaattctcaaccaaatactaggaaaccaaatccagcaacccataaaaatgattatacatcataaatgagaggggtttacatcagggatgcaaagtcagtttaaccttagaaaatcaattaatgtaatacaccatttcaaaggaaataaagggcaaaaaccacataattatctcaatagatgcagaacaagttttgacaaaatctaatttctttatgatgaaagcactcaaccaactagaaacacaagggaacttcctgtacctgataaagagcatctacaaaatcccccagctaaaaacacacaatggtaaaagactgaatgtttccccctgagaaaggaacaagatggtgatgtctacccttgctccattaattcaacattgtactggagactataaccagggaaattaggcaagaaaatgaaacttaaaatgccagaattggaaaggaagaggtaaaattatttccatttgtagatggcgtgatcttgcatatagaaaatcctaatgaatgcactgaaagaaaactattaaaactaataagttcagagtgtttggatatacaacatcaatatagaagaatcaattctattttcacacactagcaataaatattttgaaatgaaattaagaaaacaatttcatttacaataggatacaaaagaataaaatgcttaaaaatattaaaagaagtgcaaaatttgtatgttgaaactataaaacatgattgaaagaaattaaagaaagacatcccatgttcatagatcggaacatgtaatatttttatcatggtcatattccccaaattggtgtacatattcaatgtggtcattaagaagcttaacttaaaattcacaacaaaatgccaggacaaagaatagccaaaactattttcaaaaaagaaaaataaaattggaggacctacacatcctgattttaaaacatagtataaaaccacactagtaaagataatatggtgctggcataagaatagacatacagatcaatggaatcgaaattagagtccaaaaataaacgctcatgcttagggtcaaccgattttcatcaagagtttcaaggccatttatacgggaaacaactgtctttttaacaaatagcaataaacacctggatatctacatgcaaaataataaagttgggctcctccctcacatcatacataagatggatcccaaatggaccaaagacctaaaagtacaagctaaaactataaagctcttagaagtaagcatagaagtaaatcttcataacttcaggttaggcaaagtctactgaaagcataaatgacaaaagaaaaaaataggtaaattggacttcattgaaattaaaaacttttgtactttgaggccatccagaaaatgaaagtacaacccacaaaatgggagaaaatatttgcaaattatatatagaactttatacacacacacacacacacacacacacacacacgacttgtatctagaatatataaagaactcttgcaatttaacaatgaaaaggcaaccaatccaattaaaatatgggcaaagaatctgaatagaaatttctccaaagatgcatagataaccaaaagcatatgaaaagatgtccaacatcaatagtcaccagggaaatgcaaggcaaaagtcacaatgtcattcatgcctactaggatgggtataataaaaacgacagatctaagtgttgaaaaagataaagagaaattggaaccctcatacgacgctggtaaaatgtaaaatgatgcagcaacttagaaaaacatcgggcacttcttcctcaaaaggctaaatacagagttactatctgagccagcaatctcgctcttaggtatatacccaagaggaataaaaacatgtccccacaaaaacatgtacactaatgttcatagtagcattattcatcagaacaagaagtaggaataatacaaaggtcctttaactgattaatgaataaacaaaaggaagtttattcctacaacaaaatactatttggcaatagaaaataatgcaatattgatgtgttacaacatggatgaaccttgaaaacataatgctaagacaaaagtcagtcgcaaaagacaacatattgtataattccatttatatacaatgctcagaatcagcaaatctatagacagaaagtagatgagtggctgcctagggaggccagggtgggatgattgggtgtgatagctaatggctgtaaggtttcttctagaggtgatgacaatatataaaaatgtattgtggtggtagatgcacaactctgaatacactaaggaccatcaaaccgtacacttgcagtgggtgtgttttatggtatttgaactatatctcaacaaagctgttttaaaaacagattataccagtactggaaaacaattttctcaacagaaatcaaacatttgtaaattcatggtcatcagattttcatttacattttaattactaaatataaatcctaaatctaaatatatatccaaacataaacttgtttttctcatttttatgattatttagcttattaattgttcaattttaatttatccctctactgattgctgaaaatcactaaatttttttgaagaataattttagatagatttttaaggtcaataaataccttggaaaaagacactttctttattttgaaatgtaatctttcactgtttcagagtaaatacacatcaagaatgactcacatgtaaataattgcagataaaatccgggaactacatttgagcagagccagactgtcatcctgtagttcttcaaaggctttggaactgccgccagtggttacatattttgccgctctaagtatcttaaaatggaagaatccccctcatactttccataaagattcgcccaccacaaagcatatttgtttggagacctcctcagtgacatttcacaattgtgagcgtgaattatagattcctattacttaagcttttcatcaggcctaactctatgaattttgctagactttttatttttcactgaattctatttcaacctcatatccattgtggataacaggaatttttctctccttccggaaatccttgttttgtgtgtgtgcatttcagaacacatttgtgtgtgtgtatttctcttgaatcaacaaccagtgactgatctctgcagatctactgataaaggacatttattttacatttgtactttataatgtcatgtgataaaagttaagccaaaattctgggtgacaagtcgcctaaggtgtcttaagagctgagaacaagttatgttcagaatgcatggatttctagaatggatatcccaaacagctactatatacattattatggagctgctttctgtttcttgagaacttgcattttcagaaagcaatgtccctaaattaaaaatggcatttgaacctagactcctacataaatctgtagtgggtattacatatgctttggggtctggaattctaaatctagctcccgttctggcatcttcaattagtgccacttggaaaagatggctttagttcttctcacctcagtctcctaacatataaaatgtgtacaatttttacctacttgatagaactgttgagaaaactaactgaggcagcacatgtaaattacttcacacagtgacaaaaacactaaagtttttaatagtagaatttaggttgcacaatgtcttaaatatagaagctagatagtcaatatacattagttttaaaattctgcttccttaactttctaaaactatggagtgtagattatttgtataaatccatgtatatatggcaccacattaatgaactgtatagattaactatcttatattatcctgcttggtttgtgatgaagaggacagcttgctccatctttcagtgtaattttaagacagaaagcctgttataaaaccagtgaatttccaggccatcataataaaatttcctatgataataataatgtgcttttgttcaaaattaaaatatttgaagagatgagagttttaatattagtttcaaagactgacatgacttattaaaattatattaatttacgctcattatatcttttatgataaaaattttaaacctctgaagcaactctgagttcattctagcaataaaataaatatttcaacacctactatgtgccaggaagtttttaagtgcttagactgtatcagggaacaaaacaaagatcttgctttggggaagtttacttttctgaggagggagaccgacaataaactatacacacaaaaataagtcagctgtttagtatgtacaacagataaggagaattaagagttccattgtggtgccattttaaataagatggttagtgtatgtctggttgagaaggattttaagtgaaaccacttaaaagaggtgaggaaattagcagtgctgataattcagaagagtaaccagcagaaggagggccagggcaaaaaggccccagagcttgagtgttcctggcacgtttgaggaacagtaaagggccattgagttggaagaacagttagaaatgtgctcaaaaggtaacagaggagcttcatcaggtggaaacttgtagtccattgtaagtttggggaattttcgtctaagtgaaattagaagagttctgagcagagtggcatgctctgaccgatactcagaaggagcgctccagctcatatgttaagaatagacagcacaggaagaggcacagaaacagggagccgctcagcagggcatcgaggtagaggaaagagaagatggcggctgcagagaggcagaaaggaagccggaagcagtagggatctcgatttcggtatattctgaaagtgaagtcagaatgatttcctgacatagtggagctgggatattaaagaatgagggaaatcaaacgggattccgatgcttttcacctgaacgggaagacagacggagtttcaccaaccaagataggggaagctgtaagcagatcgtttgagggaggtggaaatcgggagttcagtttttggaaacatttagtttgacatgtgtatttgtcacccaaatggagctatcaaggggacagctggatacttaagaccacagttcaggacagtggtcttggctggagattatcaaaggaatgaaagcacgcagagtagacgatcaaggaccgaactcaggttattcaaacattaagaaagagacaaaggagtgacgttggagaaaaaccaaagataatgtaatattctagcagccaagtgtggaaaaaaatgtttagggagaaaggggtatacaactacatcaaatatttctggtaagtcaagaaatatgagagctgatcattgactattggttttagcaatctcgaggttattggtgatctctgacaaagcaattttagaggaatggatgaactgaaagccagatttgaatgccttaagagaataaggaaaggagaatctgagactatgaaaaaagacaatctttagaagagttttactacaagggataataagaaagtgggaattaagaattttaaagattcatgaaataacagtagtaaaggcaataattcagtagagaagggaaggctgatgatgtatgacagagagacaattatctcagaatagacaaagagtaggctgtcctgcataaatagaggggctgcacttacataggatcataaataatttgtggtttcaggcagaaagacagttggtgggtagatggcatgataggattctgcagaactttcttttggtttcctgctttctcaatgaagtaaggagcaagatcatcagatgaaagtgaagatgagggaggaagtattggagatggaggagggaagaagagaagatatgcaactgtcatcaagatgctcggatagattagcaaacataacagggttgctgggaacatcaaggacccacttaataattttggtcataaactgaacatgtgaatttaaagctggaccagtcattgtttttacccaactatgttcagttacatggatgcaagtatggaataagcaggagttggaattaaggttgtgttttcattttaagtactaaaaactgagttgatttgtttcccatagttgtaacaaattgtcacaaatgtggtgacttaaaacaacaggaatttattctctcactgttctggaggccagaagtcaaaatcagtatcaagggctatagacgggttgacagagctgcactccctctaaggctccagaggaaaatcgtttctttcctcttccagcttctggtggctgccgcatttcttggcttgtggctgcatcacaatgagctctgccctcgtggtcacagggccttctcttccatgtgccaactttccctctgcttctctcttagaaggatacatatgactgcacttaaagcccacaccaaaaatccagaataatctctccatctcaagattcttaatttaatcacatttccaaaattcttttttttgccatataaagttacctttgcaggtccagggatcaggacatgaatatctttagtaggggccttacctagcacagcacactgaaaaaaggaaagggagtgagcacatattcaaagtgaggttactatcattggccatgaaatttaagctttgataagttgttttcatagattaagtgagctaaacagaggaggtagtggtcaggaaatgttgacttataaaaccaaaatcatagtgggccagtacatgtcggtaatgacaaggtctagttcatgtctgagatcggatggaagacaaaattatcggaaaagaagaagtcaaattgagaaagcaaacagttggaaataccaccttcaggtagattaaaattgtcaaaaattaagagaaatggatacagagaataaatagaattagtaggtagaaggataaatgaaaatgtgatagatttaaattcatactgttcactctttatatgatatgtatctgtgtgtgaaaaattccaatgtaaatccttctctttccccaggtaactaaattatgccacttgaagttaaaaaattatcaaaattcaattttcattgagagggtttttctaatatatttttatgcctgtgttcttaggtaaatgtagcctgagatatagacatgagtttatcccttgagttggagtgtgtgatgatgctccaggggtcttttgaggtgtctgaaaatgtttacttttactttcgctctagacagctgtgtgttttaaatcttgggtctgctatttatattttctattacctttcttgctgcttagctgtcatctgtcacttacttttgttgtcagtgtgcttttaggcttttgcattccaatttgtagtttataagatgtcttagagagggcaaacagggagaaaagctaattataattgtgttctaaaaatgagaaatgtgactctgaatgagatcctttgcttctaaattaagtttatggactacaaagtctacgaacagatagtctatgttgtatggctatttctcatttttacttgtattacggatgtctgcaaatttgctattaggtgtctattcagataccgtacttatgaacactaataaatctccataaaaattaaaagattgtatatcaaagtttatggacaatatacaaaaatctcattatctccagataatgtgttgttattactgtatttccaaacccatagactctgttccatatccattttctaaaatatgtcggggtcctgtctggaaacagatgactcactcaaatttagcatttttaggagagttttatagatgactatttacaaaactgaaaacaggatttagaaaaaccaaaatgggaggtacaatattccagagctagtaacaggaagctgtttgcaggactaagctgacaggagtttttatcaaaatctggagagatccttgtgttaggagctgctggagaggagctgtggcctcccctggactgataagtcagctggaggatacctggcagggagaaagccagagggataaagaaccgacttccctcttcagccaccgtgacttcctagcgatgcctccctggcccacgctgaacaggaaatcagagctgaagtgagcccactgatttagtttgtgttacctggactttccggggcagaaagcagatacagttgggtgaaaggtgaagggtggctacggaagggcaaatggaagccatccaccatggtacagaaatgaaatttgaacctgaacctccctcagcaaaagaacaacatataaaaaattacatgtagtaattgaaccaatattgttttccatcaatagtattataaatacatgctaatatatttatgatgacatgtcatcccttttggaggttcctgcagataaattatctctaaaacttaggagcagtctcagaaagaagattataacaaatgtcatttcctcattcaaggcaaaaagttagtattattcttttaccatctataaagtcttaaaaaataccagatttagactgacttttctcaagatcaaataatttacttgatgagtcattcttcataggaaatgtatgaagagtttgtaagtatataggcccaaatgagataagggttccctgaggcagcacatgtggtctgtgtttgttggatgctggcaaatgactttgtctcagtccttctagagggaagcacacagttcacttccatcagaaagttagtctgtggagtattatactttcccgtatagcagattcagattcaagttaattttaaaatagaaaaagtctacattctgctctcgacaatatgtttttcctattcatagtttacaggccagatgttattttctgaagtgcaagtaatgaatgcaagaattttaggaacttcatgagagtatttcagagtgaggaatattaatacttagacaataaaagagaataacaaattcgtattaaagtcattaaagaaggtcacatgaaaaaatgttcaaattccagaagtattcagtctaccagcaatcatttgtatttattttctcaatgttatttattttctaaatatttgagagcacagtcaccctgctataatctaactatgggtggttttttttttagaaaaaattttgttgttataatcagagggaaggttctgcattctagtcaactcaatgagagataacacttcagaatgcatgacagaaagacctagagagaatactgcaactgcaggctagaaaaaaagagataaacaaaatctcattatctccagataatgtgctgttattattatatttccaaacccatagactctgttccatatcaattttctaaaattgggcaattttggtaagttttctttttataacattaagtaaaaatagaagcattaatgctaagtgaacctaaatagatgctaatatcccttttagtggttcaactttgcagttcaagaaagacgcctcatattccatctgtggttaggcattgtgttgggcacatcagagtataaaaataaatgcagcaaaattaaccatctgaacatacaacaacttcttaatgcatctactgtgccagacactgtgttaagtgttagaagtattgagaaagaaaaatgcagtcatgtcctaggggaacttcaaccaaataagagggaaacaggcaaactgatcacatagagtgacaactgaaagtgggatttgcactcagtgttttgagagtataaaaaagaagccctcaattttgtctgtgagatggtagatcaaagtagcttattaagaggaggacaacataagtattgaagaatgacttaagcagagggaggggattattcagggtagagggttataaaatgttcagggaaccatagatgattttatatgataaaacgaaccctgaagttgaacagtaattcatcatgattcttagacacagtcagaagttgtcaaataactgaatatgcccttcagcaaggtttctgattttgaaaaaggaaaatatgccttaatttttcttgaacaaagacatcaacaacaattaattggaaaatctttgcctgtaggaggaacgggacacttccccaaattgttttacattctgtttagattggaaatgctgtaagagagaattgttaaaaacatacaaaaactaaacaagttaatattgagtgcagttgaatagaaatattattcaaatatgaacctacatggagttgatgtggggctaaatatacagatttatatatgtttctataatatttaaaataaagttacttttttttttttgagacaggagctcactctgtcacccaggctgcagtgcagtggcacaatcttggctcactgcaacctctgcctcctgggttcaagcgattcttccacctcaacctcccgagcatctgggagtacaggcgcccaccaccatgcctggctaatttctgtatttttagtagagacaggatttcaccatgttagccaggctggtctcgaactcccggcctcaagtgatccacctacctcggcctcccaaaatgctgggattacaggcatgagccaccatgcccagccaatgttgcttttgaattaaagattttattattattgaggctagttgaaagcaaatggcctagctatataaattatcattgcacaggaaagtctcatgtagtaccatgtattgtgtgaatatatttactgtttatatatatacataaatatctacacacatacctttatgtacatatgtatatataaccagtaaatacacatattatcatatttatcattgcacagaaaagtctcatgtagtaccatgcattgtgtgaatatacatttatatttatttactgtttgtatatatacatatctatacacatagattatgtacatattatatatacgcagtaaatatatatgttcacttgtatattttaaaaataaaacaatggtcatctaacaagagacctgcatcaggatatacagaaggatggaaacttcacttgtctgattgcatcttgctttatactgtatttcaaatccatgtaagtattttacataatagaagatcatatccaaaaaacagaatccacaaaattaaaaactatcaagttgtgctttgtgctaccgtcatgtgccaatgactctgaagagtgcaggtggtaaacggctcctccctgctaggaagaccctgcccccgcagcgtgttgctagttagagctactgaatcaattcttacctgaaggcagatcgcccccaggacattttagttgcacaagtcattggagtctcttttctgtataagtaattttgagctgaatttctgtcacttcccactaaaataactttcagtgattcactgaataatagtggagtctacgtggagctgacaataattggaaaaaatagaatcaattaagagggaaagaataggaagaagggatacattcaatcacaggagagtcaggacaaatacgcgggtgaaagacatgacagtttttaaccaaaagcatgtcttgagaaggaattggattagaattgttttaaaaagctacatgattgtcaaatttttaaaagcagcctaatgcatagattgcaacatacaacgtgatatttaaccatgctttggatgattaatgttaacaatagtgatggattgaaactgttgcatagtgctggaatttaagtggtagggataaatttctctttatttttgtatgtagatgcatatgtgtatacacacacacacacacacacacacacacacacacacacacacgtcttggaactcatcaaataaagcagatcttttccaagtaagtccagtaaatgcagggctatgcactcaaagtgaaaaaaattacagaattttaataaaaatcaaagtcatcgtaccatcgtaattctctccccatttcgctgcttctccaaccctgtcttacatacagatgccttaaaaactgcagtgaatcttttttcttgaaaaatgtctttatgccatataatcatggcttccactcaatcttttggcactatccaatattaatatgtttttggaaataaacagaagaaacagtaatggaagaggtactcaatagaaaagtctcttgaggtctaatttgggtggcactggggaaaatgcccagaaggtctgcaaacaagtaatgggcaatctagacagtgttgagaataatacagcagattttaaaaaggaatagcacgtataaaaagacttttccatttagggtgccaaaatcctaaagtaaggacttcaaaaaataatggaaagaaacctctacattgaggctatagcagattttgtttgataagagaagatttagtacatggaagttgtgtttgtcttctgaatagtaaaaatatctcactaaggatatgcaatatctttctactttcatgtgatcattttaaaagggcaggaatatgaattcaactgacaaaagattacttcagtgtttctggtttattttaatgtgcattttttcagtaaaaccttacagtaataaagattttgctgtcatctcatgaacaaataagtgtattactttacaggcaagaaaggcaaactagaataatgaccatagcatcatttatgggtatatagaaattatgtcctttttataaaggagatcttaataagcggtttgggaaattatattacaagccattctgtattgatttattatcttctaatgctcatttctgccatgcactcaaagctccaaagcattaaaattggtatccactgtagtttgatgccagttctgaagttcaaatggcaaataaattctcatattaatggtaatggtgtgaaactgagaatttattgaagttatttgttaaacttcagtaggtacctatagctagttttcatgtgaaaaaacctttagtaagagagcaactttgaaattaactcatgaaattagttaaattttggctttcctgccactctggcagttttgttaactcatgggagtctgttcagggtaataacacatagagaagtatggaccctaataccagtataaggcagaatgaagctgttctctaccacgagaagcaaacaagaacctatcagagccatcagacaatcatgattccagtgggccattgggaaagaatatatgcaggtgttccaggcagatttagctcataggaacagttacaatattttatacacattttacaaaggatattcctaaggatttttttgcactcatttccagatggtgacttctttaaaagtagaaacagtctgacatccacccagaattaagaccaagagagtactgtattaaactaatttaaacgtcaaagcatgttgcttttaatgctgtgaattcacccagactcaccttctcagagccttctttgttgaaagaacataatgaataacctttaagtgttgcttcctgcgagtcagtgccagaacgttctaactggtagaccaagaagcctgtcagcatttccatcataaacctatattatctggagctcataagttggctgtaaaactcaggcagaatctaggcattgaaacctttctggaaaagtgttatatttttaggctgtgtagactacagggtggtaaaaacacaggattttcaggcccaaatatagcagtactttacacaaatttaaacacattaaagtaaaacagaaatgtcctatttctaaattcacaggacacaaaaagaacacataattttaggccactatccaaaccttgtagcctgattttgtccaaagtctgtcttccattatgattatacagaaagtgttgaaggcattggtaagttttcagaaaccgatgaacaaacctaaaaacttgatgttttataaactattcgtctttgaagtgttgcatatgttctaaagtggtcatgtgaaatagctaaagctctttgttattatacccttaaaagtattttttgtagagtactttgcattgtataaaataatttaacatgcagtatttaatttaactctaaaaaaagaatcctgtaatattaccctcattgcacagaaggtaagcttagcacataaaagtattactcagtcatgcacagaagttaagttcaacccaggtcttccgatttcaagttcagtctggtaccactgaaaacacccctatcatgtcaaccctcctaatttctcattcatactgaatctgccgctcactatcattatggcctctcctgctgcgactgctctctgctcccacatcactcaaccttcttcctctttccacagcttcacaggttgacctcttttaaacatacctgtggatgtctcgtaagctcagcgcaactcacctggggcagttttgctttccaggggacatttggcaatgtctggagacatttttggttgtcacaacttcatgtgggagggtagggtactgttggccaatgtccagtggtagagaccagggatgctgctgaacagcctacaacacccagcacagccctgcccaacaaataattatccagtccaaaataacaacagtgcagaggttgagaaaccctgctccggccagaactctagattaacaatttaggattattaacctgcttaattcactcttgaaccccaggtgacacatcttcgactttctttggtttctaaacaatggtatgaaatgtcaaatgctactttgtcgttctagaacttagatctaagctcacagaaaagcaagaatgtgagctctatgaggatttgggatctgctttcttctttcgtttctattgtttagtggctgcctcatagtgggtgctcaagaaggatcagctgaagcaatggcaagtataggcatacgtcttcactggattatagaaatatgtgctgtccatggacatggggaggggaacatcacacactggggcctgtagggggtgggaggctagaggagggagagcattaggagaaatacctaatgtagatgatgggttgatggatgcagcaaaccaccatggcacgtgtatacctgtgtaacaaacctgcacgttctgcacatgtatcccagaacttaaagtataataaattaattaaaataaagaattaagtgctgtctgtgactgaccccttgggcattgccattagtggctcctctaaatcattccctgtcctgaggtcccctccccttcctcctcattcctcctgcgtcttctaggccttcctgaaaacaaggccctatcatttccattattacactctgttagctccatcttcatcactttcaaatacgctgaaaaatcctccttctagaataactctgctaccaacttttctttctgtatttcttttactgctaaacctcttgagtcgtgattggctccaattccttagcatatacagtgagtaaccttttgcaatctgagtggatttcccagcatgctacaaatactgttcatctgaaattcaatcttgattttctgcttacaaaccaagaaaaggcctttgttcttggaagtgcccttgaccttgctagagcctgcaacaattgtgatctccttcatgaaattccttcccatactttctaagagactgcatatttctatcttttcacttttatacttaaaccccagtttttatttttcttagtggcaacttttcatcttctatcctccttaactggatgttttctaagctttgttgttctctgaggttatttttctctttctaagttttctcccttggtccctgcattgacttctctgtgaataactagaaaatctttgctcccaagcattcatcccacatttcaaatcaccagtataacatggctgctgtaacttcaaagtcaacacacttaaacaaaaacaactatttcttccccatccttttttataacttacctcctcatgctctgtggcccccagacacaggaaggttctatttaggggcagaactgacataaaaagccttctttccctgagcctgctccatacttaagccatctctgccattttgccaagttattgacctaagatcctgaaattgatctctcctagctacacgcaactctgtagaattagcaattccactggccattcctgtaagtccacccttcaaagtgacaccacgtgctaaagaaaacaactcttgagaactgtttcataatggtaattggcaacactcacgtggacatgcttatccatactaacttattaataccaccattctatggggtaggttctactcccatacacagttgttacagataaggatccaaggcagcatggcttaagtaactcatttaatgttacactgctaatgaggtagccaggatttgaacaaagctgtgtggctccggtgtccatgcttttattcactatgctctatctcttccttactgcagggcacatatgaaaatggtgattgggtggacattttcacatatgaaaatgaaagtgtgattgggtggacagtgtagaacaaagagccatgcaattttaaaggtgagttcagagggttgaatagcacccctcaaaatgatatgcccaagttctagcctccagaatctgtgaagatgacattatttggaacaaggatcttttccgatgtggttagcttaaggatctccagatgacctcatcctggatttagagtgagcccaaagtccaattattggggtccaaataagaagagaggaggaagctgacaaagaaaaggtgacgtgaagttggtgttagagactggagtgatgtgtcaatcagccaatgcataccgaggattgctgacaatgccgacacctgggagagacgcagcaacaggttctccctcacaaatttcagaggcaatcaactctgctgacccctggaatttagactttgggcctgctgcatagtgaaatgataaagctccattgattatggtgccaacttcgtgtggacttgttagtgcacctctgggaaacaaatgcaatgggagagatcactgtgagctggagcagggagtccaataatggagccctcaggcaagtggcaaatctctaatgaaatgcatctcacaaacagaatgctgccaaagactaaattttcttttagtttttctaacattatttttgttattatactttcagttctgggatacatgtgcagaatgtgcgggtttcttacataggtatacacgtgccatggtggtttgctgcatccatcaacccatcatctatattaggtatttttgctatccctcccctagaccctcaccccatgacaggtcccagtgtgtgatgttcccctccctgtgtccatgtgttctcattgttcaacactcacttatgagtgagaacatgcagtgtttgattttctgttcctgtgttagtttgctgagagtgatggtttccagctacatccatgtccctgcaaaggacatgaactcatccttctttatggctgcatagtattccatggtgtatatgtgccacattttctttatccattgtaccactgatggccatgtgggttggttccaagtctttgctattgtgaacagtgctgcaataaacacacatgtgcatgtaactttatagtagaatgatttataatcctttgggtatatacccagtaatgggaatcctcggtcaaatggtatttttggttctagatcctgcaggaatcaccacactgtcttccacaatggttgaactaatttacattcccaccaacagtgtaaaattgttcctatttttccgcatcatatccagcatctgttgtttcctgacattttaatgatcaccattctaactggcgtgagatggtatctcattgtagttttgatttgcatttctctaatgaccactgatgatgagcttttttttcatatgtttgttggctgcataaatgtcttcttttgagaagtgtctgttcatatccttcacccactttttgatggggttgtttttttcttgtaactttaagttctttctagattctggatattagccctttgtcagattgatagattgcaaaaattttctcccattctctaggttgcctgttcactttgatgatagtttcttttgctgtgcagatgctcttcagtttaattagatcccctttgtcaattttggcttttgttgccattgcttttggtgttttagtcatgaagtctttgcccatgcttatgtcctgaatggtattgcctaggtttttttctagggtgtttatggttttaggtcttacatttaagtttttaatccatcttgagttaatttttgtataaggtgtaaggaaggggtccagtttcagttttctgcatatggctagccagttttcccaacaccatttattaaatagggaatcatttccccatttcttgtttttgccaggtttgctggagatcagatggttgtagatgtgtggccttatttctgaggcctctgttgtgttccttgggtctatatatctgttttggtaccacactatgatgttttggttactgtagacttgtagtatagtttgaagtcaggtagcatgatgcctccagctttcttcaatttgcttaggattgtcttggctatacgggctctttttttagttccatatgaaatttaaagtagttttttctaattctgtgaagaaagtcaatgttagcttgctggggatatcattgaatctataaattaccttgggcagtacggccattttcaagatattcattcttcctatccatgagcatggaaggtttttccatttgtttgtgtcctctcttatttccttgagcagtggtttgtagttctccttgaagaggtccttcatatcccttgtaagggatatgcactgtgtctgagagattgttgtgatttacaattgtttgcgtttgcttaggagtgttctacttccaattatgtggctaattttagaataaatgtgatgtggagctgagaagaatgtatattctgttgatttggggcggacagttctgtggatgtctattagttccgcttggtccagaggtgagttcaagtcctgagtatgcttgttaattttctgtctcatttatctgtctaatattgacagtattcctagttattttattctctttgtagcaattgtgaatgggaattcactcatgatttggctctctgtttattactggtgtataggaatgcttgtgattttagcacattgattttgtatcctaagaccttgctgaagttgcttattagcttaaggagattttgggctgagacgatggggttttctaaatgtacaatcatgtcatctgcaaacagaaaatttgactttctctctttctacttgattcccctttatttctttatcttgcctgattaccctggccagaacttccaattctatgttgaataggagtggtgagagagggcatccttgtttataccagttttcaaagtgaatgattccagcttttgccattcagtataatattggctgtgggtttgtcataaatggctcttattattttgagatacattccattaatacctagtttattgagaatttttaccatgaaggggtgttgaatttcatgaagggcgttttctgcatctattgagataatcatgtggttgttgtcattggttctgtttatgtgatggattacgtttattgatttgcatatgttgaaccagtcttgcatcccagggatgaagcctacttgatcgtggtggataagctttttgatgtactgctggattcggtttgccagtattttattgaggattttcacatcaatattcatcagggatattggcctgaaattttcttttttgtgtgtgtgtctctgccaggttgtggtatcaagatgatgatggcttcataaaatgagttagggaggagtccctctttttcttttgtttggaatagtttcagaaggaatggtaccagctcctttttgtaccactggtagacttcgactgtgaatccatctggtcctggactttttttggttggtaggctattaattactgtctaaattcagaacttattattggtctattcagggattcgacttcttcctagtttagtcttgggagtttttatgggtccaggaacttatccatttcttttagattttctagtttatttgcatagaggtgtttatagtattccctggcagcagctttgtatttctgtgggatcagtggtgatatcccctttatcatttcttattgtgtctatttgattcttctctcttttcttctttattaatctggatagcagtctatctattttgttaatcttttcaaaaaaccaactcctggattcattgattttttcaagggttgttcatgtctatctccttcagttctgctctgatcttagttatttcttatcttctgctagcttttgaatttgtttgctcttacttctctagtttttttcattgtgaagttacggtgtggattttagatctttcctgctttctcctgtgggcatttagtgctatacatttccctctaaacgctgctttagctgtgtcccagagattctggtacattgtgtctttattctcattgatttcaaagaaggtatttatttctaccttaattttactaaggttgaaatttaagttatttacccagcagtctttcaggagcagtttgttcagtatccatgtacttgtgtggttttgagtgggtttcttaatcctgagttccaatttgattgcactgtgtctgagagattgtttgttgtgatttacgattgtttgcatttgcttaggagtgttttacttccaatcgtgtggccaattttagaataagtgtgatgtgtagctgagaagaatgtatattctgttgatttggggtggacagttctgtagatgtctattagttccgcttggtccagaggtgagttcaagtcctgagtatccttgttaattttctgtctcatttatctgtctaacattgacagtggggtgttgaaaatctcccactattattgtgtgggagtctaagtctcttcgtaggtctctaagaacttgctttatgaatctgggtgctcctgtattgggtgcatatatatttaggataattagcccttcttgttgcattgatccctttaccattatgtaatgcccttccttgtcttttttgatctttgttggtttaaagtctgttttatcagagactaggattgcaactcctcctctttttttgctttccatttgcttggtaaatatttctccatccctttattttgagcttatgtttgtccttgcatgtgagatgggtctcctgaatacagcacaccaatgggtctacaccaatgggtcttgactctttatccaatttgccagcctgtgtcttttagttggggcatttagcccatttatatttaaggttaatattgttatgtgtgaatttgatcctgtcattatgatgctagctggttattttgcccattagtttgtggagtttcttcatagtgtcaatggtctatacaatttggtatgtttttgccatggctggtactggtttttcctttccatatttagtgcttctttcaggagctcttgtaaggcaggcctggtggtgacaaaatatttcagcatttgctgtctgtaaaggattccatttctccttcacgtatgaagcttagtttggttggatatgaaattctgggttgaaaattcttttctttaataatgttgaatattggcccccactctcttctggcttgtagggtttctgcagtgagctctgctgtaagtctgatgggcttccctttgtgggtaacccgacctttctctctggctgcccttaacattttttccttcatttcaaccttggtgaatctgacaattatgtgtcttggggttgctcttctcaaggagtatctttgtggtgttctctgtatgtcctgaatttgaatgttggcctgccttgctaggttggggatgttctcctggataataccctgaagagtattttccaacttggttccattctccccatcactttcaggtacaaacataggtttggtcttttcacatagtcccatatttctcggaggctttgttcatttcttgtcattcttttttctctaatgttgccttcacacattatttcattaagttgatcttcaatctctgatatcctttcttctgcttgatcaattcagctattgatacttgtgtatgcttcacaaagctcttgtgctgtgtttctcagctccatcaggtcatttatgttcttctctaaactggtttttctagttagcaatttgtctaaactttttccatgttcttagcttccttgccttgggttagaacacgctcctttagctcagaggagtttgttatcatgcatcttctgaagcctacatctgtcaatttgtcaaagtcattctccattcagttttgtggccttgctggcgaggagctatgatcttttggaggagaagaggtgttctggtttttggaattttcagcctttttgctctggtttttccttatcttcacggatttatctgcctttggtctttgatgttggtgacatacagttggggtttctgtgtggacgcccttttcgttgatgttgatgctattcctttctgtttgttagttttccttctaacagtcaggccatctgctgcaggtcagctggaatgtgctggaggtccactccagaccctgtttgcctgggtgtcaccactggcggctgcagaatagcaaagatcgctgcctgttccttcctctggaagcttcgtcccagaggggcacctgccagatgccagctggagctctactatataaggtgtctgtcgatccctgctggggggtgtctcccagttaggaggcacgggggtcagggacccacttgaggaggcagtgagtcccttagcagagctcaagagctgtgctgggagatccactgctctcttcagaggcagcaggcaggaacatttaagtttggtgaagctgcgcccacagccgtcccttcccccaggtgctgtatctcagggagatgggagttttatctataagcccctgaatcgtgctgctgcttttctttcagagatgccccgcccagagagaaggaatctagagaggcagtctggctacagcagctttgctgagctgcggtgggctctgcccagtctgaacttcctggtggctttgatttcactgtgaagggaaaaccaactactcaagcctcagtaatggtggacaccccgccccccaccaagctcgagcgtcccagatcgacttcagactgctgtgttggcagcgagaatttcaagccagtggattttggcttgctggcctccatgggggtgggatccgctgagctagaccacttggctccctggcttcagctacctttttaggggagcgaacggttctgtctcactggtgttccaggtgccactggggtatgaagaaaaactcctgcagccagctgggtgtctgcccaaacggctgcccagttttgtgcttgaaacccagggccctggtggtgtaggcaccccagggaatatcctggtctgccggttgcaaagaccgtgggaaaagcgtagtatctgggccgaatgcaccgtccctcagggcacagtccctcatggcttcccttggctggcggagggacttctctgaccccttgcgcttcctggatgaggcaacaccccaccctgctttggcttgccctccatgtgctgcacgcactgtctaaccagtctcagtgagatgagccaggtacctcagttggaaatgcagaaatcacccaccttctgcattgatctcgctgggaactgcagactgaagcggttcctatttggccaccttgccagcccatctcgagtaagttttcttatctttgcatgtatatccgataagctagatttagtggtcaatagcgatttttggaatgaatgaataaataataaggattgctcttttttttactgcactataaatgtgtagaagtcatgtaatttaaaatttatttgtgttaaaatgttgggtaaaatatttttactctactttaaatatctaagttattaaatataactggctgcatttattttattaaaacttacaaaataatttttataactatacaaattataggatcatctacatattgtgcctattaaaattttacttaaatatgattttagttttttatagacagaagtataaagaatgcttcaaaatcttaatcatttagaactaaaattatgtctggtgtcttgaaatccagatttacgtatgtgttaaagatactggttatttcctcaagtcaaatcatggaattgagaggtagagttgaatacagttttaataaatatgcattggttcctatgtggctattcttgctgtagtagtacactaacactctacaaaaatctgttttacaaaaagaaacctttggaagtaacacttatataaattaatgaaaaaaatgaatgaatatatgtaatgtaataaacattaaatgattaatcagtggagatcctggattataagacaataaaaatattaaacagttttctcagggaaaacattttaggacaactatatatatatatatatatatatatatatatatatatatatatatatatttatttatttcccccctattatttcaggggctatatcgtaaagaagaaataaaacttgaaaataaatgtacattgactaagaatttaactgttgaaactcaaacacctatatctttcatatatatgtacatatgtgaaatatatagctctgatagatatatgcacacacacatacacacatacatatatagtggctaaagatatctttatttcagatatatattttttcatatatctttcataaatattattgacatacatatttcatatatgtatgtacctatattcacatacacatagccctgattttatcttagcacatacatttattattatcttactttggaaatattggaaataaagtattaggtgttttttagcacatgtagagctcagctaaaagcaaaagcaatggaaacattttcaaggacaaatttactaagtatcgtagcaatgccacttatttccatgtaacaaaaagtattatttatacatttactatttgggttaattaaattttttgccctgatgaagacctgaagcaatttcaggatagaatttttagaatgaagaggaaccacgaaaagttgatatgcataaacagagaagcttgctaattctagacactttcatatttagatattggttgtatctgtgtctatgtacaagatacccaatctttcttttttttattctttttttgagacagagtctccctctgttgcccagtctggagtgcagtggctcaatctctgctcactgcaacctctgccccccaggttcaagtgaatctcctgcctcagcctcctgggtagctgggattacaagcatgtgccaccatgcctggctattttttgtatttttagcagagacagggtttcagcatgttggtcaggctggtctccaactcctgacctcgtgatcctcccacctcagcctcccaaagtgatgggattagaggcgtgagccaccatgcctggccgatacccaacctttcaaagcctggatttccatacacaaaatatacctaaagatgcctactgtatttggtggggaagtcaatgtgaaaattagtgtaaatgctacacagtagatagaggttgatggcctcttggtcttttcataatcattatcacaggaaacacaatgcttacattgctttacctaattctacttgttccatacaagaaaattagagctggtcactggattaaattgtatttgttaccttcctattctaagtatccttaaaataataggaaggtaacaaacataatttaatagatatatagataacatctataagacatatctttaatagacatgtagataacaactcaaagagatctggcagcttctcttctaagtaattaacctgcacacatatggtttacctagacaatataacattttttgagtatggggagatttgaagcacaagacttgatgggtatgagcttataagtattattattctattgaatattgttttttggtttgaagtaaaatgttaattgaattggtaatggttttggtaataaaaagatgcttctgcaagaacataatgaaatttgattgattcactaagcttggtcttaagtactcgcatcaatgcttttagcttttaaaataaattgtatcaattattgcttaaatttaacattgatgaaaaacatttctagcccctggttaccattaatgtctatatagttaacaaagacatggggagttagctgcaccattatgtgaaggctctttaaattaggtttactgtaataaacacacacaagttatttctacagctctgaaaatcggaaaaggaaatagaagatgtttagggtcactgtcagttctgtctaagcctagattccttttctgtaaaatgaggatgataataatgatatgcccctttgtgttttttagaataacagaataaatgatcaataaattttagcaatgattattattatgcacacacaggcactgtgctatcctctataaaactgtaggatggatgagatgtaataattatccttgtataagtttcctattgctgctgaaacagattaccacaaatgtaggctaggcttagaacactaatttattatcttacaggtttgtatctcaaaagtctgttgctggtctcacgaggctaacgtcaaggtctatatgctggagctcctttcaggagcctcgccaagagaatctgtttccttgctcattgaggttgttggcagaattaatttatctgcagtggcaggatttagattcctgtgttcttgctggctgtaaactctgggtcattattaacttcctgaggctgccacattgctggctttctgacttcttcctctatcttcaaaatcagcaatgatggatggagtctctcccatgtcaaatctccctgacccaccagtcaaagttcttagctgttaagaattcatgtgattacagtggacccacctgtgataatccaggatcctctccccatcggaaaggtggtaccatctgcaaagggccatctgcaaagtcccttttactgtgtgacataacacattcacggatcccaggaactggggcataacctctttgggagaagcattatcccgcctaccacaaaccccaagcttttatatatctgggaaagtaaataaaacaagtatataaataacagccacataaggccgaatgtgcatcttgctttaagaaactataaattcattgttcaatatctaattagaagggagtaatataactcttccttttatcatatatcattataaagcttttatactaggatcttcccctgtataagggattgttttctcttatcttggtctcctcgttcctcatcgattgttgttcctgcagcaattaccgagcagcgaaaatgcagtggaatggccactttacaggagggaagccgtttccaatactcacgaagtacaactcctaacctggtgggcttgggcatcctgggtatttgttcagataatcaactttaaggcttttaaaaacatgttattttgtgaaatatttgtatagaaatgctcctgttccttctttatttacccttaagagattatgatcagaggttagttatgtgacattggttctctcctctgtggctgaattcttgagaacattgccaatattagcagaccgtattgtatttctcatatcttatttttttccttttcatatctgtcattatcatctgatgcccttcatcataacctaattctattcttcaactcaatcactgcagaatggtgtttttttccttgacctttatctagctgtacagagtttttcattctttaagtataaaaatatttcctcccactacttgagtattctacttctagaccttcccaatttaagcacctatatgtatcttcatctcttcctttctgatggagtttcacagaaaaaaaaatagtaaaaaattctgacctagatcagactggttaatagctagctggtttcatatgagcaaaacgacagcttgtaaagtgctaagcttgtgtcctaaaaaagacatgaagcgcttcctttagcataacataagataaagccaaggtaaaatagaacattgtagaataggatttaatgaattaataaaaaagaaagagtaagtcatacagacagaggacataaggaatggtgtgtgagtacatgggcttgggaatcagacgacctgagcttggacaccagctctaccacctgctacttgttgagcctggacaggtaacttactgcaaagcacagatttccttataggataaaaggctataaaaatatccatcttggatagtagtcatgaagagatgatatacataaaaacttggcatatgctaattgctcaataactgagagtttaatatttcctcagacatcatctaaaaggactggacctacatctgcagttaactgcacaatggaagaaacggcctctcctgggcagcctcatggatggggtgaagagacaaagcttgggagtgtagcatgttgagcacatctgctcagaggtaacatttaagcagtaagtcttgtgttttaaatcatgttatcagcctacatgcattatctcttttagtcatcatcataactctgtaatataaatactgtaaaatattttatagaggagaaaaaactcctatgtagtaagaagagagataacttgtcctagtacacactgctagttggaaataaaccaaacaaatgaacccaagttttgcccccagaacctatatgttcatatttcaaactaaacaaccatctttcctggaaagcaatctcttctccagacatctctatttctctcaatagaatgaacttcttagtgatttattttttaaagttaaatgtcataaaataggcatatgttgtagatataaccaaattgaagtagcatgtttatgtattagagcacaacttcaaaatggagagatttaaacagctgtttcatcagctcttgtcagggctcagctgcgtgcctcttctgctgctcacatgtgtagtttctcatgcagttaccatcagattgggctgaagctgccgtggctccaggtctaactccctcatgttcctccccaggggcttcactctatgttgctgttttaaataatcttactttttaagaacagttttcgacatacagaaaacttgggcaatactacagagggttcacacataccccacacccagttttctctgttactaacatcttatatcagtgatgtacaagtgttacaattaatatgcccatattgatgcattgttattaactaaagtccagatttttttcagtttttttttattttttttattttttattttttttagtttttacaaaatgtccttttctgttccaagatctcatctggataccatgtcatatttagttgtcatgtctccttgggctcctcttggctgtgacaactgtggccttgctctttatgtgttgtcttatcctccaggaccacacacacacatgcgggcacgcacacacacacacacacacacacacacacacacacacacacggtagtttggacttcttacttactggccaaaggctctgagatgagggaaggagaagctgtcacattctaaggcctgggctccaaaatcccagaacagcaattcctctgcttcatcttggtccaaccagtcacaggcccagcctagattcaaaggggaagacataagtcccatctcttgatgggcagagaggcctgtgtgtgcaggaagcatgagcagaatagtgagattgtcaagggtcattttagggtcaagccacacacagatgcccggaaaataccaccatttgcttagttgattttaagcagagaatgacgaaatcattttaaaaaattgagaacaaaatggcatattgatattgaatccaaattcctgtttaagctatgtacctccaaatcagtggttgccatagggtatcacattgtaacacaaatacctatttctcatgcaattgaatcactcataaaaatgttgaatgtgccatgtaataaatgtagtaatttgttttctttagtaaatataacaaatgtgtatatttaaaataaaattagccttccattgccatagaattcggaactgtggctttttttttttaagtttaggttgtctccaagcataaaaatggaaatactgatcctgtgacaacacagcctgaattttctgctttgcagatgccagatttatttttaaatggtgtgaatcaaatctgtgctgagaggccaacttcaaaatataaaagaaaaattggcaatgggaggattgtgctggtttggctgaaatgaagtgctctacggcatttcattctagtggagcgtctgactgtgaaaatccttccaattgtaattttctttggcttgtcaaaagaggattatgaactaaagtcagtgttgcaggaaatgtcacctgtcctttgaaagaaaataataaatcaaaatggcttttgttcatcatgtttaaaatgaaaaaaaaaaaaaagttgatccacttggagtcttctctcatttcttgacaaggcagttaaataaataaaacggaattttttgtaattgttacttcttgctcatctcaaaaggggaaaagggaaatcttcattcaatacatattcatacagagaaaatagaagagcagagacagagacagaaagagaaatgagatgaagagtgaaacaagaccctggtagagttcctcaagtcagatgttaagaaaggtatctttaaattataatttgtttctttgatagatactatattacaaattcaaaaatgtgaggtaaataaaaacaaaaggagtagataactattcctgaaaaattctaagtgcttgtatattttgctttaagcaaataaagacaaaattaccaaacatataacagagcttgaaattatctgaattcttttgccttgacaatttttttcagttattttagcaataaacattgcctgtgatgagtacataccacttcagagaaagaaagtgatatttctggcttatcgtatggacatcatggccatgctgacaccatttctttaaaaaagtaattgttaatgctactttgtatgtattaatctgaaaatatagaagagcattttaatagttgatgccaccaccataaactccgtttcttgttgctgttgttataatcatgtactaatgataacatctggaatgttaatgtggtgacaaatttagaaacagccatagattgcaaagctggaagataatggcttacgacatttgctctctaatgttgcaatgatatgatttcagatgtgtaataagccagtatgtcaaagaagccaataagcccatcataaaagctatatagaattttgatagagcattatatcatcgctgtgcattttctagtatggtttggtttggtatagtacaggcaaattttaaagtgtggttttaaaattaagaaatattgcagccaggcgttgtggctcacgcctgtaatcccagcactttgggaggccgaggcggacagattacgaggtcaggagatcaggaccatcctggctaacacagtgaaaccccgtctctactaaaaatacaaaaaattaactgggcgtggtggtgggcgcctgtagtcccagctactcaggaggctgaggcaggagaatagcgtgaacccgggaggcggagcttgcagtgaccagagatctcgccactgccctctagtgtgggcaacagagtgagaccctgtctcaaaaaaaaaaaaaaaaaggaaaaaaagaaatattgcatattatttgattttacttattgattttaactgtataaaactataagtcaaatataactggaaattttcatgtgagcaatgtagaaaaagaaaacgaacattctctttatcaagccaggtttaatatgatgactctcaaacaaataccaacactagggtatatgacacagcctcagagtctttttctgtcctttttctggcactgaagattagagtaccttctttacgattgtactgtgagcatattgaggtaaaccacaaaacaggtatcaggttaggagaaaattagcattctatttaaattctgattttgaatcaaagaaaattaatagatggaaagataaatagatgaatatatagatagaacccttagcaaacatttgcatggtttcacagtgctagtatgtctttatttcttccttatttcagatttcctggtataaagagcaattgtttttttaaaacaatttaatggccatgttaattttaatttttactttttaaattttttattattgagttttagggactatttaaattgtgtattagctattaactatgggtcagcttctcacttgtcatcctatctgaattttcactgacatcaaaaggactctttcctttgtagaagcattagtagatcatcttctccaaaccggatacatgtttcagagtttttcaacacttgtgcatataatctactcacagcacccagtaaaagtccaataagtcagtgttgactgactgcttcctatctagttcaaaagtggggagaaaattaaacatgttttcggtacatttcccagcttcaatattttaacttctcaaaggagctaaatgtgcttggaaatggtgtacgacattttaattatgctaccagaagaatccgagaagagtgaacatattgagaaacagggcagaatggaagaagaaagtggcactgctttaaagccaaattatctgatgtttacatctttcaacactttggcccaagttcaagacattaagcctagtttttcaaatgcaattatgtatggaaagcaacaagtatagtcatgcctgatgatagcaggggtcaggctgagggacacaccattctttggtcaaaacatgaaagttaatttcaaaatccaccaggccaaaaagaaatattaaacaaagtttttgaaatagaacattttgatgtcagtatgtttcttttatcttaaaaaacccaatcattttgaaattctctgagtattattcaggtaaagaaaaaacatgctttctcacaattaggaaacaccaggccttgatggatatttagacacagcttgcatgacatttttagctatcacactagcaggtgacatgacagaatatggaagaaccgtagctccttgtgacgtgatttctgtggtcctccctgtttgaagcaatctaaacttaaaaagtatatgactttgccaaaatgaggtgaaaacctttttaaagtgaaagattgcattaaatcagtaatttgacatcacacttgagaagaatgaacatgaataattttttattctgatgaaattcacttgtttaggcagatgtaatgaacacttgtttgttaacaagttattaatctttatgaagagctactaacatttctgctatgattgaacaaaatattatagacatttgggggtcactttcttccagttctctccattctcttgccctttttcttcccggtttcctccaattcacttcccacccatcctcaagagcctataaattggcatcataactctagactaaaatagcgttctgagaactgaaagctcatccttcacccattttctcatactgtttgccaaatacggtttttggcatctgaaattaacattccaacattaacagaaattgctgaatatttaataacatgtttagaactgtgcttgcaatcccttgaagccatgaatgagtaccagccccagatgaaattgtccagcctcatgtgaatcgacggcttccatcagagctgtgccgcccattctcatggctaatcttcccatgaatacttagactgccctgctagttaaagtatggcgcattggcatcacctgggagtgtgttagaaatgcagaactactgaatcagaatctgtattttcataagaccacaggtgacacacgtgcaaatgagagagtgagaagcattggcctggatctatccaccctcctgaaaaatagaccaatgctgtccccaacccactgctctctttctgatgcttgtccgaatggcctccttcacatcttctgtccttttcccctgctcagtcccttctcttttctaggcagcacaaagaggccagttgcacaccccatgggcgtggagagacacctgcctctatcccatgcccctttgtgagtaccacactcacaagactaataatgtttaaggattacttcaataatctaaaaagaaaaattgattttctttccccattttgaaactcatcattttctacatagctaaaatagttgaaattcactattaaacatttgtaatatgcagatttttttacaaatattaccacattgtcttcatgccattgtgtccggaattggtgggttcttggtctcactgacttcaagaatgaagcctcggaccctcgcggtgagtgttacagctcttaaggtggcgcgtctggagtctgtcccttctgatgttcagatgtgttcggagtttcttccttctggtgggttcgtggtctcgctggctcaggagtgaagctgctgaccttcgcggtgagtgttacagctcataaaagcagcgtggacccaaagagtgagcagtagcaatatttattgcaaagagggaaagaacaaagcttccacagtgtggaaggggacccgagcgggttaccaatgctggctcgtgcagcctgcttttattctcttatctggccccacccacatcctgctgattggtagagctgagtggcctgttttgtcagggcctgattggtgcgtttacaattcctgagctagatacaaaggttctccaggtccccatcagattagctagatacagagtttcgacacacaggtttctccaaggccccaccagagcagctagatacagagtgtcgattggtgcattcacaaaccttgagctaaacacagggtgctgattggtgtgtttacaaaccttgagctagatacagagtgccgattggtgtatttacaatccttgagctagacataaaggttctccacgtcctcaccagagcagctagatacagagtgtcgattggtgcattcacaaaccttgtgctaaacacagggtgctgattggtgtatttacaaaccttgagctagatacagagtgccgattggtgtatttacaatccttgagctagacattaaaaggttctccacgtcctcaccagagcagctagatacagagtgtcaattggtgcactcacaaaccttgagctaaacacagggtgctgattggtgtgtttataaaccttgagctagatacagagtgccgattggtgtatttacaatccctgagctagatataaagattcttcatttccccaccagactcaagagcccagctggcttcacctagtggatcccacactggggctgcaggtggagctgcctgccagtcctgcaccctgtgctcgcattcctcagcccttgggtggtcaatgggactgggcgccatggagcagggggtggtgctcgtcggggaggctcgggctgcacaggagcccatggagtgggtgggaggctcaggcatggcaggctgcaggtcccgagccctgccccgtgggaaggcagctaaggcccggcaagaaatcgagctgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggggcggtggcgggcgcctgtagtcccagctactcgggaggctgaggcaggagaatggcgtgaacccgggaagcggagcttgcagtgagccgagattccgccactgcagtccgcagtccggcctgggcgacagaacgagactccgtctcaaaaaaaaaaaaaaaaaaaaagaaatcgagctgagcgccggtgggccggcactgctgggggactcagtacaccctccgcagccactggcccgggtgctaagtcccccattgcccggggccagtagggctggctggctggctgctccgagtgcggggcccgccaagcccacgcccacccagaactccagctggcccgcaagcgctgtgtgcagccccaattcctgcttgcgcctctccctccacacctccctgcaagctgagggagccggctctggccttggccagcccagaaaggggctcccacagtgcagcggcgggccgaaaggctcctcaagtgccgccaaagggggaacccaggcagaggaggcgccgagagcaagcgagggctctgaggactgccagcacgctgtcacctctcaccattgtctttataccattcctatgagagagatcagcagctttatcctgacttacaggtttggagtggactataaataaattgggaaggtatcgtaaattagctttttgaaactggaattagtgtcctgtcttaaagtctgcaggaattacaagactcgaggaagagaatcattggtggtttgggaagctctgacaaacaattaagtagagaatgatttagtacacagctcagttcctgaacattctcattgctgcctctggttacaaaaaaatcttgccaagacaaaaatgttacttctgtataaatccctctcattcgaacttaaacataataactaataatatccagaatgatgacttgaattttataatcagtgttaagtggattttaaatacagaaaatttcatgaactttcatggctttaactaaacatgtttgaatatggtaaggatttttctatgtgtatattactatgcagtgtggctctgactctgattgcattcaatattccatctgattaaaccatgtttactcatttctcccctcactagatgcccttcttgaaaccttccctcaatactcctatgaggaggctttaaatgctctgaatctattacaaagataaataccagggaagtcaattttaacaaaccttgaaataacctaaatgtctattagtaagaaagtaattaaattaaaaatgttgtatactcatgtgatgtaatattttgcagctggaaaaaagtaaaatagaatacagttgtttatttggaaaaatgtccatatatgttgctaatttctaagacaaaaaggaaagtttcagaatgaagtgtataatggttgcacttatgttaaaactctatacacccatagcttcagaaacatgaaggtaaatagattaatatctatagctgtagataggttaaaataaagaaaggtggatggatagatgggtagaaagacagaaaggaagtagacatgaagatattcatgagaatttttgaaaaagaatcaaacgattctgataacaaatgttaatttctggggagttcaaatgaaatgtgagaaaagagactttcactttcttctaaatacttttacagagtgtttgaattttttgtaaatgcgtattacacttaaaatttttaattattaatttttgtaggtatgtgactgagtatcccatttttctaagagatagcttattatttttctctctcttctttttcctctcctccttttcctcacttcttacttagctctttagaaatgcaattatagcctcttatctcccatttaccaggcactccttacagggcaagttcatctccagagcagaaccctcacccatcaggaggttgccttgggagataacagttgattgacaacccagcatatgcctgctagagtttttggctgcatttacagcctgtttctgcccatgaagaagccaactcgaatgcccggtagataaggcaccaaagtaagtacgcagccctcttacctgctcccttccatctcccataggtcccccctttaaaagggcccactctgtgctccaaaagggaagcagtacccttatggtaggaacctgtgcttcttccccaaaggtagctttggaaaaaaaaaaaaaaagtcattttctttataccagacctcactctttttaactggactctgcaagtggcaagggactaaacctgcattttggttccaactacagagtaggtatatacacttatggggtaggtgagatattctgatacaggcatacagtgtgtaatcatcacaaaacagggtatccatcacctcaactatttaactttcgtgttacagacaatccaattatactcttttagttatttttaaatgtacaattaaattattattgactatagtcaccctgttgtgatatcaaacactagatctaatttattctatctttgtacccagtaatacacttaaatttttaccattacatcttttcagagtacctagcatttgctttgtatcccaaatattctgcctgtctcattgctagacatttgcattgactcagtcgcttattccccaactagacatcttagctatttctactcactgcctgttgtctgaaatagcttcctacctcgattttgcctttctttgcattttcaaactctaaagtttacttctcctaggaaataaactggttatataaatgtgggtaatcattcattcccatctactgagcataacttcagacattttccctcttagtccaaagagcaattaactttatttttaaattaaatataggttggtgcaaaaataattgcattttttgccattgaaagtaaatggcaaaaaccgcaatcacttttgcaccaatctaatatttaaattacatgcttccaacatgaggcacacaaccttcaataaagatattttctctaacaaccatgaatacatgttaaagattcaacaatgggaagaaatgtcttggaagaatcatgttataggaaagaatagaactaattaggaatgtaaatataatttagaatacggtctctcaagagaattgatcctggacttagccaattattagcatagtgtcccggctgcttcaggactattattcaacttccaaactcttaccctttgaattaaattggtattttactagtttgcagaggactggcagattccttgaaacttgcgccccatcccactagaaatttcgtcttcaggaaccacttcattgcaggcatgccgcagccgcccccgatcccttcccaccgccccactaggcttatgactttaatagagttgtctgcttctgggttatctgcctcacactgtgatggcctcacttccattccatttgcttagcttctagcactgtcgcgcatagaggtgggcacttaataaatgctgccaaccatgtcaaggtaatgagagcagttaaatgagcagctgaactccatttattcagaagtgcttgttgcatgtttactgtgtacattgtgttatatgttaatgggaggctgtaaaatgattccatttattcatcattgcaatgaggccattgaactggatgatctctacagtaattgcacatctagtactctgtgattctaaacgtaaatttccacatgagagaacaaagtttctttccttgatttaaacttatgtatgcagaaatacaatatttgtatgtaaaaatactagaaaatatgagcaaatatttaagtagtatgaaaagtgctaaaggaatctaaagaatttgagagagatgggtggagaatgctttttggacaaggtaggtctttagcagagtctttaagaatgtgatgaatgggacttaatagagtaaatttgaattaattccaagtagtgagtgattggaggagaaatccaatgttcattcttgtcccttccacacccagaaatgaaaccatgacccctttacttagaggtaggatgatttgcatttacaatcagtgataggcaatgcaacaattgacaaaatataaaggtagagttaccatttagtgaaccctaagaaatgcagtagtgcatctggcacaagcgggaaggctggaatttcagaatggaaagaactggggccgggagcagtggctcacatctgtaatcccagcactttgggaggccgaggcgggcagatcacgaggtcaggagatcaagaccatcctagctaacatggtgaaaccccatctctaataataatacaaaaaaattagccaagcgttgtggcgcacacctgtagttgcagctactcaggaggcggagacaggagagtcgcttgaacccaggaggcagtgcttgcagtgagctgagatcgcaccactgcactccagcctgagtgcagagcgagatagagcgagactccatctcccagaaaaaaaaaaaacaacctggagaggaaaaggcagtggtgtgaagacgaaaagagaggagctctgtgtgaaagctatagacgtccagggaagacctgaacacctccactttacagctctatgcttttgcacaacgctggtagaaaagagatctagaaagaggcatgttaatttctccactctccaactcaactctgcacaactgagatttacaaaagataactcgagttaaaggctgcttaaaatctaggtctcttatgtgtctgcttggtaagaagctggacatggatggaggaaatggtagccagggacttcactggttcaggatagcaaatcaagattatttcctagtcaaaaagacaagagtgaagaaagcaatccaacttccccccaagagcatcctagcagtcctacatgagactaactccaggaacacaaatccagtgaagcagtcacgatcatttaaaaaattttaaaaatccgtaacatctttcaagaaaacactaaatttgttgacccattttcaagactctttctttaatgattgctcataaaattttagaagctgacacaaactaatagaaatatgcacaactcagtataccctattccttactaccactaactgaaaacctgaatgagctacactctcttttttatactggattaaatagacattgttattttctctgactctccagaggcaaaactgaacataagctacaaaaatttacattttcaacagaatgcagttttcttttgtataaaaccttctagatatttattctctagcttcatttgttcacctgcttgcttggaaaaaaatgatttataagaagtctctctggccaggttgcccaatgtagttagcaaactagcaagatgaaacagctgagactatctgttagcttcctaattttccaaagatcaccttacaaaccaattaaagtttatgatgaattatgagcaggactatcatgtgtctagcattagaggtcataatttaagcccccaaaaatctatgatattagacaaattatgaattctgagatttgttagcatcatactctgaaaggaactgcagattctctagttcaaatccttttattaatattacagatgtggaaacagttggattgctctgagtgaaaatcccccccttaattgtgaccttaaaattatacttgatgtatccatcctgccaaatgagtaagagctattatgacaaaaaaatataacagaaaagcagaatatttcttctaaatagccacaatgggtaaaacatttccatgtctactaatctagctgacatgtgacactgttctgggccaagtgaaggctttgctgatgtattttttgtctctgtacttctcatagaaactcatacagagatcatgattgaaaaagtttctttcagctgtgtaatttaatcaacctgacctcctaagcctctcaagactttaagaacaggctggccgggtgcggtggctcacacttgtggtcctagcactttgggaggccgaggtagtagattatgaggtcaggagttcaagaccagcctggccaacacggtgaaaccctgtctctactaaaaatacaaaaaaaaatttagctaggcgtggtggtaggcacctgtaatctcagctactcaggaggctgaggcaggtaattgcttgaacctgtgaggcagaggttgcagtgagccgagatcgtgccactgcactccagcctgtgcaacagagactccatcgcaaaaaaaaaaacaaagaacaggttgatgtaattccttcctagacaagatttcagttgaagaactacttgatacggttcatttggagctgttctttgtcccttaattgtaacagacttagatggagttggcttggcaggttataaaactactacagggacagagtactgtggtggtttttgttgaataaaacctgagaatctacttcctaagattctactgtagagatgtatatctgtgtacgtgtgtgtgtatatatgtatgtgtaaaattataaataatttgtgtgtgtgtgtatgtatacacatatatatatatgtatacatacacacacacattcagagacacttgtctttattctatcactacatgaaaaaacatttttaaagctttcctgccgggcatggcggctcacgcctgtaatcccagcacttttgggggccaaagcaggtggatcacgaggtcaagagatcgagaccaacctggccaatatggtgaaaccctgtctctaataaaaatacaaaaattagcctggcatggtggcgggcacctgtagtcccagctactcaggaggctgaggcaggagaatcacttgaacttgggaggcgaatgttgcagtgagccaagattgcgccactgcactccagcctgatgacagagtaagactccatctccaaaaaaaaaaaaaaaaaaaaaaaaggcttcccatgattaaataacaactttgaattgtcaaagcaaaatactattttgtcttataaatttattcttctatcttaaattttaggtctaaatgactgatcctcaaaccacctactttcacaaatgcttttaaatatgttcacgtttccactcacatatatcatgattatgtaatatattttaattgaagtcctcattccttcttttaatcattcatccaacaaaaggtagaggaccactctgtgctgggcacaggcttgggctctgagggttcatcagaggcacagagcacacatttcactccgcgataagtatcctaacacaccgtaaatgagtaaatagaaatgagtaaacgatatatactatcagaaggtgataagtactatggagaaacatatagtatagtaagtgggaagggggacagaaaatctggggaggttgcagtattaaatagggtggccagctgaagatatcagtgaaaggataacattagaacccaaaaaaatgaatgtagtgagggagtagtgggaaaagtggatttcaagtaaggcaccagcaaatgcagaagtcctgaggcaggagcatgtgaggctggaagccactagacaacctaaggagagatgtcatgcggcctaaaaatggaccaaggacatgagcagctacttttcaaaagaagacatacaaatagccaacaggcatatgtaaaactgttcaacatcactaatcatcagagaaatgcaaattgaaaccacaatgagatagcatctcatgccagctagaatggctattaccaaaaagacataaaataacagattttggagtggatgcagagaaaagggaactcatacactgtcgacaggaatgtaaattagtgcaacctctttggaaaacagtatggtttaacttaaacttgagtagaattactcttgacaactgtgttgtcaacaggctgttctgggataaggctgagagtaggtgagactcgttaggactctaaaaggcatgacagtatgcattatttttgtaaaggctgtgtgttagtccattttgtattgctatcaaggagaacctcaggctggataatttataaagaaaagaggtttaactgattcacggttctgcaggctgtaccagtatggcgccagcatccgcttctggtgaggggctcaggaggcttagaatcatggtagaaggcaaatggggagcaggtgtgtcacatggtgagagggagcaagagtgagaggagggaggtcccagactctttcgaacaaccagatctcaggtgaactcattatcgtgggggcaccaagccgttcatgagggatctgcccccacgacccacactccttccaccaggccctacctcaaactttggggatcccatttcaatatttggaggggacacatatcaaagccatatcaaactggaaggcaggggagacaatcagagattttctctgatttggctcttgccatttaagaaacctcagactgttaaaaaacaagtgtgacgttaaactattcagttatgaagcactgatgatttaaacttagaaatcagtgctggctctagaaagaagttcaagattcttcagggcaggagcgatgacaaagcagacaatgttgagcaggctaaaaatcccttaaatggaccaaaagcttcagattattttaaaaaataaacaaacaatgaaacaatagtgagaaatagcatactgatgaacagctaagactttagagtgagagagacctaaattttgattcatgatacttgcctgttacctgtgagaccccgtgataagttaccttacagctctgaggctcagcttccacacctgctcatgctgatagtaacagcaccaaactcaaagtgttattaaaaggatgaaatacaacaattattaaaaacacttaacacagtatctgttgtgagtgcccaataatgataattattagttctcagctacaataattgaaatgtctcaattatttaaaggcaaaagaaactttatttttggaaactgcacaggatcaaaatacctcatatatattacatgaacttgaaattagttactgtcttagaggttcactaagaacacactgctgacaaaattgcaaagaataagcttacttaatcaacctctagttaattgacccaacaattatctgataatctccacttcctctgttcaacaggactgccctgtcatgctgagaccctgtagctggtcaactctactccatgccactgtgcaattttaccctcataagttggggcctatgcatattaagtgctacgtgtattttttcctaagattgtttattccaatttcacttattactataattatatatgctaattagctgtttaataaagtgatgaaatatgagtacaaaaaaggagagttgcttccacaaaaactaataaaaattattttgaagtcttttcaatataaactgtatcactgttgattacatgtgggtaagacaacgacaacaaaccccaactggcatggggaggaatgttccgtaggattctacatctatattgctggggcggtgttaagttgtcattcagcctgaagaaataatagttctaaaattgtagatgtattatgagtgtggcttatgaaaaaaaagtggatcctcaatctgggaacccacattcaaaaatggatctggtctcctataaaaaattaacaattaaatagctgggtgaataataaaatataaaggtatgtaagcatcacttttttatgactttccaatttctcgtctctaataatcagtcagcaagtagacttgattgaatcaggtaagaggacataactttttatctacttgtattgtggcccttccaggcctccacgtgagtgtcagtggccatggagaagcaagattgacaagctgttcagcttcagaagcatctactcctaggccttcactgttgaaggcattccctagtaaccactttcatagtcgtccctttcttttgctcaaggcctgtggctcacgatgaaagggcaggtaaaaatgggatgagtgaggcatttctctaagagaggaaatgtctcttcagctctaagggaggtatgggggtacagatctctccctctttccaagattgtcagtcttataacaaaagatatgaaaacttagtagtttcttggtagaaacctaagcgaaggggaaaaaaatgcaatcacaatccattacataaagagtagataattttgtaaagctctaatacaagcttgcaaattaccatgtgccaagactcccggggtaagtagaaaacgatatgttttagtcatgttaataatatcagaaaagccatgtaaggagaagagacctgttaaatgtagtcacgtttacaaggatgctttatagtcatcaatgaagacttgtgctaattaatgcttacatgattaactcagtctagttttatttaatttagtccgactacacacacacccaaaactgaactgaagcagggaagacattttgcaaaaagactcgccaaatcattttacaatggattgtggaagaaactttctttgaaagactttgtgtaagttttttgaggctatgtaattacggtattgtttgaccagagtatcatacttcctagcataagcttggatgtaaaatatattggagttttgattgaatatgtggaaataagtgaaaataaaacataaaacagggccactctgccaataacatggatattttaatgtactggattatagttttggtcatgtggacaaaaacattcctgttacttaatctgtgttctataatagtattatatttttgtcaggattactctaattcttgtcaactcaagtatattagattctattatgggtcagcagagcatttttccatatttttccaaacaaactattatttatttatcttattttatattttatttatttattagtgtttttttgagatggagttctcttgtcaccaggctggagtgcagttgcgcgacctctgctcactgcaacttccacctcccaggttcaagtgattctcctgcctcagcctcccgagtagctgggattataggtgcctgccaccacgcccagctaatttttgcatttttagtagagatggggtttcaccatgttggccaggatggtctcggtctcttaaccttgtgatccgcctgcctcagcctctcagagtgctgggattatagctatgagccactgcacccagcctaaactattatttattaattcaataagcacactaataggtgaacaaggatgccaccaagtctaccaagcaaagatggagatttgtcccttcagtgatttagacaggaatgacggcaattccttactagttgacctccctttttctttttccctgccaaataatctgctgtcagattttccttctaaaaacagggctctggggtggtcatcctctgcttaaaactctcaacggctgcccattgctccaagctacagtccagtgctcagcctggccccacagcccgcatcagggagcacttacctactgcgaagctgctccccacttcccacctcttctgttatccctacactccagcaggagcatttacctactgcgaagctgctccccacctcccacctcttcttctgtatccctacactccagcaggagcacttggctactgggaagttgctccccacctcccacctcttcttctgtatccctacactccagcaaagctgttgtggctcacctaagtattttatgttcccccaacttgatcgagatctctcttttctcctccatttccgcgcatccaaattctagaccctatccaaaccccacatcttccaagttctttcctaattccccaaccagaagtaatgtttggattccagcagcattttacttgtatcttcagaggatacacgatcactttctacctgggattagaagttttatgtgcataccttgctctttttactgggatgtggtattcctgagagcaggactgatactgctttatctctttaactcttttaatagttgtcatagtttatatgtttagaaagaaaatcaatattcatggataaggtagcaaggattcatttagaatacaaaagacagaagcttagatcagacaaaatctaatgctaactatataactgagtcaaatatttcaatgtgaaaggatgctaaaagatgatttggtctattcattttaaaaattagaaaattaagaagcagaatattaacagacttttttttgcaattctatattgtgtacccccagataggatgaaattttaaataattttcaaaatgtgatcacttttatttcactgtcttaactcattcccacaaacatatcctaaatcatcagctgaaatgacctcaccagaaccagccctcttgttcttctccttcatgcgcctaaccagcacaatgatctgattgtttttctaattttattttgacccgtatacatggcaacaatatggtgacgtggaaaagaacatgtactttggcatcaggtatctccgggttttattccctgctctgttactttcataatttgtagccctcaggctctctgagcttcagtttgctgatttgtaaatttaggatattgaaaagattacaatagctaatattattgagaccttgctaaatatatactgttctgaatgctttacatttattgtctgaaatctcaaaacaactctatgaagtaggcactattattaaccacacacttatagatgaagtagatactataattatccccatatgatagacggagaagtgacggcttagagaagttagctggcgtctagagtcacacagttactgaagagtggagctagaaccgaaaccccgttcttccgacttgcgagcccatgaacaaatgattattgtgaggatgatttgcaaaggccagtcctactgtttgctataaagagtgtttctcaggactcaggttgaatgctgttattttaagtatgtatgagttaattttactccaattacagaaactctctagttgtggggtttaaggaacaaatgttacattctctatcatgagcactccccatctgttgacattaggaatcttagctaatttttcttttactgttgcaatttcttaaagtatggcaactcttttgagttaaattgatagtgcctgtccattttgccaactgaagaatctcactagtgactgaatgtcctggggtgctatcttcaagtttgatacccagtccttcccccacacccctttctaactgccctcaagcagaggaagaaatatcctaccaggtgcaacaaccaccaggtagttcaatagattttgcaaagcacatttttctgaactattcagtagaagcttctaaacatatctttatatgttctgaaacatataaaacaaagcacatttttcagaattattcagtagaagcttcgaaacataactttctctataaagtttgcttgttcaagcttttatgttaatatcatagtttaaatgaatcatattccttaacattatttttaaaaacaaggctttgatggagaaataagtcacgtgtgaagcacaggacgtctttaaaaattagcaaggagggaacagaattaccaaatgcactcatttactggcattttatttctacagacatcagctcaatttcttctaaaataaaagctaatgaggacaatggcatgtccaaatgcctttactggattatatatgccacaagtatactatgtgagtgagccctgtagcaaattggatataatagtgttgattctgtattgttggtacattgggaaggggtttttatagatttgaattttccaggaagattactagggctataagaagatacatccaaccatgctatttgtccttttgtctataaatttgtctttcatctataaaaaaggtgattgtttgtgtgaggagtccagcagaccttacaactataaaacattgtgaatctgtgatccagagaggtagatggataggacaaaccaatgaatcacctaaatagcatccaggcatctctgtgtgtgctaaactgtgccataaatgaaagtaatcatcttctcttctcttcccccacctctctgtaaagtaacctcctgacagaagcttcacctcttcttgttgtgctcatgtattccagatatcagctgaggtttcccaagctccctaaaatctacagaagttcggctcaaacccctatcccagatgctggagatgaccaagttctccagaaacacgtagcaaattccagggtgggaaggagaatctgagcaaggagacaacgattacattctcatggtcacttgtctcttgagctagtgctttattggaattagtttattctgttaagagtttcccaaatgtcctgtctttatgttacactcacaacaaaacagacataaagcactggcttagcctccagttccacaggagcctcatcaacccatgccttcaactgacgcctaagctgagactaaagaagatggtaaccaagtgaagagatggaggtttggagtgtccaagcagagaaactacatgtggaaatgcatcgaagcaagaaagagcatgacatcttcttagtactgaaagaaaatacgactggacttcaaatattttctcattcgtggggttaagaggtgggtgtttctttactcctccttttcaatacatcccaacaaaacatctgtgcacttctttagacaagaccaaaatgcaaatattttcgttgctgttctttgtactgtcaccaaatcaaaatagtaccttagttttgtataattctttacagttttcaaagcaatttccactatctcatttgaaattctcagaggcccctcaccaccaaagataatcagtgaactatctttttcatggatccatttgtgggtttcaacaaaaattaactatagaacttactgaaacatcaaacattttaagaaatgggaaatattatttttttaaccaaaaagcaaaaagagtggtttttcagacacacttattgcatatagcaaagcagctcatttggtgggtgggggtggggtatggcattttttttgtcttacagccacgagaagcagcattttagaataattatttacaaatttgtaaaactttaaaaagaatagactatataacatgttgaaatagaatcattgttacactttgataaaacattaaacaaaacccaggtctcccttttcacctttctaacctcccctttggtctgatgacagtcatgggggtgagggattcaccgggattcaggtaggggctctgggcctgcctaagccttgccaagaagcagttaccagcttggcagtgcatacctgaagaaggacaattgaacataaggctctgttgacgtgcctgtaaattgttctgttagagttggtctatttaaagcaattatgaatgcatgggtcagtgctattggaaaagagcacttttgtaccctttcacaggcctcagaagcagtgtattctccccatctgaccctccggatggttccaggccaagcgtctctcagggaaggctggtttctctcaacgccccctttctgtctgtgtttcttggttaccagacttgcttactttgtactatcctcagagcccatgacttcctctgcttttttccctatggaaccttccttttctcaaaagtgctcacaaccttctctgtgtcttagtgatcacaagactgagcacatttcctgttcgctgaataagctctattcaatacaaataaattaaagaggaataagcaaattgctttaacgttgtgattgctcattaagactctgaaaaatactcaagagcatagacttgttcccttagaaatacgatcaacaggtcattgaaatctttgaacattaagtaactgctatgtgtagaagtgttatattgacattgttactgtggatctcattttctcgctgttttgataatttttactccacattccattaaaattattattttaaaaaattaacacaaaggctttcccttcctctgtgatgggcaccagaccaaagttgatgtgcaatagaaaggaaatattaatcagagtgcaaagcagtggaaagatccccactgctttgcagattagaaatggatgtcaggaagtttcctgcaggaggccatgttatttctttactctctttgtaaagaaacaatttacaaaaaatgttgagtcttgccctaggaggaaggcggtcctggagacaatggctttgccctgaagaagaccatgctgttgaacaccatataaatgatgtggcagtgagagccgaaggctgtgggatctgagagctggctcagcctcactgcccaccagtcatgggatcttggtgaaatcaccaattcctctgagccccagtttcctcatctgtaacgtggatttcataaaaatcacttcttgtattgtaagcgttgaaagcatgaatatacatataatgtaaataatttctcattggataaatcacatgaaaagtactcaataaataaaacattattgtttgttaattcttgatttagagccatctgagtcttttctgtacccttgtagataccttggtcagctccatggagcagagctgagttgacagttttggtggtagtgaactgctaaggaatagaatgtttgatgaactaatatcccctattccatgagtcaacatatccattcctgcaatgttactgagggaaggccctgggttgtcatcactgtgacaatgctggtgcaataattcaatgaattctttctgcttgttgcacagacaaaacaaattcactgagatggtgacactgcagtaaaaaaaaaaaaaaaaaaaaaaaaaaaaaaaaaaaaaaggtttaattaacacaagactggccatgcaagagaactagagttatcactcaaatcagtccctccaagaactcagaggctagggtttctgtggattctttggtgtgtaggaggctagggaatgggtgctgctgattggttggggatgaaatcacagggtgtggaaaatggtccttgtgcagtgagtacgcctctgggtgggaccacagaaccagtcgtcatgagtcacagctccagcttgggtctgtcagttgccagaatgcaaaaatctgaaaaatatctcaaaaaaccagtcttaagttctacaatagagatgttatctgtcggagcaattggggaagacacaaatcttcggacctctggccacatgattcctgggcagtaagggattacagaaactataattctgctacattttagaattcaggcccctctcatgatcttaaacttatggcctttcattagtttctggtccttgagcaaggatggggttggttttagggaggacctgtcgtcatccttgcttttaagttactaataactgaattcctcccatggttagcttggcctacacctaggaatgagcaaagacaaccagcctattaggctagaagcaagatggagtcaaccatattagatttttctcaccgtcataatctttgcaaagccagggtttcactagcacccggtataatgctagaaacagcatagggcccaattgagatctactaacttgaaatgttctgacatacttggtagtaaatttttttagtagtagaaaatctaaagtttaactgttgcacacaaacgttttttttaatcacataggaataaaattaattctgaatggaaatgaaaaataactaaccaagagcaacagatcatctgcattgttatccagacatattcagttgtttgccaagaaactgtaagttaacctttgagaataagaacagtgtctttgttctgtttattatagatggaacagaaattctgtgaggattccccaatgccatccatggaactgtgtgtgctaacatgaatttttaaaatgttgaaattatatttagaaatgataagaaaaccaaataccccatgttctcacttacaagtgggaactaaacattgggtattcatggacactggggactaataaagggaagaaggaggggacaagggttgaaacactaatgatttggtactatcctcactctctgggtgatgagatcattcatatcccaaacctcaacatcatgcaatatagcatgtaacaaacctgcacgggtacctctgaatctaaaataaaagttgggattttttttaaaagaaatgatacaaatggaacagcatttagagagttcatatgcgaggtgcagaacaatgacacttgttttcttcattttccttttgtattatttacgatgaactggaatcctgttcatttatactgtatcatgaaggttttaccagaaaaattttagatttataaaagagaaatcaagactaacatttaatagtttcatacacttaatatgcaagtctgattaagctaataaaggtaagttttaatgtgtatttttgtttagaaatgcttatttatattcatctttaatagtatgggttgaattagcattttagtcgattggataaatgtgaccttcaacttgctgatctagcttttgcttttcctgtattaatttatgaataatttacatttggcccatgggcattttacaatacacaatgacatggatatcttgataaactgctaattaacaattttatcagcaaactttccccaaaacagagcagatatcgtgctttagtaactttgtgcttttaactatgtctaacatagtgctttgcagggggtagcaaaggataaacattaagaaattattaatttccatgagctactccatgaatatttcaaatgtcatttcaagtacttttcatggaaaactaaaaccttgttcttttcatcgtaaaggattgtattcattgtttattagtctatgcatttggactgtgtgacttagctgctgataactttaagcaaactgaaaatttttcaactaaagacaattttcttgtaatggcaaaataaataaaacacatgtaagaaatgcaactcaagcacaaacctttatagaaaatactcgtaataaagtcaacagaagtttttctttaaattgagacataattttctgttgtccaattagaaaatattttaaaaattaagaaaatccattcgtaggaagagcaaagaaaatgggcatggtcatattcttctcgagcagtgggcagtagcataatcctttagatagtaattgggcattaatgtagtaatcattccaaaattgtgcatattttttgacctaataattacataagtagaaaaatttaaggaagtaactctaaattcagaaaatgctttaaagaaaagtgttcatgaaaatattatttatatagaaaagaatcaaagcctaattctccatcagaaaggaaataattacttgtgatacagccgcatgattgaataatgtggacgcattaaaatgcctacaataatctggaaaaatatttaaaattaaattacataaaaaatacagtataaaactctattcaacaatgttaataatactttctttgaaaattgaattatggatttttttctcttttctaattttatgtatttaatatcttttaactactatatatttgtcttatagtttaagaaaaataaattactgagttcattgcaggaatccttttggagattatgctctgaattactttgtagcccaagaggttatatcatgtgaactcaagatagcaaagtatggttttaagagctctcagatgtaagggggcccattaaagattctttgtctaacccagtcaaaggcagaggggaggtaatctgtggaactcctggtcatgtgcagagatctgtgtgtctgaagaaatcagtatgactacagcttaaacaaaaacagatggaatatccgcagatgaactgaatatatagacaaggaacagatcaaacttgcccatgttcctcctcagggaaatggaaagatttccaaaaagtttgtaaagaaaaatgacaagatccgatttacattctacagagatcattgtgattgtttaaaggacagtggattgaatctaggagaccagttgaggagctatggctatagcagatggacgcagtaatggggcctgaattatgatggggagtggcagtggagatggagggaggtagagatatttgaaacatattgtgaagataaaattagcaagactttgtgatggattgacggtgggaaataaatgaaagtgagacatcaagaaatttactttgatttatagttaagaattttgtgtttttttttaaatcacaagtgagtgctgaatttgattaaatactgttttagcatctataatatgattatatgatgttcttatttctgttagtgtgacatgtcgtatttattgatatttaaatgttaaaccactttcgtattttcaatataaatttcactaggttgtaatgtaattatctttttatatatcactattaaattattcatttatgttttgcttaagaattttttatctatgtttaagagagatactgggctataattttctttacttatcatgtttttcttaaggttgggtatcaactggtgtttgcctcataacagtagtttggaagaatttttttctttttctattctttgggagagtttctataaggctgaggttatttctttcctaaatattcggaaaaattcacagttgatccatttatatctggagttttcttggtgagaatgttttttagtaaaagactcaatttttcaatagataatcacatcttgtatgtatttgtttcaattgtgacatctcaggatgtctgttagcttcagttgtaatgagacttttacagaatcctcttcttgtgacctcatacccttgttacaccttgggtattcactgcagtctcttggtccacggctttcagctgcttatcaagtgctttctgtttcagcatctcccgatcagtgttatgacgcatggctgggttatatattataattttcagggccattataaaaactaaccataccattcttttgcttaatacttgcaaaaattttgccatcttctatcttgctttgacatatttttctgccttttaaggtctagctgtctgcacaggttttgccataccttgtaagaatagagctaaaaagtctttgtaagccactgagtgttgttcttataaagagataacaagcgttgcttcaccagcctttttttgttatcataagtaataatttcactgtgcttgtttaccaggttcagattttggagttctgagagattactggttgaatagacttgggctaactcataatatgcattgctaaggagcttaatgaatataccagtaatttgagatctatatttggtagctattgtactctgacaagtaatagcaaaaaaactatcatcaactttttacatgattctgaagtcaccctcacagagttatcaagaattatcgacagaaatgtagttataattaagcatttatcaggctgccctttgacccatttccttgaaaccgaaactcccgttgcactgggtacggaccacttgcatccccactgttcctacaggtaggatttctgaccttagaatcatagggcttttgcttaagacaggatctctgatattggaatcataaagcttttgcttaagagttgcttaagcagatcctgacttccagcaggacaatagaggttaaccagcttcaaggccccaccgaagacctgaatgagcatgagaagatggtttcttcatctcccagccccatgactttgccctgggcaattcagccagtcagtgatctccacactgcagcccatgccaaaacccttaaaattcccagcaccaaactactcagggagacaaattttgaggtttcctcccatctcctcatttggcagccctacaattaaacttctttctctgctgcaactgggtatatctatgtattgacttgccacactcatggggcaaaacttatgatttcaatccaacatgatatgacgacctgacatggcaagagtgggttcagcttgttcagaaggtaaagtgctcttcagccggtgcaggtcatccctccatgagaggagtaacataaacattgctttgcattgtcgttttctattttacaatgtgcctaggattttgtctttaattcaggtatggtaatgccaatagatcaggagtcaactaccattgaaaagatagttggggccgggcatggtggctcatgcctgtaatcccagcactttgagaggctgaggcaggcagatcacttgaggtcaggagttcaagaccagcctggccaacatggtgaaacgcgtctctactaaaaaatacaaaaattagtcgggtgtggtggcatgtgcctgtcattccagctactcaggaggctgaggcaggagaatcgcttgagtccaggaggcagacgttgcagtgaaccaagatcgcgcaaagagtttgtcactcatgattcccaagagaggggcatgacacactgagggccacaagagaagatacaggggcagtcaggagggaaaaggggaggggaaagtatggaccagagccaatactgtccttgttgaggcagtaaatgatcaaggtagggtagaaaagctgagtgggagtaggattgggtagtttgaataatttcagcagactctgggacatgagggtcatccctagttttctggtaccctgccctggggcgatttagggcaggaggagaatgccctgtactgcaggagactgatgaaggaaagtggatgtgggtatgtatttagaactggttggcttgcatattaaagttgtgctcataggaaacttgttagccatctctaggaaattagctaattagcagtcccccacccccaggttcataagtctccaaatatgtcaaagcatcataaaatacagaaagtagaaaatattattaatacagctccattctctttagagatatccatcatagccatgtcaagagctggaagggcaggcttaaagcatgttgcctgcaaacaaagctggcagaaatcagcatgtattcaggtcagctggtttgtattcatccgcagcttgttatagctcctttaaggatgccaattcctctcaggggctgttttctttccacaaatgcattagttaactgatggcaaagcccatcacaagtactgatgaaaagtgaaacctgtgagaatagtgtttccacgtcaggaacagtaggcatagaagacctcacaaacaaaacagcaagaagcctcaaaaggtgttcctgtacatcaggagccccaagcacaatacccagatgatataagttctttgcaaggaattctctactccagtcaatcagttcacaaagctgagtcatttgcccttgagttgagagctgtggttcactggtcacatattgctttggggcagtcatcattcccagatacaacccaagcggtagaggcagctcaggcaggactaggtggccactctgggaggaaggactgcagcaatttagcaaagggattcaaacatttttgaagagtggataagctgatttgcaagggaaccgaggcaataatcaagattgtgtggcactggcaaaaagataaacctgtagatcagttgaatagaattacagttcattgactttgacaacagtgcccaaaatcaatcaatggggaaaaaatagtgttcaccaaatggttctggaaaaactgaatagacacatgcaaaagaataaatttggacccccttgctcatactgtttgtaaagattaactcaaaatataccatagccctaaatatgagagcaccccaaaagcacaggcaacaacagcaacatatataaattggactacattaaaatttaaaaatttaaaaaatttaaaaatttcttgataccatcaagaaaatgaaaagacaatccagagaatgggaaaaaaagtattcgaaaactcatatatctgacaatgaacttgtatttacccacactatgtaaagaactcttacagctctataataaaaagacaaataatccaattaaaaaatgagtgtagaacctgaacagacatttcgacaaagtagatacacaaatggccaataaacacataaaaagatgttcagcatcattagtcattagaaaaacgcaactcagaaacacaatgaaataccaatccaccctcactagagagattataatcaaagaaacagacaacaacgtgtgttaacaaggacgtggagaaactcgacttcccattccttgctgagaatataaaatagtccacctgctttggaaacattttggcagttcctcaaaatgttaaacccagagttaccatatgacctagcatttcaatcccaggtatatacccaagagaaatgaatacatatgtccatacagaagtttgtacatgaatgttcatagcagtgttatccaaaatagcaaaaagtggaaacagcacaaatgtccttaaactgatgagtggataaataaatatggtctgctcatatgatggattattattcgaatcaaataaatgaaaataaaaggaataaaaatactgatacatgttacaacagggatggaccttgaaaacattacactaagtgaaagaagccagtcacaaaagccacatatttatgtaaagtattcagaataggcaagtttataaagacagaaagcatattaaccctaatatctagggctgaagactgtagggaagaaggattatgaggtgaatgttaatgatgataggatttatttttgagttaatgaaagttttccaaacttggattgtggtcatgccatacaactctatgaatatactaaaaaccattggattgtaaacttcaagtgtcgattttatggtatgtcaattatgcgcttataaaactgctaaaaacggtactcagaaaatgcaataaaaattaccttgaagtttgaaaatacaatgatttaaatttatttaaattatatcagattataatacttaaattttatgtagtaatacttatgtttattttaaagttatcaccacttatttaaatatacaatcatgagcctggcagttggttaccaacccaatttctgtgctttgaccaacatcattgaatttggaaggcaatgtaataaaaggtcatgagggccttccacatttttctaccagaaatcatggtgaacctagttaaagatggtctcttatacagttgacaggaaatcctgatctacctggaaaaatctctcactgatattacaagagcatgtcccttcaaaagtagtaattcattgctagagaagggtaacctaccgttttcatagcacacttttttgagaagtccttgataagactcatttctatatgtgagtcaaaatttttccctataagttcacactctcaattatttagtgcccacagtatagggataatgatacagagctcaatagtaaaaatgtatatggtgtctctcctcctgtggctataggcctgacagtgaagaatggaaaattcagataattaagaatcttcacaatgtgtgataacatttaaagccccaaagaatatgaaactagatagagaataaatctgttgataatttctagttttaagtagctatgggtggcacaaactctgtataattgcatataatcctcaagaaaagcctgtacagatacaaatgaaaagacataaactcagagaggcaaagcatgtagtctacggctacacaattaataagcatatatagactgtaaataaaaattcaaaaaatatcacccgcttatgtcaaacacagtaacaaatgttgacaagaatgggtagaaattggaattctcattccttgttgagaatataaaatggtgcctccactttggaaacatgttggcagttcctcaaaatgttagacatagaatcggcatgtgacccagcatttcaatcccagatacacaccctaaagacatgagaacataagcccatacaaaaattataaataaatatatacataggggtgcatatatgtacacatatttaaccagtagtagagtttcaaaataagagcattaattaatgtttcatgccagtttacaaagtttattcagcaaggctcagagatggtcagtggcttgctacgagttaactagctagttcaattagaaccaagactagactccagtgtcagacttttggtgaaaaagtacttagaaatgtatcaagggattcctgtgatataattccttacctttgatgaatactgagatttctgttctaggtcaaggagctgacatcttttgttaactttttttttttctcttcttggtcctgtttcactttaggagtttgaattgtaaattccattataaatattcactgtaatttttccatcttttacaattttccccctttctatccagaagctgattattaagagctaaatgtgcctattcaaatgaactaggaagctaaataattgtacagtggaatccgagccccagttcttttgggaaggtgataatagtctaacctgaccaaccaacttttaaaaaaatccactgagccaatactattcaactgtacttcatttaagtaatgtagatttggaaccagtcaaaactgcctactttacaaaaacacttcttcttaacttactacttccaaattacaaaaagagcacctttcagaatatgtcttcagtaatgagttctgccaatttaaaagtaagaaagtctagcagaatgtgtgaatgccaaaagaagaataatagatgaaattcaagaaatctttaggacttacggtctttagattcagtatttttcatattcttggtacattagctcatgtctttctctttcttgtttctaaactcccaagcaacataatgatgtattgttaaccaatttggtgatatttttacaatcgttagagtactacaggctatattatgtaaaatatttctttgtgccctgttacttcggcctgctttagttttacttcttttcctttatttttaatgactttagtgtttaactctctcaaaagaaacatggtgctagtgaatactgtcaatttcaggccgttaccttcctgggcacaataactggccagaaatgggcccaaactagacccatttaaagtccctttttacttttgagacttttctaaatggagctggcagaacagtttgtttggactatgattctactgaagcatgactctagctgtgtctctccttcaaatgtcatagttacgacagtgaggaccctctggctcctcctctccatttctggatggttttcccattctcctccataaaaccatctggtttggaatcacatattgtcagaccacctgctaccactttgagttgtaggcatctactggccattggctcactcttctcctttccagattttagttcttggcttaatgacttgctttctaacactatacattcattgttcttggtgatttcaatatccacatagataatcttcctaaaacagaccacttggttctctgacttcctctcaagtacacttgttctccccaatttagcatctcccttccatccttatagcctagactgtcattacttataagaacaaacccttcatgatggaaatttcaagcattgcatcctaccatttattgttctaaaatgctcactctaaaacacaatcctcccacctcctcaaaacaaagaactcaccttttcacgatctaatcccctcttctaactgttctcattacccagctgaaattacgtgatcgatattttataatcagtctctcaaccacactttcaactcctttcttctttttcatgctactgcgctagcaaaacccaaacagatcttatctatctttctgctcgccccaccctagcataggtacaggtaaacaatctggacccattggaccccccaagaccaaatgggtccacattaaaacacaccttcctttggccgggcgcggtggctcatgcctgtaatcccagcatttttggaggccggatcatctgaggtcgggagtttgacaccagcctgaacaacatggtgaaaccctttctctactagcaatacaaaaattagctgggcatggtggcacatgcctgtaatcccagctactcgagaggctgaggcaggagaatcaattgaacccagtaggtggaagctgcagtgagccgagatcttaccactgcactccggcctgggcgacagagggagacactgtctcaaaaacaaaacaaaacaaaacaaaacaagcaaaaatacattttcctgaggagtcatttaaagtgcatgaccattaacctcaagttggccctgaatgcagccaggcaatcagctgagcttcccttgcccttttattcttctcccctcaaacctacaatacatcctcattctgttcactgttatctgatgactttgcattctatttctctgaaaaatatggaaacaaggtgcattaatcagggttctccagagaatcagaatcaaatatatgtgtatgtggaaggatggatagatagatagatagatagataatagaaacagacagaattaaggcaagagttgatactgcagtctcaaatccaaaatgtgcaggttggaactcaggcaaggtttctgtgttgccgtcttagagcactattgcttctcctttgggaaacctcatttttgctcttagggccttcaactaattggatgaggctcacccacattacaaagaggaatctgccttactcagtctattgatttaaatgttaatcacatctaaaaaaatcacagcaacccctagtgttttaccaaacagccaggcagtgtagcctagccaagctgatgtgcaaaattaaccatcatacaatgagaagaaggatttctcaagttcccaccatcacttctactcccacggacgacagtgcccaaatcctctctctttccttatgttgctgtgcgtcaggcttctcagcctcagcactatctgtgttgggaggatccttctcattgtggggaagctgtactctgccttgcaggaagtttagtagcctgtctggcctctatccactagatttcagtagcacccccacttgtgacaactaaaatatgtctccagacattgccaaatgttctaacaaacttcccccagttttaaataaactctctgtgctcctagagtcaggccctcaagttgagcatgagattccaccttctctcaggttgttgctccagcaattctcttctcacttcatgctatccccaatttcatcagttttcccctctttgttggatcattcccactatatacaaatatgctttgttctttccccaaaatatctcatagcccactttactttttatctatcccgtaatttcttttgttctgtttgtagtaaaattccttgcaaatgtttgtacttattaccaattatgttgttctttctcaaattcacttcagagttttcccttgctactccaacaaagcagctctcatcaatgtcaccaatgaccctcacgttgctaaatccaatagttcttctctcacttgtcttatgtgcaatatttgacagtcgatcactttctcccccttgacataatgataaaatgagatcttcctcactgtcttgaccacataaattttgagttccaagataatcagaccttgaacctcttgtctatcacactcactcatttgataatcttatctagtcccttagcatttaatgtcacttacatgctgatgaaacctcaatttatatcttcagcccaagctgctcccatgaactccagactcatacgcccttgcccttagttgtgggactttgcagttccttcgtctggtgacagccccttgatttggggtttgatcacatgactttcgttagctgatgagatgtgatgggaagtcgcagggtgccagttctaagcctaggccttaagaaaaattgacgctcctgtcttccaaattcccatagtggttttacattccatgaagacattctccagttatcctgcttgtccaaagatggtaaaagagacattggagtaactaggacctaaccagcagcttagagttatgaactgtgagctcagccgcactcagccgaaaccaagcagctcagtcaagagcgaatcatggcttttctctgcagtcactcagttttggaatcagtttttgggatgccggaatgctgtgttacgtggcattattatggcaattgtaaatgcaccacaactcctaattttcctcctgcacctgttttgccctcaatgatcctcaattctgtggataataattccagccttctaatttctcaggccaaaacatattagagttattcctgacatcactcttcttctcatagctcacatccaaaccattatacgatcttaccttttgtacctttaaaatatttctaccatactcccatttctcggattctccgtggagacgaaagtgaccccaccttggatgctagtctgccacagtcctgtgaatgcctcctgattcctactttacttactctcccttgtgtaagaacatgccaaccttgatgatgttattgcacaaattacaggctgtgacacacctggcattcttgcctgttctgcagggctgcacttagttgtccatacagaggacatacaccctctctctatggtatacaagccctgggtctggggtttaacagtgtggaaatctacctgacctgctactgcccaagaccatgctgctgttcataagttttccaataaattgccctctaccaacaaaccgagtttatctgcctcgttctttggcttctctgttccttctgtgtttggtggtctttttgcatatatggcccttttatgggacattcattaacccgatgcaagctatcaccatctacaaactggagtgtcacaatgggttgccaaatggattccctgattctatttgccccgttccccatagagttgtttttcaacacagaaacaaattgatcttgctgagtaaaaattatatctatctcctgcccaaaccctccaggatctttctgcctcgctcagagtaaaagctaaggccctaacccaggcacgcaaggcctcattggatctgtggctcccaacatcccttatctctccaatctcatcttctgtccttatctcactcccctgcagccgcacccgccctgcagaagacatgtgcagagcacatgcctggcctgagttcttcatgctgacactgctctctactccaaatagctctataacccgcactcccgctgctctcatgtcctcaccagatgctgccttcatgatgaagctctccgtgtgagtcggctagggctgctgccatcacaaagtaccatgaagcaggtggcttaagctacagaaatatctggtctcattgttctggaggctagaagtccgaagtcaaggtgtcatcgaggttggctccctgtgaggcctgttccaggcccctctccttgtcatgtggatggctgtcttcatgctctcttggggtttgtcctgtatcttcacattgtcttcccttttgtgtccaaatttcccctatttataaggacatcagtcacactggattaaggcccatcctaaggtcctcattttaatttcattacctctgtcaagatcttttctccatccgaggtgctgtgagttgcgatttcaacgtataaattttgaggagaaacaattcaagcccaaacaccttctctaatcatctatgttaaactacatcctcatctgcaccttatgtctaatcatctatgttaaactacatcctgtaaaatgagcatgattccaaaaggtccttttctcctttatactcttctctcactatgaatggaaactgtcaggtgtctcccagaattatgtagatatccttggttttaatttatttacttgacagagagaacttgtagttcagacaatccaaaagaataccaagaaagtaacatataatagccttagaaataccaaaagggagtatttattgctataaatactaaaggctaacactctgcaaatcccagcaccttcaattctgccccgtttgtagacaatagacatagaagggaagcagcttattaacttaaaagggaggaggagctgttaacatcactacaaataatataatattgttaggcagagtataataacaataaatctctagataactttgtggccaatatttgaatgatctttgtatttagagatgacagttactatactgatacacaactatcagtgtgtgcttaccttttatgcaaagaatgaataatattttgtaatatgagcttgaaactatcatcttttgatttgtggctataacattcactgaagatcttagagcaggcgatttaacttcttttttcacctttggcctaaaatattataattccatttaagaacttttggtttttaaagaaaggcatgaagcttatagctcatatcttcctaacactccaaataattaatgaataaacaggtataatgcacaaaggtgtagaacaagctttgcagtatgcaaccttttgccaagaaactagaaaaatgatatttatatctgtatatataaacactaaagcatacaaagaaactcacaaatgtggttattttccatatatatattttatatgctgttttgattttcaaaccatgtcaatacattacctatataaaaaatacaaaacttattattttaccttatcagatataaacaaaacatatagacaagaaaaagagggcttgctttcacctcacttctcctgaagcaaattaacataagaaatgagaatcaaagcttgttcctgtgtattttccaactattgtcttcatttttatgagaataagagtataaaaagagtgatgctattttagccagagtactatgtattgtaaactgaatgtttttagaagagccctttttgtattcactcagaatgaggacttatttttgtccccagctgcttttggaagcatgtgcctataatcggagggctgcagatacccaggcgtctgccaggagtccccggaacaaagccgcagaagctggtgccctctgcttgtttgtgttcatgcttggttctggatgttgcttttcttgaaagaattgacattaagtgcagtgaaataaatccattttgtgtgacattaaatatttttatcggctgtgtaatcatatatataaaatctccattcctgatgaatcctgaaatatgcttataaggatgaccacatttattgtagagcaggaagacagcaatgccagttctataaaagccaagttgaaagaagcaagtttatgcatagtgatctggagtgtccttagtttatttttcatgtacctcactttcatcttggtgaccaatttatctatatttgactaatatatgtatacaaaaataagatctgcataatgcataacacaaacatcaaaactataaaggacattataagtgaggtttcaacttaatgcttcatgatttgttgaccctaaatattgctacagatattagcaaagagatcgtagaataagaattttatttggaataaactactctctatgtaatcggctccaaaacttttaggaaaaaatgagttccaagagaagatgaattgtgaaaatttgttgaatggaaccagtagacacaaaaaattgctaaaaaaaaaaaaaaaaaagtttaagaattaggttttctccatagatgaatgacatttcagtataaaacagtcctcacggaattgctaattaagtaagagttatacaagcaaagactgaattacaatactccacttcagtttatccaccaccttagtgcctaacttgaaattttttcatctattaattcagtgttaacctgattaaaattttaaaataatctgataaaatttaatgaaatggtcatctctctaattttccagaaattcctcatgtctatgcctgtagttctataaaattgtagtctgaaatctggagaagagaaagagagggaataagagtaagttttttttattgtgttatttataacaacaaatggtcttttgagtaccaaatatatagtccttttatgcacagggagacaaaattctagctgtttcagtaaatgctcacttgtagataattcaaacaatggaatattccaataaccattttctttatgtattagcagataatttcacagtgaccttgaatcactgcagcattccaaagtgttctgaattatcagagttacagttatggtcaatttagttttagtgctaagaatatgttattaatatgaactatttgaaattgttacattagactaataatctctatacgttgcttattaatgttagaagttcatagatatccttgctgatcatatgtttgaaatttgctatacttgacatttgaaaataaataataatgataatgctctagagatgttcttttgaagcacaagttttgactctttcagaatgcctttaaaaacctttttatattgaaataaatgatcctgtcatggaggctcctcccctggattctcatgcagcctttttactgcatgttatattgcaatgtttgtcgacatgttcatgcctccactaagacatgaagcatctagagggaagggactgcctgtgcgtgtataatgcatgaacacctgttgcatttaattgcataatatggccatttcccatttcagttttatgggtgcccagacttttattcaacaaacatttattgaactcctgtaatatgattttcagagtgtcaggataagaacaagaaagttaaaagatcaaagatccagagatgtttgttgatctccattcagtgtcatctggtgaatgaagtaactaggccataattacaatgcaagatcaatgctacaggggccgactggaatacagagaatgaagaaccctagtgtgaagaagaggtgatacataaatatcaccctagacattgaactagggttctcatatagtggacagagtggcaaacgcaaagatgtggattcagaagaggtcaatggtgtggactgggaaaagatcagtgggcctggatgacagagtgtatgaggggctgatgggagctgaagcaggaaaaggacacagtgggctttgtgcacctctattcttacactgcaggatgcagatgggaaagcaggagagtcagtgaacggtgtggagtattgactggaagcaaagaggaaatgcagaaaaacaaactttacagctgcttattgaaaacagctaccatttatatagcactagacaatttgctaggctacctgcatatactatttaatgtaatccttgcaatagtcctgtggggagggaccatttccactagtttccatttacaggtgagaaaaataaagctgcatggtgctcagtgacttgcccagctatgaagggagaaaatagtacagtctgttttcaaatccggaggcatatgactccaaagtaaattcatatgatcactgttctatgccttatggccaacgtctgtttccgggaacgtgatcagaggggattacaaaacaaagcaaggtatatgtgccctggccactctcctcaggcgtcttgccattggggccggtggcaagtcagaacgtctgccatggagcagcgagcctcagagtgtgacgattgcagtgagtgtgtgacattgaggtgattaactgtcacacttgttacactaaggcaatttttaaataaaggcacatagtagagagttttccataatctgcacagtttagaattttagcggaacccaaaaaccactaggaacaaaagaaaacgtgactacagtaacaaggcagcctatgcaaatagacccgaggtcaccccgaatatgcacttttgtggtcaactgcctgacatccttgctgttttatgttcactattgtttgaagatccatattattagtttgctctcctttggcctgtgaaattgatcttacgaattttcttttcaatctgtttcagtaggcatcctaatttacattgaaaatatatggccagtgaagaaacagcctggagagatctacactcacatggatcttggtgagtacgaacatgtgtacattgtgtttactaatctttcggcggagggcaaaagggagcccagaagagatggaggcctctcaaccatgacatatttggttatgttttccatcatctgatctgctattgcagtcaaaaagcaaagcattaagtagatgttaaaggcagagatgtatttatttatgcattttctggcagccaaaaagtagagatggattaaatgtgtggtcttagagctggatagctacttgtatctatcatcacatgggtttgattttgtggatgggagtctcaatccacatttaattaaactcccttgctctttcaaatgaaagctcaggaacacataaaaaagtgtttgcttttagtgcagtgcttctgtggcttccagaattggatggatttcatcgcatcctgactgatctatctcaacaggaaaaatttaattgattccatttttgcctgtgccttctcttattttattttagagggatttagaatttgagttgtctgaacgcttttgaaggctcagagctccaatttagtgtgaatttatattgtaaatttgcaaaattctagcaataatatgaatgtgagtaaacaaaatgttgatccaaaacatttgatttcataaaagacatttgcatagtatctaaaaattagtgtcaatattagcgtctttcatgaagctctgaaacttccaatagttaaaagagataaagaatatagagaagattttaataagtaacatttccctcatatccccactacccaatgtaaacccaaatatattatgacctgagtgagatgagattagaaatgtgattgaacacaaataagtggaacatgatatattttataatcaaaatatcataaattctctaatttccatttatacagcattgtccttctgaggatctcaaataattttatatcaattcataagacaaatcaacatattaaaagtagaaattacattgttgttataatatgctctgccttgaaacaagcaaatttgtatatgtcaattaacttttatcataaagaataagtgtagattattactcctatcaattttctctaatactttggtgaaaattaatactttttataaatatatccaaatatctgccttttattgctgtctttcatatctccagtctattagaacaaaatatagtctatttcctgatgattaagaattgtaattataaacgcatatttaaaaataaaaaattgaaataagcagcattcactaaaatttagaaaataagaaaaattaatataatcatgcctgaattattactggtatatgaagaaatcacactaaccaaattttatgatccacatgcgaagaaaattggaatattaggcaaacattttaggtcagagcacacaaactgttttgcgtattatttttgttgctattaatgtgaaaaatacatagtttccaagatgcaaacctttgcagccatatgaatcattcctctgatgtcaactcagcccagagtccatgttagagtcccatcatacatctaattacccaaccagtcagggattttggtttttttttgtttttttgaaacagggtcttgctctgtcgtccagaccgagtgcagtggcacaataatggctcactgcagtctcgaccttcgggctcaagcggtccatcctcccacctcacttcctgagtcgctacgattaaaagtgcatgccaccacacccagctaagttttgtattttttcgtagtgatgggggtctcactaagttgcccagactgatctcaaatgcctgggctcaagcagtcctctctcagtgcagcctctgaaagtgcggggattacagatgtgagccaacacgatcccccaggatttttttttaacaatttttttcaaattagcctagaaatattggaaactaatataatgaatccacaagatacatttatttatttatttaatttatttcgtggttcagccatcctatcaattaagggaaatattgatagggtggctaaaccatgaaataaataaatgtattgtgtggattcattatatacttgccaaaatttttcggtgtaattaattatgcaaatattttgtctagtcttaacaaacattaaaacttgctcaccatacgtgaaacagtttgccagatttggacagcagcaagtcctatgagggcaaagtggccagggcaaaactcgggggatcatctggaagcactgccttcaggacagagcctcatcaagctaagctcataactatgacgtgcagaagacattgccctagtcatggtttgtgcttgggcatcgcatgagacctggcttgccccagggctgttgggttccatcagggaatatttggcctgtgcaaacaggattttgaaggagatttgaatggaaagcgtatttacagaggtatgggcagagctgtgggaacccagggggatactgaagcctcctggtagcagcagaaagccatcaccactcctagactcaaaggatcacagctgtgggagacggatgctgaagagaatctgtggcttttggcagagccccactactggtccattattcagtaggaaaggagtctgggaataaatagtccaatctcattattcttgtgtcctctgacaatctgcctaaatttcccattggttacgcctaatagagaagtctgagaaagggagaccattaatgcaagtcattaaaggtcagcctcccagggcacaaaacaagttggaaaagggtgaagacagaatttggttgaacaaacagatctcaaccagcacaccaggcctgctggaggatggtcaccagggctgtgctaagccatgctggacccaagactaaaggaaatatctgtaatgatgatgctgtcttgcttaaaattttgatattgttgtttatcatagttttttgccattgatcttatttttaagatgtggcattacaatattatttatcctgattactcagtttttttggtaaccccttaaattttgcgctcaagatgaatatctcactccccaaactcgaatctcagcccaggtaattggagtcaatatactgcattttgctttctgatgattacccataattttactgtgtgtttcattatgtgtgtttctttcattaatacattgtgaataactcttttaaaacccaagttctgaaaaactgtgtgcacacctgatgtattttataatatgaagtctggagagcatccctgttttctgaaacaagcaaggttatgtatcctgataaactttctttcccggaaactgctgtgtttggatcctttgtttgtgacctgacccctagagatcagctcatccttgaatgacagctggtaaataaatgaccagcaacattttattctgtggcttctctgccccttgaccctgctagagtcgaagatttatgagggcaaggatagcggtttttgttgttgatgttgttgacctcaccactctagcaatacatactgattaatacaacaaatgaattaatcaacaaccatatcatatgggaaccatggatatcagataacacatctccggctaaaggaaaacaggataaccacctcattaggtgctcctgctaaccttttgtcttcttgtttgtgatgacttagaatcagaacattcaactatggaaaaactgggggatttattacaagtggctggagagccttatgaagctacatacaaatgctagagcattcaatttcttttgcttgggacatatctcctcccagctaatctccattcatccatgggtactatgtactacagaatcaaaaggagagcgtggaggaaatgatgtcatgagcgtctgtgaagctccttacataagtcactacagtaaagttggaattcttgacgctgtcactagaatacaacaatttaacacttgactacataaaattcttaaatatctaaagcactgggattttgaattaaaatacatttattatttagaatgtcacatgctttttattagctgttggtaggtatgttcacagtgaatgagacatgaatcgacgtgagctcaaatgtgaaaactagacatttcaattttggactttgttatttgaaggtatactaaggaaagatctctgacacagcagctgtggacaacagtttacaatgatctaactagctcacattagaatttcccaaatgtgtttctgtgggatgttaataggtgatgtatgagggggtgtgtgtgtgtgtgtgtgtgtgtgtgtgtgtgtgtgcatgcgttgatggtagtgaaggtgattacgtggttgaatacttttgctaagtgctgggctaaacagattctttcaacctactgggagcctaatatgattatttgaatctttaatctttaagaaggatgtgcgacatttgccacaaagtatgtgactacagtacccattttcccatagcatttcacaggattttgaattcccagaaaacattttggaaagtgctggtgtcttcaatagtaatacttttagttctgtattagtttccaattgctgctgcaaaaaaattaccacaacttagatacttgcaaccacacaaattaatttcgctgtagctctggaggtcccaattctgaggtgagttttacacaactaagattgcagtgtccgcaaggccgcgttccttctcgaggctctgcggagcagagacgccctggtcttgccgtttccagctcctcagggctgcccgtgcactctttggccctggcgctccaacttgcaattctgtcataagatctcctttttcctgtaaaatcgtcaaagatgctccaagaatcacgtttgaacaggtctcattcattttaaagtaatctcatgtaatttcaaaagcatgttgagtatccactccggggatgactttcactcatgcgatgtgaggtgttcatcccaatgaaatgcaatctagcccttaaataatgaattatttaattgtagatgtaaaattagttcccaggtatttaaacttcaaagaagaatataaatggcctaaaaacaactcacaaaagtgcttcaggggctgggcgcggcggctcacgcctgtaatcccagcactttgggaggctgaggcgggcggatcacgaggtcaggagttcgagaccaggcgggctaacatggtgaaaccccgtctctactaaaaatacaaaaattagctgggtgtggtggcggctacacaggaggctgaagcaggagaatggcgtgaactcaggaggcagaggttgcagtgagctgagatcatgccattgcactccagcctgggcgacagggtgagacttcgtctcaaaaaaaaaaaaaaaaaaaagtgcttgagggtgcacgccaggggtcaaacaatgggtagtgttctgacctgttaaaatttggagaagcagccagggctgagacaacagtgcaaaatgaatgcccgaaaatatctcagttaaacgcaggaaattggtgtttcacacgtgttcctaggagccaaatgtgagagtaaggtataatacatgtgacagaatgggaatgaagaagtctggaaaagcagactgaggccagatggtattttctcttatgctttgaatgaggtaatttgtcttaacatggttggtagttaatttggttgtttataattttttcaacaaataattatgagcacctaccagtgtctaacctcaccctgggtgtagaggtgatggagagccatcaaaggcttttcaccggggcagtggtaaaatcatgcagagctttagaaagtcaattctggcagcaaattcgaataaatggggggctctgtattagtttgctaggactgctgtagcaaagtgctaccaacgaaggggcttaaacacaggagtttattgtcatagtcctggaggccagaagtccaacgtcaaggtgcgagcagagtcatgctccccctgaaggtgccagggaatgatctgtgctgggcctctctcctggctgcctgcagttccagtggcagcgtaactgcagtcctcacatgctgttctctgtgtgtgtgtgtctctgtggctgtgtccaaattttccctttttagaaggtcatgttttattaagtcatattggatgactgtgcccaccctaacgatttcctcttaactgaccatctgcaaagaccctgctgtggtctgaatgtttatgttccccccaatacctatgtgaaacctaacccccaaggtgatggtattaagaggtgggacctttgggaggtgatgggtcaggaggacttcccccctcatgaattgaatcagtggcccataaaagaggcctgacagcactttttcactccttgtgccatgtgggcacacatagaaggcaccatctatgaggaatgggtccctaccagaaagggaatcttgattttggacttcccagtctccagaactgtgagcaatcaatttctgttcataaaattacccagttttgtttattttgctattttgcatgaatggactaagacagaccctatttgcagataaggtcaaattcataggttctagcagttagtgcttcaacatctctttggggagatataattcaacccgtaacccactggaagtggaggatggaggaagtgggaaatctagttaattttcagtggttttggaagacgtgcctgggcagaagtgaggaacttgcagtgtccttaggaaataacgggagcccaaatgagggcaatggcagcaggatgggaggaggtcctgcgtgccatatcgagcatccacaccacagcactatttatcatgaatctgcttctgaaaacttcagcataagcagtacaacttctcgtttattgctttttgctaagatgaaacagaactaaaaatgtgctgaaaactgtaaactctcccatacatttctcatcatgattctctttctactactgaccagataatgaaaataatcagcactatctacacagcacaaatattttcatttatattaaattggatatgctttttcttttttaaaaatgaccagcattgcattttaaagtgactttttttttcttttttctactgactgtacatttctgactttatgtattggcaactggaagatttcaacattattctatatttgaatcaaatgcatatacttttctttccaaatgtaagcaaattgcgatcatctgggagtgaatgtttttaagaatcatgcaatacttagtcttcaagaaacttgtcacgcagaaaatccttggtgtatgaatttttgcagcccatcttatttaatgaatgttctaagaagacttcaaaaagacaaattaaaatcagttgtccctgacaactgaggaatatcaagagctttttaataaatttatttaagactgaatatgggtcaaaatatttttatacccattcttagaactgacagattgtcacatttgttagtgtgggtgaaaataatattatatttcaaaaatcaatgaaaaataaaagttaaattgaaatgtcacatatggtattataagcaattgtgccactcctgcatattaaaattaaacataagcataggcaaccagcccttggtttctgaaagtcttcacaacttagcctgagaaatacaaaaccattttccctcttgttcccttcaccaacttttgactcagatccctttttctttgcttctgaaactgccccaggtcaccccctaggcagccagccagtctaaaagaatcaaagtagctattttacagggctttgctcattatgatttcagcaaaccctttccatgctcctgtttccctctgacacacttctcagaagagagatattggcttacacttgtgcatttgtgtcctcagaaattactgttcatacataattgccttgtatttagagtgccctgacaagattcttcttgctcttacaattagaagtagtagaatgtattttgccattccaatgccaagaacaaaactcaagtctctcaagattcaagattcatggagagctggcaagccaggaactcttactgcaaaggaaagagatttaaggaggcttagaagagaagttgtaaggaattggaatgctaatatttcttgccaaatcaaactttctggaggtataattactgtaattagaaataggtgacattttccttgagatatttatatacagagctcaaatccaaaggaaaagcactcgttttgtaccatctctcttctcaatatctctctctgtctttctgtcttgtccaattaggaaattcagtggtagctaaaacacaactttgcctactttagaattctgtctgtgtctaagccccagaatacaacttttaataactccaagcctccttgaaaaggtgacaacaagacagctttgacattttgtgcacattcatccttactgctgggaaaaccacaaaacctggagtctgccaatggagcatcaataatctttgtgtcataggtgaagaccagtaaaattagcacttaagacaattcttcctggctttcctaaacaaattcgtgaaaagaagtggattcgtctttctctactcttagctcgtctatttgagtatatactttcttctttgaagacatcgttcgttttcatggatttcttatcaacctctttgtggctgacttccagccctttcattagcatggtctgcacgtgtaaatcatctgactcgtttagctttccagctttgtctctcgcctcccttccttccctcccgcttcacccctgcccctctttgtctaggcacagtggagttcctctgatccccaaaccgatgttccttcacattgctgtgcttactattctaatgtccttttatttctctattttcaaaaaatgcattctacttggtagttttctctctatggaagcttcatctgaagacttctatcttaaaacaaatttttctcttttttttaactccagaaaactttgttctagtatttaccatatttcattgaaatgatacaataattcacacagagtagataataaatatctctttaattaattaatcatgtatattttattctcagcactctctttaccaaattgccagggcattagaaactccctcctctgtaacccatagaagctctacatattgcctttatcacattacctggcagctaatcattggcgttgtttctcctcagataccccagacatcacaaactccttgaggttacagcttgtgttgcactcatctttatattctgaatctaacattgtgactggcacagagcagacacctggtgagtattgaatgagtgactaaactcaaagggcagcacatacagtctccaaggtatgtgttatgactgcattaggctgtttttgtattgctataaagaaatacctgtcactaggtaatgtataaagaaaagagggttaattggttcatggttctgcagacagtacaaggagtgtgatgctaccatctgcttctgtggaggcctcaggaggcttacagtcatggtggaaggtgaaggaggagcagtcatttcacatggcaacagcagaagcaagaggaagatatggacggagccacttttaaacaaccggatctctcgagaacccgttcatgatctggaggacagcaccaagccatgagggatccacccctctggcccacacacctcccccaggccacaccccagcattgaggatgacatttccacatgagatttggaggggtcaggcatccaaaccccatgtcaatgacctttctctcccagtgatgtcagaggacacttatcatttgtgccacgctaacctgtgggtacagcctgattcttattttccctttgtttatttactcattttttttgtttgtgaattttgtctctccactgggccattaattaattcattatattagttagaattctccagagaaacagaaccaacaagagatagatagatgatagatagatatatagatagatagatagatagatagatagatagatagacagatagattgattgatagatagataggaggggttcaatattatgagaaatggtttgcctgattctagaggctgagatattgtgctgcctgaaaaccggagaaccagggaaggtgtggtacaaatcagtccagggctgacagcccaagaagctcagtctgtgacagtgggtgtcccagctccagagaaagagtgtgttcgcccttgctctgccgttttgttctcttagagccctccgtgtactggggggtgcttgcccacattggtgagggtgatctcctttactgagtccactgattcacatgctaccccttctggaaacagcctcacacacacacccagaaagaatgttttaccagctatatgggcatctcttaacccagtcaaggtgatgcataaaattaatgctcacactcacctagatcttacagctcacattttcctagcagagaagaatggattgctatagcaatgagggttcttagagactcaggatgttcgccctgcagaaattacctctaaattaatcccagctggaagtcagagagcctctataaaacatagcctgtgttcagccacattgatttttattatgggaaatatatgaaaattcagcaaaggtgacggagtgccttctgaagagaacccagtggagattcttaccaccattaaaaacaagctcatcatcagttcatcttattggtgtgagatttgcttcacaatcttcaaataatgttacagaagatttcatctgaaactacacattttggggatttttatttaggctttcatttaaaacaccgaacactgaataaaagaatctaagcctattatctatatatctatggcaaagtttcttcactttattgtcaaaagtttacataaagttgaaaccagaaaaaaacatttttttcttaactatctaatattggtgagaaattgagagatacttttttttttttttttggatggagtttttgctgttgttgcccaggctggagtgcaatggcacaatctcggctcactgcaacctccacctcctgggttcaagccattctcctgcctcagcctcctgagtagctgggattacaggcatgcaccaccatgcccggctaattttgtatttttagtagagatggggtttccccatgttggtcaggctggtctcgaactcctgacctcaggtgattcgctcgcctcggcgtcccaaagtgctgagattacaggcatgagccaccgcgcctggccgagagatatctttttaccttgaggtatatttagagttgacctcaacataccactgtactcagttgaacagatataattagatttataattatcttttaaaaagttgttctaatactaacagtttaaataatgtgagtatccaattacttggttttattatcctacatatttaacacttacatccaggaacatgcaggttttcttttatgcttagctttgttttctggggtaacaatgaagaaaataatctctagagaataaaagataagaaaccatgaattatctgaaagacttaaggtttatatcatttggagcctgaacttaaatgatgtgtttgcaggagaaaaacaattctagaagaccattctacttaaatggagcttgtactaaagtgttgaaaagctgcaaaatgttgcttatttttaagtttaaggcagctatacctggaataattaccatgacaacttaaggccaagttcaagagcccgagtgaaaaatagaatcagttctataattgattctctttgaaactactaaattcacagttgcagaattgtaccactttaactatattctttgtctgaattatatgcagattgtacaggttatgtgtttttactgtagctttggtatttcatttctggagaagaaacaaggttgtcagtcaaatatcttaaactatgaaatagtgcatggactcacagagctccgcttcacatgcatagtgtgagatgaacagaaagtggccactggcatgacaagaacatctgctacttaaaactatgtggccataagcaagataattaacctctttaaattttcttttttatctttataaataagaatgtcaatgaattccttatacagatataatgataaaatgagataatatatttaaagggtatagaaaggtgcctagcatatttaaaccatctaaaaatagttttgcttttatgtattgaaaagttcggttgcaccaaagtcactgcaaaagtgactagtcaaaggcaagtaacacaaaacttaagaacaattggattacatgagtaagagatttgtagttctccccctacaaatatggagttggctcaggacagagctcttcaagaatgttttcaaggacctaggctcctcatctctccagtcctaacccttggtcgtgactttcatcctcatgattccaagacagctgctgcacatccaatgccatgtctgcattccaaccacaaagaaggaaaaaggataaaaagccaaatatcttcttcacataggaggttttttctttttaatttggaaaaataaccactttctagctaacttttaattatattctattagtgagaagaaatataccaaattgccatttaacacaaagaggggtaggaggttttaggtcttaactggaaacatagctattcctttctctgtatctgttatctgtctctgtctctacctctctctttctgtgtgtgtgcatgtgtgtgtgttgtgtaaagagagacacacacagagagagagagagaaagaaagagagagagaacaaaagaagaaaggagaaggtatattggatagctaaccagcaatgttagccacggttatatttagacaattcgttttgcagcttataagagggcatgcttgaatataaactcatatgacaagcatagttaaaatactttcattcaattttgcattccatgaagcttcactatatactctagtccagtttagcaaggagtgttagactggggctagaatctggacagcctgtgtctgtctctagtttactgcttagctttgtgcaaattacctaattattctgcatataattttcctctcccattaaatgtggaggtcagatgagaggctaccaatttcagatcttaaatttggtggtttcatgattgttatatttctccctattcttttaaaaaacagtttcatattttcaaaaacttaataattttctggaactattgaactttggttaagacagtcttgcagaggttatgtattgttctcagcactgtgccaggctgcatgtgagacacaaaaccagttaaagacatgcccgccgctctccgtgtatgacactaagcaccttcagtgtggccatgactcactgttggtgccaaggttccaagaagagataagtcagaatgacatgaggaatttaaagatggcttcacagatgaatggaactggaactcaatgccatctcactaacatttgaaaattaaatacaaggtagaatgaaaagatatggttaggtggataaaatatgaaggaacatctcaaacaaagggagatgcaccaacagaaacacagatgagaacgcaggtgctatgatgtggatgtttgtctctccaacccctgcattgaaatctcaccccagtgttggaggtggggcctgatgagaggagtccgggtcatgagggcagatcccgcatgaatagattaatggcccccattgggggtgagttctcacctcagagttcccacaagaactggttgttcaaaagaggctggcacctgtgtccacccacctgccatgtcctctcgccatgtgatctctacgtaccagctccccctcaccttctcctggcaccatggtggacgttccctgaggcctcaccagaagccaggcattgtcagcactgtgcttcttgtccagcctgcagaaccataggccaaataaacccttctttataaattacccacctcagggattcccttagaataccaaattagactcagacagtaagcttgacaagttggggccgaggaaggagcctctcccagttaggtgagaaagcatatgctagtgactgataaaaataaggttgcccgaagacttcgtaaacctgtttcctgcaattcttactctaacacaaatacacagctaggaccaggaggctgcttcaccataagtgtctctaccacttgcacacacagtgcacacaagttgaatcagagcaacttgctgtactggacccaggttcctgtgagcagaaagtacaatacactcctcagtatccatgccatgtatccgactcagtgtcactcagtgttgctaatactgtatccggacttagccaactcctggatccagagctggccaaaataagcaaaacaaacaaacaaaaacctacctgaatgcctttgttgcaccttcagttgtgaactaatcagtcataaatcccaacccaactctttctatctcttgcctataactgttcctgtcacttatgcattggtatcacaaatgggagagacctggtgttaattcattgagtaatgagaagccactatggatacttgaagcagaaaggaactgttttacgaagttctgttcctcggcagcatttgaaataaaaaataatgtagtcatctcactaggcagatgagataaaggattgctgtgtctattatcttggagaaagaccataaagacctagattgaggtggtagactttcaagtgagggtgaaaataaatgggatttgagctacagattggaaacacagaatggattggaacagagagtgtgcaactgtctttatttcagatttctatttgcccagtgtttgtccatttttcacctggggaacaggacccagaggtgccagaagtgacattcaagctgagggagggcaccaagtctatatgactgggaggaagtcaaaggtaactctttgtcgtggcagctcatctgacataaatgcaagtatcaagtggggcttttggctagtgctgagatttagctttttcaactgcctaaaatttagatcatggcaaaaacattttagtagggatatattttaggtagttatgcttaaaaataagaaaatggggacatgggagaggttggtcaaaggatacatcattacggttaggaagaatgaactcaaaagacctagtgtatagcaaggttatgataattaatgacaatttattgtattcttgaaaaatgcaaagagagtagggttaaatgctctcgccacaaaataactatgtgagataacgcagttgttaattagctagatttaaccgttcaaaatatatggtaaacaataaatagctacaatgttatctgtcaaattaaaaaaatttaaaagtaaaataaataaggaaacaggcaaacaaaacttttaaaagtctgcattttaatattctagcagtgttttaatctattttatcttatctatagattttgtttctctctatataaagactataaagatatccgaaaaataatctctctgatatctttatagtctcctcaatttacaaactattcgattttaaaaataattgaccatatatatccatattatgttggtatgtgtgtcaaccataatcgtacttttttttttttttttttttttttttttttttttttttcagacggagtctcgctctgtcacccaggctggagtgcagtggcacgatctcggctcactgcaagctctgcctcccaagttcactccattctcctgcctcagcctcccgagtagctgggactacaggcgcccgccaccaggcccggctaattttatgtatttttaggagagacggggtttcaacgtgttagccaggatggtctcaatcccctgacttcatgatccacctgcctcagcctcccaaagtgctgggattacaggcgtgagccaccacgcccggccaaatcttactttttgtaactaatttaatagaggaggaggaaagaaaagtatatgaaagtaccttcaaataatggagtgataattttagttcaagttcaatagttaacatacacttaagatatttttaaagaaacatcacattgtaatcaccagagccttttaagcactggctaattgagaaatatactaagtctccaaaaatacattttttgtgtgactttgacatgatgctgtggtttctctttgtctagaatcactttacctgtgaatcctgtaggctcacatgccactagccaaatcaaacttaacagctcctgggaaatctttaaagattatttcatcaatttgcttgctacatatgtggccttagttaatgttgtaagtgctttttttcccatttcagatgatttttttccttcattgtatttgaaaaaattaactttcctatttaaaaggcaaagtcaacatacagttcattctgagagtatttcttaacatgtttgggtcaaatcttctttgtagatactggtagaactcacagagactccggtaagatgacacatttcccagtacaatttcaggggggttcataaccccaaagccactctatgaaatggaacaggagacacttccagactgtatgattaattagtaatttgtcagatgtaaagatttttattgaaggagggcttgcaattggaataaacataaattatttcccagaactgggagcacgtgtcctgaggaggatgacttgtttgctctgtggaggtgaaagcgatagcctgagccacagcctcgctgagccattgttgctgacgggtaaatgctggaacccttatataccagagggaaccactaccctgcagtctcagttgtgcttctctgtcttcctggatgaccacaaccccaggcaatttaggcccacattatccattcctctttctaccttctcccatccttcatgtaacaaatatttattgtgtctaccacagatcaaacatttgagaaaaatcaaaacagaaaactcctcgatctacagaacttacattccagtgggggatgatagaaaacagaaaataatcatattagaaagtgattaacactgtgaaaaaaagtgagagttagcaaaaacactccctccatccacagtgtggtgggctctctatccactttgacccacatttggtggtggaagtggctctgtgctggtttttggtcccaggactgcaggcctggctgttccctgtccctgagccatgctgttggaagtctgggtgtttgaatggagagtccatgggaaggtcctgagacagaagcaggggaagagggacccaggcctgcaaggccccagccatccctgccaaggtgctgggccctccagataccccagccacgagctggagacccctacagtcattacatggagcagaagatcacccaggcatgccctgccctagagtctgaccgacagatcacaaacaaaataaagtggttattggttgaagccattaaatgtggtgtggtttgctagtcagcagcagataactggaagcttggtggttgtctccacaaaaacaaaacaaaaacccaaactacattatttcaggcacgaccgcagtggccctgtcagttcttcactgcaccctggctgtcggctgtctccgtctctcatttcctacggccctgttcttccggacctttcccactcaattcaaacccaaaccacatccttcgcttttcttacaatcatcacaagacctcgtcttgcattaaaaacaagtatcaaaaatatcctaaatgaatggtgaatacaagtttgagagcctcaaatctttcactataatctcctcctcttttttctctttcttctcttagaagaaaagctgacactaattttcaaggctaatcctcccacttcacttgtaatatcaatccctttgttctcttctacttacccctggtaattattttcaacccgttcctccatcctcctaccttacctatgccaacaagagacctgttctcagttctcatccaacttcacagtggcaacattctttttgaaatactttcttccctggctttctaaaacactgacttttaaaccatccttcacaatgctgcaataatggtcttcctaaaacaagcattatactatgaagttttctccctcagaaactgtcaatggctccctgtagctttctaagtaaagaccacggtcctttcaccgtagtcttagctctccataaataatctcacacagctctttctattttgcaggcctttattcagttgcatgtttcagacaactctgctttccttcaagttacatcttcattctgaaaaccttttcctctcctcctgaatccaacccattcttcaaggctctgctgaggtccacttctccaactcaggcttcaaccaacacattatacactcacccttcttccaatggcattgaacacctgcccctgcattcctgtttagcattccttttctgtgctttgttaaatattctctatcatcttctctttttttttttttcatttagtaatctgcttaacatttttaaggcatatgggataagagacactgggacccatgctaagaaaacagaggcaatagactctgtccatcctcaagaggcacacactctaacataaagacagtcacttgcaataggtttcttttaaaccctcatagaagtaacagttcagtgggagttttgaagaataagtgctcaagactatgtaggaaactcagagacggcttctagaaggaggctatagttgagtctttaaaaaacacatagaaggccgggcccggtggctcatgcctgtaatcccagcactttgggaggccgaggtgggcggatcacgaggtcaggagatcaagaccatcccggccaacataatgaaaccccgtctctactaaatatacaaaaattagccaggcgtggtggcaggcgcctgtaatcccagctactcagtaggctgaggcaggagaattgcttgaacccaggaggtggaagttgcagtgagccaagatcgcaccattgcactacagcctgggtgacagagcgagactccatcaaaaaaaaaacaaaaaaaaaccacataggtagtcaagataaatgaggagggcattctagatgaaaggggtaacagagatgaaaaacactgtgaaatgctgcagaaagtttgggcagcctgctggtgtgggagtgctggatgccaggcaggagaaaggggaggtgaagtggggaggcagcaggaccagatggactatagatgatctcacttgccaggacaaagagcttgacttgtcacaggggaaattgagggtgcagggaggactttcagaggtatagatgggctatgacatgattggataagagatcattctggcaactctggtttctacgtctgccttccccccatctccctgccaccaccacacacacaaattagggcttttaagtgagaaggaactgttaattttacatttgttcctctcctagaagttcatgcaacctcccacatacaataggtacttaataatgtttttattttatgaataaagaggttgaaagttactatgtttaagtggtctcttcactaaatgtgttattatcattattaatcttgcagcaaagggaggagaatagtatttggagaaaggtgcctatgactacatgttctcccactgaccttgcatgggagaaactgggtgctctggcacaattctgctcattgatccaggctgtggggtcctgaggcaagactgtggcccattacacagcctttgagatggcaatgccctttaggaggcaggatttctgcacaccttttcctatgccttctgcttttacacaaggagaaactgatgagtttgcagtggtaaccaccctgttcctaagtgtgatgcctccaaactggtctgagacgtgagggtgaagtcctgtaaagtcctttgttgctgttttttattctcttatctatatgtaagttcaacatctcttgttataaacgcttcaagtgcattaaccctgactaggactcttgttggagagtaacctatatctcttctttgtcataactaagatcagaacctgagatgccttttgggaggaatcctaagacttcctaaatcagatacttttaagtctgctgaaagagatgaaagaggcacaggaactgccctgagagccgactcatccttcacagaaccgttgataggaaagagacctccaaggtcaaagctgcagaaagtgtgttaggaattgcaccttcgagtggtctttgctgagtgttgaatttttcctactttcttctcacccattttatctctgtgtgtaagtgctgctgaaaggcaaaacatgatgcttgaacagggaaggggagtttcccaaataggaggcatatggcctaaattcaggtgcagaccgtgtacatttcagccaagtgtatgacagtgggatcaataaccatggcatgcactagaggtgcaagacccagaggatctcaaattgttccccaaagctcagctctccaaagtcgtggcttacaataggcgactttgtgtgggtgaaactgtaagagcatctctgcacaaggcctttgtggctgcacttttctgcttgctgttccttcccagtatgtatctgctttacgggcaatccccttacttcctcctgttaactcctgggcaaaaattacttctgcgagagttttagaattcagatagggtctgaagagcaagctctgtcgtttatcttacctaacaaaattgtcagcaagagagaagtgcaaccttttcttgatacagctctctcatttggattgtaaaatcttatgttgagggagtgatgaatgggggagaaagaaacataacttctttcagatgtaaagaatgctgactgcttcaaaaacattgctttacctgattttcttggcaaatgcgatttgaaagcaaagcaaggagtagaaaatatgcaggtgtcactttggtagtcacttttgtaggcagagccatcgtgattatgtggtgataccaagtacaggactctgatcagctgcaggtagcacgaaagcctcacctggatataaaattccccagcaagggtggtgagtgtcccggggacatttcataaaaggaagatacatgtgtttctttgcttattgcttgttagtaagtgttgcaaggtgagaggagttagactctggcccttttgagctgtgggccactggtaaatggctgatgccctctgagctcccttttgtctaaataagatatacaataaaatctatgctcaatgggaaaaggtatgctaagccaccactccattactcggtatctggtaatgggaagctatgattactatttcataagctcttttcttcacatgctaaataacaccagcacacactgaaagtacacagaccgctcttttatttagagaagctcaaaattctttgtataattaatcgtatctttctaggaacgatcaaataaacatgacattctcggttgtttccatagtcatttttttaaatcttctaccagctaagtacgtcaataatttaccgtcattttacttcagattcattcatttattcaacaaatatttattgagcacgtgccaatggagcacgtgctagtgccaggccctgttcacagtcaggaaacccaagcccatgcttttgcggagcttatgttctgctgcatgtggacatggggatggagggagtctaacagtctacgagtaggaaatacgtagtaagtctcacagcggtaagagccatgggaaacagggcagggcaaggatagagcaagcacagaggcagggctgggactgtttatacagggtggtcaggaaaggcctctccagcaaggtgctaaatgcaattcaagcagagacgacgtaaaggaagcttaattattttaagaacattataagctaccttgcagggctggagataagggaacgtttcaacttgcaatctggcgtctggtgtcaaaagctggcctgaaaacatcagccatttctgtgcttttctctgtttctcaggccccggcttcactgtgtgccaacagccaacagcacacagcccttcggggctgaaactctgcactgtctgtgagtcatggtggatagaattccaagggtctatatttgtcttgggtaaaataaactgtcttttctaaatatatgccttaccacttcccattagccaaattccccaacacatatttctgctgggaaagctgaacgcaaactattttgctcatgtacagtgcagccagcttccctgtggctctcagaggagacacaaagctaagaatcgaaaacgaacatatctgatgacagaacaaaggtttaaaagaccttgctatgctggaattataacaaaatcaacatcatgaaattaggaaagatatggagagggtgcagcatttagattttcgaatggcacaggtctggaatgaatccttaatgaatatcaagttgtctgaaataagcagagatcttccattgtgtaaaaacctaatatgtcagttacttggtgatcatatcttgctctacctcaattacagtgctgagacaatatcacaatttattgagagagtatttttattttgttaggttgtaggcttcttgaagtaaagactgtcttacctttgtatccaagaacaattcctagctaagaatatttcgatccatttattcattgaatatagtaaaaacatcttattttgataaagaagtatattatacacataagatgagacatgtctgcaatgcttaggtacacttgcagtattgtgtccacatttggttacatattgaagtgtgtgctttggaatatggccagagagagctgaaggctttaaacgaatatcacataagaaattattgcatgaaatgaagtgtttctaatctaatggaaaagaagcttttggcagaaatgatagctgtcttcaaatacatgaaaagttttcacacggaaaaacaagttgatgtgttctgcgtagctctggaaaaacgaccagggccaacggattgaaggcagatttcatctcagcctgaataatccaaaattaaatgagctgcctccagaataaggagatgcttccctctccagtgatgagactcccatttctggaagtgttcaggtagaatctggactggcatctctccggaagtcctgccttaggtgggatgctagaattaaggggccctaatgctctccctaactgtgatgagctaattataacattactcaggtaagcaattccttcagaaacaattacatcttacagagaagagttatcacttttcaggccattatttttagatttttttccttgcaaacttcgtttatttttgacctaaccataccattccactgagcaatattcatgcttggggttttgatgctgattttagacaatgtggttgtaaactgcatgcatttctaggtggtactagaggctagtatgtcaccctgctcaaaatttcccaagacacttggtgtcacattgctatcctcagcatgccaagagacgggttctgtgaattcatgcactgtctaaagcttctttgtcacagattataacctctaataagagaatagtgtctttttggcacttgtgagtaccttgttgctcaagagtagattacccattcatttgttcaacaaatgattcacttaataacatttattgagctcaagtgcatgtgttctaaggatacaatgccaagatgtccctgcctccagcaatttccagcttagtagggaaaacagacctaagtccagacctttaggacacactgtaacatccgctgtaacagtgtttacacaagaccgaacactagcaaaaagaacagagctgcagattctgggtagattcaaaacaatgccatggaggaaaccttgaaatgagtctcaaaagataagtcaggtattttttcgtgtacacaaggtcatttcagcaaagagagaaagtgatattgtcatggagaagtattagcatagaatttgcattggctgttcaggcaacactaagtagcctcatgggtcagttgtgaagcttgggtggtaatctgcggaaatattgtcgagaaggaagcagggaatgaatcatacagtggatagactgaaagtaacaatacgaggcaggaaaactactctgcagattatttcaactgtccacatgaggtaatgacctaatgcatcggaagtgggttttaaaaggagcagagagagtaaaggatatatgtttaaaaggtaaaattgggaggccaaggtgggtggatcacgaggtcaggaaatcgagaccatcctggctaagaccatcctggctaacacggtgaaacctcgtctctactaaaaatacaaaaaattagccgggcgtcgtggtcggcgcctgtagtctcagctactcgggaggctgaggcaggagaatggcgtgaacccgggaggcagagcttgcagagagccgagatcgcgccaccgcactccagcctgggcgacagagcgagactccgtctcaaaaaatacataaaaaaaaatttttttaattaaaaaattgaaaggtaaaattcacaggacgcattgagaaactaccaggtgctatactagcattgaacaagtaaaggtgaatatgcacaacacttcctcaagcaatgaagatgttcttggtggagacaacaaggcttcggcaccagagagtgctccgttcaaatctctgcttttccatttggaaaatctttgtttcagtttccttaatctgctgcattgagactctttcctcactttctctgtctggaaaatcacatgcccctgtcatggttacgtcttcagtggaccctttcctccaaaagcctcttccctcaaaagaaaagtcctgcctattaaggcaaattaatatggaggctaggcctgaacaacccttgagcagacatagccagtgaggcctcatcagtgaccctaaccctgcttgatcggcaaacagaagtgaaagttaacttgagctatttcttgtaaacgcctatattaaataaaaacggaattcaagcccaatcaatatgaagcagccaactaacttataattatagaagcagggactttccaataaaatagaccacataaggaaaactgtataactgcaaacaatcaattttttttcctttattctgtgctcatcctaacccagttgtggtttggagcttcctgattcattaattgctgtttgctcaaataaattctccaaaatgttcttgtgtgctgtttacttttttttttttcttttctttttttttttttttttttttttttttgagacggagtttcactcttgttgcccaggctggagtgcagtggtgaagtcacggctcattgcaacctccacttcctgagttcaagcgattctcctgcctcggcctcccaagtagctgggattacaggcacccgccaccatgctcagctaatttttttgtatttttagtagagacaggatttcaccatgtcagccaaactggtcttgaactcctgatctcagttgttccaccctcctcggcctccaaaagtgccgagattacaggcgtggcgtgagccaccatgccgggcctccgttttacttttaatatgcctaaaggatggcataaaacttaactgaggcaatgaaaaacatgcaaataatagagatgtgggccagagtaagtactcaaaaaaataaagactaatgaggcatcttttattttcttttttaaagatagcatttttaatagaagatgaacatgggcatttttctgaatacataacaatgtatgtttatttcttttcacatgttagtcccatcaaaataattattactttatatgctaggatatgtaccagaacattaatttttgtaggtttcaagttattttttggactactttatcagtattctctagaagaagaaaaaaggaagaacaaaactcaaagagaattaaaaaaagaaaggataaataataccaaagtcagtgtatatttgatttctaaccttattgtatttatatttcaatgaattctaaaatgcttctcacatatttctctttcaatgctgttttttcttcttttactgccatgagtaccttgattcttcaaatgactttataaaaatggctatattaattaagaatatgcataaagatgtcttagatatatccctccattctggaatttacagttgtttggaagaaatgttggctacaactaatcatacagaaaaattttacttcattatataagcaaagacaacgtggtttgttattagttttaaggatcttaaatcagtattactccaaatcttgtccatcttgagctaccttgctcatctgcatttgctttgggatgctttaaaaccagcatgtccaggtaacctgacttagcatccaggaatgcagaggcaataggaaagagaacacattggctaggcacactcttatctagctcctggcctttggtccttctgattgtgagttgtgttggtagaaaggtctaaacaaatgcccagaatacttattcatattaatagtaaagaaatgaatcagcacgatcaattttcattctgttatttcatctcagtaatatagagaaatacattctaatgcagaaaaataaggttttctagtgccatcttctcttccaatgacggagctattgaagttaattctctaacaaaagacagaagcagcagcagcagaaaaaatgaaatatcatttttttttttttgctcgtttcaaattaaagaactcagaatgtttacttatgctggataaaatatacccaaatgttaccttcactaatcaggagcttaattctgtgtttaaagatcaccccagctgcaaattcatctgaggagctgaagcagggagattttaaaaatctaattatttttataattattttcaccaaatgctttatacctctatttggtggctggttcctgagaactccatatgaagtcaggtcagctttgttcacatacacccttctccatggactagccacctaatccaccctctgattaacggagaggcagaatgttcgcaatgtgtaaccagatatgctggtacatcaatgactactgtacacccaagcattgggaactcagtcttaaaaaaatctactgcccccttattagttttctccttagtgaaatagtcttccctacattggaatatgagcagaatatatcccactgagaaatgagtttgaatataatgggagactggctctgtccaatgcccagaccctattcttcaacctgacaggtgaaaattcttatcttgggttgtggaggaaaaacgaagcagggggaagggcaaaaactgggtggcgaaatgggggcagccagggcagaggaagcatgaaggctgagtcagtccccacttcctagtcttctccagacccacgctctccaggttgggttgtcacgatgatggactgggactgacaaccagcatctccactgctgccgtgggagtcacagtgagcacaagacccagagtgtgcagaagtttttaaatgcaagtggacaaccataaccagggggagtcacctgttgcccaggttggacgggagagtggaccatgctatcaggtgactccatattttattcaaatgaagtttttggatctccttattgcataatgtataagggagagcaggggggctactagttgttttatattaacagttgctttagtctttgggaaaatagcaataatattctattgctggagcatataatcaactgcttccatagattcaccttaggaatttttcacccctgatagaattacttgacattatgccattaagtcataatgagcactgttatgcaatcctttaatcgttttaacacatttattacaggggtgttctggatgatatttaccatattacttagagtcttgtttgtgggtacctcttaaattttaatttgcaaaagaaaaaaaaatcacctaggaatccaattaaagtgtacattctgatttagttggtctggatggggcccaagattctgcattgatagcaaattctcagtgacgctgatattgctgtcctgtgctacactttgtacctggctttatagatatcccatcgtagaaacttactctcggaaaagctctgaatgttgaacaagtggtttgtttttattatgcagtactgtgaattgcattgagttgggccatatgaaatcaccaatttttgatcatatttgacatatattgggcaatttctcatgaattgcattgagttgggccatatgaaatcaccaatttttgatcatgtttgacatatattgggcaatttctcatactgtagatatagcatgacaatagcatagtatgctaattcaatgtttctctttgagttgatagctatggagcttgtaaccaaaggagtgacccacctaaagcgaagtgtacggaaccatttacctggggcatagtttaagttttaaaatttataaaacctttccctcttttataagtgagaaatctttagttgcaagtaatagaaatctatattcactagctgaagaaaaaaaaatgtagacttaagtatttaggaattgcaggtttagaccgtctcctgttggcacaggtggatatagggacctcaatggtgacatcaggcttcaggcttcagcttatctgcccaatctctagttttgtttgcttctatgatgaattcacttttagcagcttctttctccacctagattgttccttgtagctcctggattacaggccatcttcttagcaactccaacagataacaaatttccccttccaggaattggattttattagacttgctttggccagagaaatggaaagctcaggttagtaatcttggctcccatgccccctggacctgggtcaactctgtcagatgtatattggctcagagttggcaagggattattctcctagagaaaactgggtagctattcccagaaaaaggaagagtgttcagagttgttcccaggatgccttttcttgcaggaccgttatccatgcccagcccactgctgtcagcattgacctgtgagttgctctgacagatggtatgtgagcagaagatgtgtgtcacttctagaggaagtttaaaaacccgaatgtgcttctctgtgctcccctagcccattgcaatgtcccaggtaagggcagcttcttcagcctgggtccaacacatatggatacatcttgtgggtaagaaataagcctctgctgctgtaagccactgcttccaggacttgcttgttattaaagtaattcttagcctaacctgactgataaaataggcagaaacaacagttgttcatattattccactcatctcattccaacatgaaaaccaattcttctttgccaatataaggatttcaaaaacaccccaactgcatttaatttatacattaattacaatctaaaatccactcacttcctcctcaaataagaaaattataaaagtctgttcacttactgtccaattactgcctaagatctaagttcaggatcttttggtgatgggaatttatctaggtcaagtccagattagcttctactggtggagatacctatggttgaatggggtatttaaatatatttaagtaacatatttaatcacctcccaatacatataagattcagtagtggaaatcaaaaggactaattataaaactaaacaaggtaaaattcttttttgttgaaaaggaggcaaggaaaacagcagaattgtatggttaagtgttcatggcaagttagcactgcagccctctggcagagtgagctccttggttagccagcccatctttcctgactcctctctctgtgaggatcttctttatttattgacctcccatgtcacatctgagatgacattggagaggcctccctatctgggttgcccacattagctggtatcaggctctatccaggcccccactagaactagaattttcaattaaagcttcagatgaggagaccaaagttacccatcccttatttttagggtgcatcttagtcttggctttttacaataaagacctttcccaggaggtgttcatggtgagctgaagtatccgcccctcctgaggtctcctcttggcttcccccatattcccttccttactgctttgctgaactcagcccagtgactgagcccagcgcagagaacccagctttgcatcctccaatactccagtctctcagtgctcacaagtttcctgccccaggccagaaaaggaacccttaaagacaaaatgaaacgaggccgagtgcggtggctcatgtctgtaatcccagcactttgggaggctgaggcaggcagatcaccggaggtcaggagttcaagaccagcctggctaacatggcaaaaccccatctctactaaaaatacaaaaattagccaggcatggtggcacacacctgtagtcccagctactcaggaggctgaggcaggagaatctcttgaagctgggaggtggaggttgcagtgagccaagatcgcaccactgcattccagcctgggtgacagagtgagactccaactcaaataataatttttaaaaagacaaaatgaaacctatttttgcttttttttttttttttggctttatgttttaacatgatccagttttaactaaagtgaagcttgtctctttttatcaaacctttgagaattagtcaatatattccaaaatcctgtgaattttctaccatgttaccaatctctagcctaggaatgtgtatgatatggtttggctgtgtccccgaccaaatctcatcttgagttgtaactcccataattcccatgtatcatgggaggaacccggtgggaggtgattgaatcatgggggctggtctttcctgtgctgttctcatgatagtgaataagtctcacaagatctgatagctttaaaaacgggagttttccagcacaagctctctctttgcctgctgccttccatgtaagatgtgacttgctccttcttcccttccaccatgattgggaggcttccccagccgcatggaactgtaagtccaattaaacctctttcttttgtaaattgcccagtctcaagtatgccttaatcagcagggtgaaaacagactaatacagtaaactggtacctgaagagttgggtgctgctgaaaagatacctgaaaatgtggaagcaactttggaactgggtaacaggcacaggttggaacagtttggagggctcagaagaagacagaaaatgtgggaaactttggaacttcctggagacttgttgaatggctttgactaaaagcctgttagtgatatgaacaataaggtccaggctgagatggtctcagatggaaattaggaacttgttggaaactggagcaaaggtaactcttgttatgttttagcaaagagactggcagcattttgcccctgccctagagatgtgtggaactttgaacttgagagagataatttggggtatccggtggaagaaatttctaagcagcaaagcattcaagaggtgacttgggtgctgttaaaaaggcttttagttttataagggaagcacagcataaagtttagaaaatttgcagcctgacaatgtgatagaaaagaaaaacccattttctgaggagaaatttaagctggctgcagaaatttgcataagtaacaaggagccgaatgttaatccccaaaacaatggggaaaacgtttccagggcatgtaagaggtcttcacagcagcccctcccatcacaggcccgaggaccaaggagaaaatggttttgtggtccaggccctgggtccctgtgctgtgtgcagtctaggtacttggtgccctgtgtcccggctgctccagccatgactaaaaggggccaaggtacagctcaggctgttgcttcagagggtggaagctgcaagccttggcagcttccacatggtgttgagcctgcgggttcacagaagtcaggaattgaggtttgggaaccttcacctagattccagaagatgtacagaaatgcctggatgtccaggcagaagtttgcttcaggggtggggctctcatggaaaacctctgctagggcagtgcagaagggaaatgtggggccagagcccccacacagagtccctactggggcactgcctagtgaagctgtgagaagagggccagcatcctccagaccccagaatggtagatccactgacagtttgcaccatgcacctggaaaagtcacagacgctcaacaccagatggtgaaagcagccaggaggagggctgtacctgcagagccacaggggcggagctgcccaagatcatgggaacccacctcttatatcattgtgacctggatatgagacatggagtcaaaggagatcattacagagctttaagatttgactgccccactggatttctgacttgcagaggcctgaagctcctttgtttgggccaatttctcccctttggaatggctgtatttacccaataccagtacccccattgtatctaggaagtaactaacttgcttttgattttacaggctcataggtggaagggacttgccttgtctcagatgagactttggattgtggacttttgagttaatgctgaaatgagttaagactttgagggactattgggaaggcatgattggttttgaaatgtgaggacatgagatttgggaggggtaaggggtggaatactatggtttggctgcgtcccctcccaaatttcatcttgaattgtaacttccacaattcccatgtgtggtgggaggaacccagtgggaggtgattgaatcatgggggcgggtctttcccatgctgttctcctgatggtaagtctcatgaaatctgatagctttaaaaatgggagtcttccttcacaagctctttctttgcctgctgccatccatgtaagacaggacttgctcctccttgccttctgccatgattgtgaggcttctccagccatgtggaactgtaagtgcattaaacctctttcttttgtaaattacccagtctcgggaatgtctttattagcagcatgaaaacacactaaaggccgggcaaggtggctcacacctgtaatcccagcactttgggaagccgaggcaggaggatgacaaggtcaagagatcgagaccagcctggccaaaacaaaaattagctgggtgtggtggcgcatgtctgtagtctcagctacccaagaggctgaggcaggagaatcacttgaaccgggaggcggaggttgcagtgagctgagatcatgccactgcactccagcctaggagagagtgagactccatctcaaaaaaaaaaaaaaaagaaagaaatgcttatttattttggaatcttctgtgatccctcatatagtgcctagcacatgccctgtactagttaagcaaatgagaagaaaaatgcttgtaagctgcatgagggccccagttacacctatcttgctcagaattatgcctgcagggcctaacacaatgctggacacacagcaggtccacaacacatatgtgagaatgaatgtgtaaacaaatggctttgtgcacaatttcataccatctacaaaaacgttttctacacgcagcatctccttagtctacacaggaatttgggtggcacaaaggaggttatagaagactcttagcaaggtgaaagatatttcaagttggctgggtacggtggctcaggcctgtaatcccagcactttgggaagccgaggcgggtggatcacgaggtcaggagatcaagaccatcctggctaacatggtgaaaccccgtctccactgagaaaaaaaaaaaaaaattagccaggcgtggtggcgggcacctgtagtcccagctactcgggaggctgaggcaggagaatggcaagaacctgggaggcggggctagcagtgagccaagatcccaccactgcactccaacctgggtgacagggcaatactctgtctcaaaaaacgaaaaaaaaaaattcaagttaacaaagtgacaatctgtatgcacatatttaggaagaaaagatagactgacaatctacctcaaagggaaagcaaatattggaagtttcatttgttgctattctcttctctgtttttggtggatcttttacctggaccatgaagtggttttctgcaaggggagtattgcagtaaaggcacgtacagacagagatgagaacataactgaggcacagagggagagccgtggtgacagatactttctgtccttggctttacttctgggggagacttctttttcacatactcctggcaattattagtccaacaaatccatcataaagttttaggggagatgtaggaacattcagtcccggtatatgcaatcattatcctttgggccgaatctcctctgagttaattaaattcaaataagtatctttccattccccgggacttgggaggaggagtccaacgcacttgagaagtcacaaaacagccattagatgttaataactaagaactgttccaacctctgctggttttaaatgagaagaccagaggcataaagctccacagggcattcctaacttcctgaggcactcagctgttgaaaatcaattcctcaaataatagtttcctcttccaaaatttagctggatcagatatttttagtttaaaggtcctaatgagactttgtaggaacacgcacagcaagggagaatcctgcacgataaatcactggaggtgtgccaccttacggctggaaatttgaataaacagctttgatgatttatagcagatgtttttccacttagttgtagcccaccaaagcacatactaggcagcatactccaggagaatgggaattagaaccatttttgtgtcattcgccactgtctaaatggcacctggcagtgtctggtagatagtaggtgcccaacaaaatttttctagtggacaaatgacagttctatttagacacaatgcagtctcctctggtcagtcctaggaagaagagggcattaaatcacgtattggttttcaggcacaaagaatagtggacctattttgaagtgaaaatgctattgccttggtaaattcttctgtggggctagaaagaataaactagaagtctggggagttgcacggttcttctgaaggccttctagacctactctttatagatagattgccttccaaacatagcatgtttccacatgtatttctcaattattagttacattacttctgcctattcttggaccctagcccagtgtctttaagtttgaacttaataagtgttcattgaataaatgctgactcatatctaatagggcatatgttccaaatttacttctaaccataaagatgtgttttttctgcatcaagctatccttgctgtcagtcctttttgtgaccaaagcctttattggaaagaagattgaatggacataacagtacgatcaacagatgtgatgcttggcagtttccccatctctgcctgtaactccagcactttgggaggctgaggcaggtggatcacctgaggtcaggagttcaagaccagcctgaccaacaaggcgaaaccccgtctctactaaaattacaaaaaattagccaggtgtggtggcgaatacctgtagtcccagctactcgggaggctgagacgggaatcgcatgaaccctggacgtggaggttgcggtgagccaagattgcaccactgcactccagcctgggaaacagagcaacactccatctcaaaaaaaaaaaaaaaaaaaaaaaaaaagacagaaagaaatagcacctaattcttattagagttattttgcagtctaaatgatttcatatacgtaaagtaaatagaatgttacctggcacttgaactctcaataaacgcaatttcagtatccacaatatgtattattgtatattatcactgtagttccaagtgatcaccacaaatatcaaaactaatttatgttatataatcccaactggaatcagaagaatgctttgggttatcttgggactctgcaaatacttaagtttgagaaacacaaagaataaaaaaatctaaagagaaccagaatttatgtaaaataaaaattaaagtgaatacgtattccagttgaaaggagaaaataagcacagagagttctcagggtggaatttatgaaaaacatcttcaccttcatcagcaaacacatcttttttttttcttttttttttttctttttttgagatggagtcttgctctgttgcccaggctggagtgcagtggtgcgatctcggctcactgcaacctctgcctgggttcaagcgattctcctgcctcagcctgctgagtagctgagactacaggcatgcaccaccacgcccagctaatttttgtatttttagtagagacggggtttcaccatgttggctaggctggtctggatctcttgacctcacgatccacccaccttggtctcccaaactactgggctcacaggagtgagccaccatgcctggccaacaaatacatcttaagtactaattgtgtattatgacttgttaagttttatcaacacggagaaaataaacttggccattgtcgtcaaaggaatggccattgagagtaaaacagtcggtcactcaccacgtaggtcccacactgcaacttgtggaatagaaatacaggaaaagtgcaatgcaatgtgaaagatcacaaatgttcctttagaagggttggagacagcttcaagagaaaaggtaacatttgggttgggccttgagcccatacagatatttatgtggtgtagaagaggctgtggtggaagtggggaagaagagggcttctagcaaaggagcagagaggaggagaggcctgggtcttaggaaccaccacatgctggcatggccagattttcagtttagtgaagagagggcaagggctgcaactggaaacatgcaatgcatttcctgtgccctggtaggcaatttgatcactatcttactggcaatagaaagccaacaaggcctcaaagcaggcttggaaaggatgactctttttcaggaaaaatagcctgtcagtagtgtggaaaataaattagaaaaggggagcaattaggtggtgagacagttgtgacaataatccaaacagtggcaaagccaattgttgaatctctgattcaggcctcaagacagcattggaacagacagaaatggagactaattgcatgtggaagaaaaatggagcaggacactatagattccagagcaaagcctggatagagattgacatggtttggatctatgattccacccaaatcttatgttcaattgtaatccccagtgttggaggtaggcctggtgaaaggtgattggatcatgggggcagttcctcatggtttaacaccgttggccttggagctgccatcgtgattatgagttcttgtgagatctggagtgtgtggcccctgccccctccctctcttcctcctgctcctgccatgtgacacctgcctgcttccccttcgccttccttccaccatggtcccctgaggcctcccgagaagtgggacccgccgagcaccgtgcttcctgtacagcctgtggagccgtgagccaatgaaacctctttaaaaaaaaaaaaaaaaattaccagttctcattcccagaaattacacagatatgcctgtttcttttgttttgttttgtttttgttttgttttgtttttgagacagagtctcgctctgtcacctaggctggagtgcagtggtgccatcttggctcactgcaacctccgcctccagggttcaagcaattcttctgcctaagcctcccaagtagctgggattacaggtgcgtgccaccacgtctggctaatttttgtatttttagtacagatgagctttcaccatgttggccaggcttgtctcgaactcctgacctcgtgatctgcctgccccggcctccccaagtgctgggattacaggcgtgcactgcacctggccctgtttctttataccagtgtgagagtgaactaacacaaattaaggggattggcagagacaataaaagattcaacaagaaaatgttttgagccactggagggatatgatggggagggaatggtaaggtttacctggaaaaggtcgaggccgaattgtttgattggttgtgaaggctccttgtttgtcctccagctacagtcctttccacacatctcattcatacttcaaattgttccatttctcttcaagccccccaatcctcaattaatgggctttctcaaagaccaggaatatacttcagtcactaaacccagtgttctcttttcaggccttaacctacttgtccttttgtagaaatggaagataagtgtgtacctctataattaaggcagtcatgtaatgtattgtccagacagatacatttctgaatgtagaaggacattgttaataattatgttggggcagtcctggactaagcagaacgtttggtctcctgagaagcaggatcgtgccaggtgtggaggctgctccagaacaggcaagcacatagtgagaaacagtggtgccactcaaagagcatcttgagtagtagcggaataaagagcctaataattcagggacaataaactttttccattccctgcctaccccacactgccaacacctctggtccccaaggctgaatagcagatcaggcagagggtgagggagtgtggttttcaggcgtccagactaaagctgcttagtggatggaagttaaagtaccaaagacaaataacctaactctccgttctgcccagaagagccctagaactgaagatcgggaatattggttcaagtacccatacggctcctgcatgtcctacactgctgaaatggaatatacaccttggagctctataggagcagggaagagtttcgggactcaaagtatttcacccttttttagagctatgagataaatgaggagaaaacaaacaatgataacaacaagattgtaatgttaagtagctcttgatttctgagcccaagtgacaggtttagctcagtgcaagactgagctcatgaatatttttgtttactgttttcatgaagcctgcttgtggcaaagataaacacctgccttgcaaatttatttcttaaatcaaaatatatctttcatattttaaaaggaggtgtgtttaaagaggacaaggattaaaaacattcattgctggatttgtgctataatatgcttgccctaaaaattttatttttccttaatttgaccatcaagatgtttgctatgcctttccaatttgcagttttcacataccaaacttctgcagagaatctggatgttgtaaagcatttctgaagttacagaccatctgaaagtttcttaatgggtctaagagccacttcattatcttttaaaaatatatacataaactttagtctttgaaaaagtgcatttttctaaaatgctgataacgctgccatatgttgttttcatgcctttgatttgtaatagaaaatatgttcctaagaaacaatagtagattcacatgtagttgttttccttccaagccccaaattatattttctactttaccaatttataagctgttaaagccaaaagcattcttcaaaatagtctgctttgtcacatcacatacacctacctataatttataattctctatggctatcatttaaccttcaaaaagtgtcattgatattttctgggctacaaagaagttggctactctttctgttcaatgaaggaaataagaaaaataggcaaattaggtgaggtcctgaaatagactgagagaaaagaaatgcactgaatataaagtttatgactggttctgtttgattgaattttacaatgtccagagaggagaaaaatgcaaagccctattaaaaagcatgtttaaatatgttatgaatctcctgggctggttgtctcataatctggattattgaagtatagcacaggaaaggcctaagaccttaattagagtaagtgatatggcagctcgggcatcagcaacacaatctgccgattgtgagaaaaacaaaattagacaaagggctgtggtttagagacatgcttgaacagttaggattttttccctagttttttctaaagtgaaaagaagcagatagccagtgcaataagccaaggggagagggggtataggcctatttggtgggcccatatgtaagcacaacccaaggctcatatgcgctagacaaatcacagccatggagccaggaggaaaataggagtctccataaatccaattctgccagtccaagtccaaaatttatttggacaatcaaagagagaaataatgctgtgaaaagtaatcttctcttcatgtcttctatatctccatggatttcaatgattttgaattggttccccgtagaaataattgtgaagattggctgtcagccaagaaatatttttttgtgcatttactatgcataagtaaatgagttccctgtgtctccttttatcattgtggggtctccaaccctgagatctcaatcctcttcaaaatctcccacacttgtaagtacaaatgtttcaactgagctcatgagtaatttatcttagttcttctaatggccaaggcaatttctgtgcaagaaaacacaaagcatgtcatgagttcagttggcgtctgagagtggtgatgtgtctgacactcaagccaagcacggagtcccccaacactattaaactaccaactcaggccatggttcccctgatgaccggtttgtaagcaaagcgacagtgccccaaatgcactggattaaactgtgctgtgtcccttggggtcctaattacattgaagcctcttggcattccatgtgacagacaaggtcttagactctttccgccacaaaggtacttttgtgtgtaaataaatctcaattttgtctgctttgttttattgttatttgtttttgtctgtagaatctctctgtaagttttatgtacatgaagtgaggggatgtatctgagggctacatgctcaaaactatcctttgttttggagaatgatggtgtgattttgaacccgatctttgtttgccttaacctcacttcccttaggatggattaggtcacagaagatatccggatttgcatggagacgtctgtgcaggacagcccttgggcccagcgtgacttccaaccgtgattcctcaagtgattcctgcaactgtgattcctcacaagttccagcagtgctgcatgcatgtgcaggggaaaacaaggaggcatgaggcaaggatcacaccctcagaaaatgttcagtttaccagagaaggtagacacacagcaaataatgatggcacaaactgaaagcgatgtctgccacacaagtagccacgagaagaaaggacacaaatacaagcaaacactgtcaggccccctaatgtgaacacgaccatcagtttcaggtgggcacaaggaatgaaggcttagtccggtctaagatgtgggtgtctaagcgggtggttttgagggacagaacttctgtcctgtttcaccctcttcacttcctttctcctccttactgagggtcatagcctttgattgtgctccatttcactaaaaggtgcaggtacttttccttcaaaataagctcaaacccttcctgaacgctttctctttcaactcttaagcacgtgtgctgtggagtgacttgttatttcctgccctacagatctgtaagagagctagggcctttgcccaatgtgtgagaagaggtgcaacttgcttcctctcctgcattcaccttagcagggttgtcttccgcgcggctgaggtggccaagctgctcacatccctgcacccaggtcttggccactaccaaatggagaagcccagtcgacaaatgctgtggccgggcattgtcaccccagctgcgagaccttctctctatccatggggagggaatagaaggcttcatttatgccaccatatgagcaataagaactttggactggttttataagtgaatttgtaatctcacatcccaagaaaaaagtcttctgcagtttccaaacccttttaggttcacttgcttgttaattttattgtgagaagaataaataaaatcagaaatacataaataaaaatattttgatgagattgtcattcaaaatggatttgttggtgcaaaaagagtatttttaaaaagaaaaaaaatccacacaagaattatcactaatctcaaaagacataaacgtcttagtagcctgcagagatagcttttactttattttaatatcaaagcagatgaactcaaagcagatgaattaacttccttaaaatatcaaaagctgattgtctgttctcataattcaataaatttggcaaagaaaaagtgtttcaggtaacacatgctttatgaaagtgtctcagttttgtaaattaccccttagcctccagtattagagaagagcttcagatttttataaatattaatcctgtcctggtttattacgtgctgattcagatataaattacttttaaaatttaaaaaatgtcatgcttattggcctaagaaaataatgactttcctatcagagactacaaccagactttaagaactcaatatcataaaaatgtccattctccccaaatttatttacagattcagtgcaattccaataaaaagcccaaaagtttttctatgtaattagacaagttgacttttaatttatatggaaaagtaaagggccaagcacagtggggattcatcattgggtgtatcaaaccttattgtaaaccagaagtaattcagacagtgcaagtgttgtctagaaatagacaaataggccaaggaaacaaaatagaaactccagaaataaactcacatatacggaaatgtattaagtgcaaaagcagggatcgaagctctgtggtgaaaggaagggctgtttatgaatggtacttgcacattaacttatggataccaaataatggaaattggattcctacttcacagcctatacaagtatggtcatgcactcccacataatattttgatcaacagtggactgcatatacaatggtggtcccataaggtaatcagggagctaaaatatttctatggcctagtgatgtagcagccgtcataacatagtcacataatgcattaccttttccatgtttagctgtgtttgatacacatagaatcatgttacagttgctgacagtactgagtacagtaacctgctgtacaggtttgtagcctaggagcaataggctattccgtatagtgtaggtatgtggtaggttgtgccatctagatttgtggaagtacactctgtgatatttgcacaatgatgaagttgcctgatgaagcacttctcagaacgtatccccattgtgtttctcagaatgcatcctcgtcatcaagtgatgcataactgcatagctttaaggtagatttaggacttaaatatttaaggcaaaactacaatctttcaaaagacagtatcagaaatatcttaattacctcagggtaggactttgctttaaaaagatgtaaaagaactaaccataaaaaagatggataattcgactacattaaaatacagagcttctgatcatcaaaagaaactattagaaagtgattggacaagtctgaagtaggaagaatgtctgaacaacacagaagcagcaaaggcttggtttgaagagcataaaaacgcttataaatgaattttaaaatgataagcgatgtgataattggcaaaagctataaatagaaatttctcaaaataagcagcataattgatgcatgagatatgaaaaatacccaatcttactagtaatcaaagaaatgcaaattaaaactacaataagacagcatttcctatccacctcagataacgttcttaaatagcagagcacatatatatgatttcactttttgtggtttagcttttcattctgagaatgagaataaaccttttcacccatgttttccatagtccggtctgttattctacattcttttacattctaataccttatgttttccattacatcctttcttctcacccttatatcagtttctaatggatttagcaggaaaccaacattcctgttcaacttgtacaaacttgtgaaaacataattgaaatgaaaatggaaatttcaggccaccagatgtctttatgcatctgcataaataacagtgccatgaaattgaccccagcctaccttttaagtaggaaaacactctcctttaatccaatgtggatgattatggatgattcatttgctactaatttgctgaaaactcaattcagaaaatactaacaatacgtatattaagccttaacaaatgacattcaacagaaatctgtttcctttgatacttttcctttaaggaagtctccagacagtgtttcctaatcagtataatgagctttctggaatttatgaaagcgaaggctcctttcagatctaaagtttcagctctgtattttcactattaagaattgtttacacctataaaaccagattgaagagctttgctaagtctccgtccctcttctccatcccctctgcatccgtgtctcccaaagctctttattaccctccccatttctttgctctgtttctggctgccgcttttcctcaatcttgctctcattctccttcacactttactgctctctcactaactccacaagtttaaaaaactaacccaacttagaaatgtctactaacttcctaaaacatcctccacaacattaaaaagcactgctaatatttttacaatacaatacacaaatatttaataaaatcaggacaacacacattcccactttgtaccatcgtgttaccaaatgagattcacttgtaatgaacaaatcatcaatcttcgctgttatcagaaactagcttccccaagccttccagtaattttttagagttctggaagcaatagctccaaacctagtctgtcagcaggagactcggcctggcttacgctccacttggacttctgctcgggctcccgggaagccatctggggcagcctggcgtccatctgcccttctgaagtaggtcgcagaccctgccaagatactgaccctggatgccagtgaaacctcatccctgtcatgacaaagaatctctggagtccaggtaaaggtagggagaatgcctcctctccaacatctcccacactgcatcgtctggacaatggcacagttctacttctgtgggcacctctgttcttcatgaaaaacaccactgccatattttggccagatctgggcaatacaaggctcactctcagcccaaagggcatgcatgaaacagatttcttcccacgagggagagaccctcctattatcctcctaaattccatccccacttagaaccatcctcccatgtatcctcctataatcaatctcccatgttatttatctcctaaagtctattcccagcttagaactgagaattcttcctttctcccagttcccacacttgcctagttaaaaactgtccagtttaaaacaacgacttccatgcatgccaaagacagaagcagatcttagaagaagatggcttcccaaccccacctttctcagggctcttgctaaataatttattagattgaccagccagacctggaatttgaacctgacgcatgatcttggtggagatactaactgctcatttatcatccctaaaagggagaaaaacctgcatttgccatacttcaagatctagtccacacttagcttccctttggactgctgcctttcactctttcatttatctagaatgctgtgtattttcctgactacatataactacaccgtaaaacatctgaagactgcataaaaacataagaaaaaataaataaatcatttcaaaatttcatcacactgaggcaaccactgtcaagatcttggtatctgtttctgttatgaaaatatgcaaacataaattaattttacataaaaggaatcatttctgtttacatcttttaaatttttactgttgcccttttcttgctttccccactccacaagtgtccttattaatttctttattcctcatatcattccttgaaagttgtttattacaggtatattttcctttttctctttctggctgcagaattgtgttaagaatgagataaaaattacccatgtacccatgaccttattaaaaatcatccatcaccgaaacagctgatattcctcctagttcttccccaactgcctccttctgcacccacattagccagcatcttcctttggtgtttgtcattctcacggatacctttacatgtgtgtcacatacgtctttggcactaaacagtatgtagcactgcgttatatgttcctaaccgcagtacaaatggccacagctatatatattttcctggaatctctcttttctcacttaatgcggattaatatgagtaagtctagtttcttgactttgctattttgccacattctcttgtgggaatgtacatcaaggtattagtcaattcctctgttaatggacattgctgttgttttcatccttttgctctcctgtggtctgtggctgtgagcctttttttcagattgaggcagcatagcaagcagttttgaagggggactccagtgcagactgcatgcatctgatgtgtggtggcgccatgtaggagctcagcagccttggcaagttagttaatccactgtgcgtcacttccccattttaaaattgagataaaaatagtatgtacttcataggactattgagaagagtattaacttgaagcatatgcaattataattttcatagtccaaaaatggtcacatattagcatttttatatggtgaaacctaataaatgagataattgatatagcatatttagaatggaggtatacagtcagtacttagtattagctgtaatgatagcagtggtgatgacaatgatggtgtctctttgtatatgttaagtctcaggctttctctggcctaaacagccaggaatagaattgctgggtcacaggatctatccaaattcaacctttacctccagaatgttctccagagttttctatccaagatatgttttatttttctacatatttgtgtcttaatatttttcaataacgttttataatattgttcataagaattattcgttttcttctctctttcccctctcctcctctctcttcttctgttcttttttatctctttcttcctcctcctctacctctccttctttttcttttttctcccaaattcgaagatgaacactcttctgctatcagagtagaaaggtctgtgacttcctcatgtttctagaagatctccatggatcatgcaaaaggtcagatgccatctttactttcacagctctggaaatccatttgctaagctctcaattatcacccagagctctaggacggtatttctaagacttttgtgtggctcacagagtatcatgctgttaactgtcccagaagcctagaggatcccttggctttacagcgcacagctcctgaccctgcagctccactggaaattggactgagccatcatcttccctgagcctccccgcttcgctcttcattgtcctccctccctattcggcagatccagagattcactctgctgcgtaaattcttttagtcccaagataaagcactgcctatgaagagatgtctaacttttaaaactggccaattacatcaaaatttatttggttctataagcaaagatatggcccagcaatttattaacaggaagggaatgctaagtgaatatcagcaatcattaataaagatgttgtgaatggtttcagaacgcacagtaaacaatttaattccaaatgatatattaagagagaactaagaagaggatttctttcagatagcacagaatagaatatttttccaaattaatagttacaatattcaggagaaacaaaccgttcaaaataactgaaccctgcctgtagtctctttcctgtattgctaatcctctttcctatttcgtttttctgtcatttctttctctctctacttggctttttccatcagcatgtaaatctaatttagtttttgccatccttaataaaaacaaaatgatgcctgcgactgttgtctaatgtctacttttcaaaaccaaaattttcaaaagcactatttatgctgtttgtctcttcctcttcccctttcctcccagcccatttcaataaggctgactaccgccaaccactccgccccagaggcatctgcccccggccgcgcaccctctctccctcaccacgccttggtgtcctcacgttcccgcacctctcagaagcgcttcctccacgctccacaacggccttccccgcccagaagcgcttcctccacgctccacggcggccttacctgctcagaagttcatgctcccagcggccttccccacccagaagcgcttcctccaggctgcgcaacggccttccccgcccggaagcgcttcctccagtctccacagcggccttcccgcccgggagcgcttcctccacgctccacagcggccttccttgtgagaggtgacagcgtgctggcagtcctcacagccctcgctcgctctcggcgccccctctgcctgggctcccactttgggggcacttgaggagcccttcagcccaccgctgcactgtgggagcccctttctgggctggccaaggaggagcccgctccctcagcttgcagggaggtgtggagggagaggcgggagcggaaactggggctgcgcgcggcgcttgcgggccagctggagttccgggtgggcgtgggcttggcgggcactgcactcggagcagccggccggccctgtcggccccgggcaatgaggggcttagcacccgggccagcggctgcggagggtgtactgggtcccccagcagtgccagcccgccagcgctgcgcttgatttctcgccgggccttagctgccttcccgccgggcagggctcgggacctgcagcccgccatgcctgagcctcccacccgcttcacgggctcctgtgccgcccgagcctctcggatgagcgccgccccctgctccatggcgcccagtgccatcgaccacccaagggctgaggagtgcgggctcccggcgcgggactggcaggcagctgcacctgcagcccctgtgcgggatccactgggtgaagccagctgggctcctgagtctggtggggacctggagaacctttatgcctagctcagtgattgtaaatacgccaattgatactctgtatctaccgcaaggtttgtaaacacaccagtcatcaccctgtgtctagctcagggtttgtgaatgcaccaatcaacactctgtatctagctactctggtggggccttggagaacctttgtgtggagactctatctagctaatctggtggggacgtggagaacctttgtatctagcgcagggattgtaaacgcaccaatcagcgccgtcaaaacagaccattcggctctaccaatcagcaggatgtgggtggggccagataagagaataaaagcaggctgcggagccagcagtggcaacccgctggggtccccttccacagtgtggaagctttgttctttcattctttgcaataaatcttgctgctgctcactctttgagtccaccctgcttttatgagctgtaacactcaccgcgaaggtctgcagcttcactcctgagccagcgagaccacgaacccaccagaaggaagaaactctgaacacatccgaacatcagaaggaacaaactccagacgcgccaccttaagagctgtaacactcaccgcgagggtccgcggtccctcttcattcttgaagtcagtgagaccaagaacccacgaattctggacacacctgctcagcagttcatgctcccagcggccttacccgctcagaagcgcttccgaagtgcttcctccaggctccacagcggccttccccgctcgctcctttgagctcctcctcggtcgcttttgccagcctctgcctccctttctagcgtcctatttcagcacactcattttcgtttcaggcaggtgcgctttccgttcccagagcgcactggaacctctttcccgctggcctcagccttttcttggaatgccctttccagccttttcacgtggaagcaccactcagcttcaaagccacctccttgggaggccttctctgaccgcccagcctcgttcgcgccacgtgtacattctcagtgcagccagtaaccgcccatttatgtatacatacacatgtaaatgcacatataaataattcacccactataattttgatgaaatatatatttaagaatgtgttgttttgtccatcattaaagtccaagctccacaaaatcagaaactataacttttttattcactgccacatctccagaattagcagattgttggtatagtgttaattgaataattggataaaatttccaacatacaagccctacagaaaagaacatgtgtggtggaaactaaaatacattttgcctatttacagaaggagatcagttggaagctttccttggactaagagcatccttagctatgaaggcgaatggatcttgaggctgcaaggtattcaacaaatattggtatgatggggtcatattgttgacttttaaaaatactgcaatatactgacatatcgaaacagcgacgttcggctatgttttctggtgagtatgccttcaggaagaagaaaagacgagatgccttcccattcgaatggtttatgctctgaatcacaaaagtttataagatcaaagtgaaaagtcaatgtagattttgtagaatatttaatgaaacgttttgcgtgttagggctccaggtagtgcacgatctttcatggcaggaaagccccactccgccaccatgggaatctgtgaggacgccaagcttcagttctagatccagaagctttcccagggagcaggctgccgtgccatttcacattccacgtggcatttccaatggggatgatgagaagccactgagataactctttggagaaacattcagctctaggaaagtactatgtaacctgataggttcacttttgacatttcattttatatatttctaagaattttttaaaattcctgcatgcagccgttagacaaggatcataatcctcattgatgctgtttaatgcctaataacagatgcatattggctctagtaaatggcttgtaaggtattaacattaattctaggtataatataataatacaatcataaaacaagtaggaaatgacaaagatgagaacggtgaaaacagcatacaatcttcaaggaaaagttatacatatggatttaaaccacaggtatacagtcatttttattcatttttgtatacctataccactaatataaatgtcagaagcaccacattctgaattattattagtgttgtttttgtctccttttggcctgaagaatttgaaagccactattttttactctgcttcaaagcacgggcctcatggtgggtatgctgttttaattgaggcgaggtggttcctgtaataagtcatggttcttctgcactgtgggttagactcacagtttataaggctgagaaaagtgcagtggagtcaaattctacagtttcccagcagcagaacacgtctaaaaatactcagaatatcaggtagttctctcccttcctctacttttttaaaaaaactctttcttcctcccttcctctcatctttcattcctgcctttctccctcccttcctcctttccttccttcctttttctatcatatcgtatcatatctatcatctatctacctatctaatctatcgtctatccatcacctttcttcctctgtctcttccaccgctatcttcctaaaatagtttctatttttattactccgcaccagcactgtctcatagaactttctatgaggtcagtggcatttcatacctgcactatccctacagttggcagtagccacacttgagctattgagacatttgaagctgtttgtcactttaaatgcggctagtgcaactgagaaaatgaattttaactacttaattttaattaatctaaatttaaatagccaatatggctagcggctaggatacacttacgaagaaaatgctgccctgaccttcgggatatcacattccagggcacttgtactgacaacattctgcacagtatattttgaggtttattgaatcggtgggcgtaacattcctcatcacatatgagcttaacaaaccaacaatacagcagaacgtcaagctatataaaacaaatttatataagcaaaaattgattacgagactcaagacagcaagacaattcattgtcaacaaacatgttaaacaattccacaaaataagtaggtttttgatcaagtaatttgtcttcccaatattttatattctcctacaaatcattttgttctcagagctgcaacctgtgttctaggctgggtccctctttgacatatctcgctatgtgatattagacaactcaaattgttctctaagagccataatctttccacctgtaaaacaaagactaaggccagtgatctacaagcactcttactgctgtcagattctggaaataaagctcttagagaattttttttcccacaacatctttaacacatagttaggttgtcttttaaatattaatctagagatgtggaaaaaatacttataccacctctatgtgttagtctttgcagtagtattttgttggtttatgtgtgtgtgtgtgatggagtcttgctctgtcacccaggcttgagtgcaggggtgcgatctcggctcactgcaacctctgcctcccgggttcaagcgattctcctgcctcagcctcccaaatagctggtattacaggcacataccaccacgcccagctaactttttgtatttttagtagagacagggtttcaccgtattagccaggatggtctcgatctcctgaccttgtgatccgcccgcctcggctttccaaagtgctgggattacaggtgtgagccactgcgccaggcctgcagtagttttaatatagctgctagatacaatcttagattgttgaaacacacacacacacacacacacacacacagggaaagagaaggagtgctaaactgaagctataattttttttttattttattctactcttttttctttttttttcttggaagggagtcttcaagtaaaactatgtgtgttgatagagcatagtctttttctcatcacatagctaaaatgcccttaagaagtatgggattgctctgcccttactggtttatggaagctcggtttacagctccatctaaaaagatggcctttcgagaatatgctgttatgggtgttttctagggaagagtatcttttaagaatgtgtgtgcacgtgtgtgtttgtgtgtatgtgtgtgttagactagatctatcttgcccccttcaaaaatgtttcataaatatttaggaggggaggtcttgtgtgttggctggaccacagttgtttagaaaactctgccatatgtttgcttaataatgcaagcctgtggcttttagagtttgggtatcccatggattgttttgtaaaataattttaatttcaaatgattatagtatttaatttccctttcatcagccattaaatacctcaaggagttattatttattttctacctactttcagtaaggattcggggtgggttttgaacacattcagtaactgcaatagtcactcttgtagaggaagagtctcattcgattgttcctgcatggaaaagatgttcagtcaattctctattatccgcactaatagatgggtgcaatcaagcagataatttaagttatcgagagcagcacaatccagtttgtattttactttagaacatgtaggtatgataggtgtttagccattcaatctaaatggcaaaagcaaacatctgaaaagcccttcggaggcacagaaggaagcccgctgtctcctctcaggatcctaccccctgtcccagattcaccactgaaaatggaatgcatcaccgatgacaaaatgagagcctagtgtggaattttcttacctgagtttctggctgagacccttcctgggagagatgcaattaggtgttcaagtttagatcattcctcttccagttaccgcaggaagagacaggtttaatttcttatggcagatgagaatgctggtaagattccacccgtgcaccactttgcaaggcagttgaagaatccctatgccgtagttagtttccacttgttaaatacttctgtcactgtttcacaatgccaaagctttgcttgctgtcttagccaactgtaatagggtaaccactgcagtagaaatttcacaaactgtacccggtctcattgctagtgcattaaagcaattcatacataacaaaatatgacaggataaaatgaaataaaataaaaagtctcctgaaaatcagtattgtgcttatccttccacaaaacacatatcagatgggtatgaccgaggaactactggattcttcagtcagtatccactaataattactatatgttcattatgaaattgagagtaatgcacaggagagagacatatttcatgttcactaaaagcacaggtataaataagtgataatacaaaagaagacctactttacaatgtacattcaatatattacatttctcttcattgagatccagactgaaatggggaggaggttgacatctaagtcatttatagaattttgagtgtttcccaaagttcttaggtctaatcagagagactctgctataatacaatccatgggaaatgatactggtttcattttcaactggaaaacttattctatatgaacagagaggatgagtaacagactaattaatgacatctgaaaagagtaacacatggtttataatcagctgatgtactgttgagcattttagttttgaccttggcaagatttggttctaagactatctgtgaaaattttgatttcaattctgtataactactagactgcacacaaatctgattcagaagaaagttaatcattaaaatgttagattccttctaagtagtattgtttaaagcatttaaatttagtttctggggttttctcattaccaaatataatggaaagattgtatatagcaaagacttttcccagtgttctgtaaatgtagtaaagatgtttaaattataaaaatgcagctagaataaatccatattcattgtaaatatctcattgtatgatagttatatttgtgtcttctttgccaaatgtatgtatatttttattctgactcattactgacctttcatcaatatttgttaattaaacaaaattattactacatatggtagaatgcaagctgaacaggaactcgaagagtgcagcaaacaatgaagttttgaagggggaggtgaagactgtgacaatgagctgcgcattgaaaggcaaatagggaatgaaaaggagaaattataaaatttagttttaaaaactttttctttttacttccaggaaactgtttaaatacatttctacaggaatatagactcaaaagactatttaactggatacataattttcagtaaattaataggcatttgaatcctaaaaagaaaaaacacagtaatagcattttgatgaatggagatgagttgagtaaaggagaacatatttttgacatatcctcagaggaggcgtagagaaatacactaacttccaactgaataggaacaaattcctgttcagaatattatgaggccaattcctgcctaccagtcaatcccctcaaaattcagaagagaaggaagaaataaatttatatttatatatcacatatatatatatatatatatatatatatatatatatatatatatatatacacacacacacacacacatatttcattcaattgaacaatattaattttaggttattttatacccgtttcaagactcagacaagttaaataacatgcccaacatgacgtagtaaatagtggatctgaaattcaagcccagaaatttaaatgcaaagtcaagccctttctgctacaatattcaatgttagaagaaacgatagagtgtcataattattaaaaataattatgctttctgtaaaactaattaatgttattatctttaataagtagcttcaaagtaagataaatcaattgtggaattaattagataaaattcagaaaaaagattgaaataatgtctggatattaattttaaatgtcataatttcaattatatttaaatttctttttattaatatatttattaaatatgtattaatgtaccctatgtgccacacactgtgttgagaacagagtattcaattgtgaatgacactgttcttgcccttgagaaattcatcatgtcgcccttttgtattttcagattttgcccaatgggaaatttgttgctatggggatcagcacatgacaaatattagcagatttatgagtgtagtgtgattctgaagtaagaggatatctccacaagcctcacagggatatttatctcattattttataatcacacaggtgcctaatgatttattttaatttgtttctatgaataggcactgtcataaacccttccctatgtgcacctcatttttgttttgttttttttttttttttttgagtcggagtctcgctgttgttggccggggctggagtgcaatggtgcgatcttggctcattgcaacttccgcctcccgggttccagcaattctcctgcctcagcctcccgtgtagctgcaattttaggcacgtgccgccacacccggctaatttttgtactttttagtagagacagggtttcaccaccttggctaggctagtctcaaactcctggcctcaggtgatccacctgcctcggcctcccaaagtgctggaattacaggtgtgagccaccgcgcccggcctcacctcacttttttcccatttttttaacgactcaggctccacacgtcactcactttttgggctcctgcttggttttgtgaaacaattttcagtctgtgtcctgaggtcaattctactctccctttcaaacatgatgcattcttttgcaaactctcatcagcattaagaactccttacaagtaggcacaaagttctacgactggcaataaatataagatcaactatgattgggtgcatatacatggacagaaaagggcattctatcataagcatattttaattaagaaatattttaacttgattgaaaaagtactgttctttttattatctgtgagcctatgatgcattatgagattttatactaatgttggttattattattaaaataaattcctatctgtagtggctgatctttttattttaattgcaaaatatagaaactgaagaaagcgagaacgacgagggaacccactatcccatattggacaagaacaacacctttctggaagagattttttttggctagggaatgtctttttttttttttttttttttttgagacagagtctcgctctgtcgcccaggctggagtgcaatggtgcaatctcagctcactacaacaaaccgcctcctgggtttaagcgattttcctgcctcagcctcctgagtagctgtgattacaggcgcatgccaccatgtctggctaatttttgtatttttagtggagacggggtttcaccatgttggtcaggctggtctagaacttggctagggaatgtcttattacatttacaaacattcctctgaagctgcatccaaaagagcactgcagacgaagagatgcccatgtagttcatgtatttcaactcatcaaggcaattctgttggttctttgggccacctgtttctagagccttcttccattttgaccatctgctctaacatgcatacaatgtagtgcttagggaccaagcagtgagaaactgtttgtttaacacaaatccatccatatgattggaaaagtactctgtgcatatttccattaagtttcagctttttttccaactataataaagagctctttgttatcatcacacaaatgtctaatgccataaagtatagcttaaaattttgcaaatacattccaccatttaatattttcccatgaatctttaataatgagataaagttataaaatatagacacataaaaagcaaacattttcttttagttcctcaggtatttcaacctttcttatgcatttatacaatgctctctttctctggcctgttacacaaaatccacatgtgcaaacacatagacacacagcatgctgcagcctcaaccctggtttctttccagcttactgtttacttcggcaggcattagctgcctctacagcagaagaccttcacgtttttttcactcgtgttgtattttattggagctatcaaattgcagaccattttctacctatccctgattccaacaagaaaagaaaaaatctgaattatgtgaataatggagatagctttgataaaaaaaattaccttcaatgaagtataataacttaaacttttttaccaaatatcacaaattatgtattcgcaatagagacgtatggataagctattatgacattaataagtgatcagttcccagaatttggaagactctcatggaccccagtgaacccacagaccactgcattaggaaagtcactactagtagttgtttcctgtgaatttctcagtttttccctttgtctttgaccaaaatcttcagttccattcttccatcaaaacttttcatgaaatatttctaacaaaaatacacaaattaaattttatattccaataatacactcaaattttagatattgagaaactaataagaagtgattgcaggggggttgggaaaatagaattgatttgtaaatgaatatattttatttcatgaatagccatactacctctaatgtagacagcaatagctataaaatgattccttttattttctatttaacagaggctcttacattctcatttcctaatattaatctcctccattatataaatttattttcactggtccttaagtcctgtattcttttaagataaatggtacctttagtaatctatctggttccttcttaggtattcaatattttatactaaaacattgctaaatgtatgagatgggagttccatgaataatgagatggggagacaagaaatgaccagtgttaacaaaaaatattcaattattgaattttttgatataaaaatatgaaaaacaaggtaaataattaaaatttagtaacagacatgtgagatctctttgaaagaactgagattacagtatctggtgagaaaatggttgatcttgaacttgaatagacaatgagctatgatttgaaattatagttcttttttcttcaaaataatgggaaaaaggaaatgggaattatgtgttaagaaatgttttcagatagcaagtgaatagaagctgtcattccacatgagtgcattgttcaggaatctgttgcatataatgataaataaaactcaaactgtcttaaataatgaagacatatcactggcttggaagatgtctgcaaagccttgatcaagtggcgcaatattactgaagacagatttcttccatctctgtcttctacagtattttgcttcaatccaaaactggctttagctttcatctaaagctctgtttctggtcacaagacggaggccagtcgttagcaggagagccatgcttctaatcacactcagtaggaagaaaggttgtttcttccagtacgcttcttggaaaaacaatccaacttctattggggaagtccacagaaaatgtcgctacaatttgcattggccaaaactgttttacgtttccaggggtggaggcgagggttggggcagcggtcagtttccatgaagtacaggtgtttcatggacaaggggtatcatgcaactggggcttaattaacaggatgtaagaggaagggatcttgggcaatcccatttggcaaatatctaccagtgagaggctatttgatgagattcatcctgggttttgctgccagccctgtaaactcatctggggaaaactccattgctgagattactcagtacaagttgcctaccttaagttgagaaagaatggtaaatgtatctataatacttacaatcaaagggtccaacatctttaaagctaagttcattatcttcttgtttctttctttttctcctcattcaacccttgccctcagacacctatgcataattggagcagaaacaaaaaatagagcaataacatggcatgacatttctgaatccacacaattctttcggtattgttttaatacttttcatatatatatatatatatacacacatatatatatgaaaagaataaaaatatatagaaatatactttatatatttttattcttttcagaggtgatacataaaggaatttgagaagcatataaaaattaggttggttgattgtggcaaaatggctttgagcatttgtttattttacatttactaaatagggtatatgttttatgattttcttatgatgcagtgacaaacaatgctgaatagaagtcttcaaagggagcttaattgctttcacctttccgtgattctatttgcaaaccccttcatcattgtactaaaaaacatttatgttttctggtaactgtctcaaacccttcccgttttcaaagaatctctatggggttaaaagaactagatattccttcttcttggcatcaagggaatcagcagaactgacatcaactaggctctggcagtgcaggtttctacttcagacttttgaatattaacatggggatttaaatataagatagctaatacgtatgtacttctgattatgttgcagactatgttctaaatggtctcatttaattcttaccacaactttatgtaatagagacttctattttccacatttttaagatgcagaaactgaagtccaaagatgaaagaccagttaatacagtattagtaatggcaataagctttgaaaatctcctgagaaaaagggaagcatgacccaagatccaggaagtgcatttccacgtccaaccatgctggagtaactctctacaagcaactctaaaactaaactctaaaagcatatatggataaatggttttctggcattggacaataggatcacatgctttatgcgatttctgagagaacggggctctaggagatgagatgcgtggctgccccactctcagcctggaatgatttcctaaccaaaacacaaggagttgaagtccaggcagagaactatggtctcattgggatgagaagtggagatcagaatctgaggctgctgaaggggctgctatctgcagggcaacggaccgaggagattcaatactgacgtgatgtctgttctccaaaaatctatacactcaatgcaattcgaatcaaaattccaactgactttttaaaaattggcaaattgcttctaaatgttgtatgaaatcaaatgacctagaaaattcagcaattctgaaaaaaaagaagtaactacaaagttggaagatttaacctacttgacttcaaaatttattgtagggctgcagtaaacaaaatacttaatgttgcataggatcaattaaatacaccagagtccaaagtgtgcccacacatatgggcaattgatttttttataaaagcaccaaagtaatttaataagggggaaatggtctattttcaacaaatagtgatagaatagttagacatctgtatgattacgaacaaaaatgaaccctgaatagggtagcatgctccctcacactaacacagtaattaatttcaaatagatcatagaattcaatgtaaatgccaaaacaagaaagctttagaaaggaaacacagaggaaaaacgtctttgaccttgatataggtaaagatttcttagagaatacttaaaaagcatgaaacacttttaaaatgatgaaatagactttaaattaattctgctcttaaaaatactatgaagaaaatgaaaaatccagctggactggaaaatatctgtaaatatgtatctgacaaagtgctgatgtccagaatataaagagaatttttacaactcaatggtgaaataaataacccaattacaaaattgtcaaagggcttaaaatagatgcaacaaaacagaagataaagatcaataaacacatgaaaatatcctcaatatcctaatttaccagtaaaatacaaattataataaaatgacatactacttacccactggaaaggataaacttaaaaactgacaatatgaaatattggtaagaatatggagtacctggagctgtcatacactgcaagtgaaatgatgaaatgatgtaacacctgaaaactgcttgttagtttcctgtaaagttaaacagatacttacaacattgtacagcaattcaacttctgtatattacctaagagaaaaaatatatacatatgtccatacaaaggcctatacaagaatgttgacagcagcattattcttaatggcctgaaagtggaaaccagtgcaaatgtccatcaactgatggatgcataaacaaattatgcaatatttatatgatagaatactattcagcactaaagaacaaccaactgagatgctcaacaacactgatcaatctcaaaatgtaatgctaagtgaaaaacagcgaaacacaaagactccgttagtgtatctttccattcataagtcattctaaataggcaaagttaatctgaagtgatagaactagatcagtagttgccaggagtgggagactagggattgtaaagggagtgttctgggggatgaaaatgttttgtgtcttgaccatgatggtagttatggaggtacacatggttatcaaaacttgtcaaactatacattaaaattgtgtatattagtctatgtaaattagacagcaagaaagctaaatttttacaaatatcaggactaaccctggagtcttgcatccattggcaagaatatcaagcatcctatgggaaccattgtaaccacaattttccaatggcttgatcttggctgagtttgcaactcctttggttcttgtcctgctttagagcctgaattcccaggcttcactttgtttctgtaagctcgccaatgctttcactttattattatttgcttaagttggtcagggtgagtatctgttgactgcctactagtaggcctatctccagatatataggagcagagtgacataggctcttgatatggaaaattacagtctgctttttaaacacctaactcttaacagtaatgtgttgtttgatcttcaacaaattttttccctactatgtgatgcagtctcctaatttggtaagcatgcctaatttcccatgcaagtcttcattagtacaatgtcctctgcatgttgattgactgaaagctttatcccttataaaggcccaactgtatgagtaataagtgaccagtgaaaaaataagttggtaatttacagtattttcattccaacttatcctactttccttatggaatgaaaataaactgtatgtatatatgcaccatttgaaaacatcttgttttgttcatcaatgttataggaagtcacaatttagactttaaaaacataattgaaatactgatttacaaggtaaaattatgtaagaaatatcactgagcatctccttagtttcaaattaaatgggatctagttaatacttttctttctttggagacacatgttctacatcttaaatgtttttgaatgttcattacttaattcaacaagtaaaaaaacaaataaaccaattaaaaagtaggcaaaggacatgaatggatacttctaaaaagaagaatacaagtgaccaacaaacatgaaaaaatgatcaacatcactaatcatcacagaaatgcaaatcaaaacaacaatgagattccatcttacaacggtcacaacagttatcattaaaaagttaaaaaactctctagattcctcctctctggacagggcatctctgaaagaaaggcagcagccccagtcaggggcctatagataaaactcccatctccccgagacagagcacctctgggaaggggcggctgtgggtgcagcttcagcagacttaaacgttcctggcagccagctctgaagagagcagcagatctcccagcacagtgcttgacctctgctaagggacagactgcctcctcaagtgggtccctgacccctgtgcctcctaactgggagacacctcccagcaggggtcgacagacgcctcatacaggagagctccagctggaatctggtgggtgcccctctgggatgaagcttccagaggaaggaataggcagcaatctttgcgttctgcagcctccactggtgatacccaggcaaacagggtctggagtggacctccagcaaactccagaagacctgcagcagaggggcctgactgttagaagaaaaactaacaaagagaaaggaaaagcatcaacatcaacaaaaaggacatccacacagaaactccatccgaaggtcaccaacatcaaagaccaaaggtagataaatccacaaagatgaggaaaaaccagcgcaaaacagctcaaaatcccaaaaatcagattgcctcttctcttccaaagtatcataactcctcaccagcaatggaacaaagctggacagagaatgattttgacaaactgacagaagtaggcttcagaaggtggctaataacaaactcctccaagctaaaggagcgtgttctaacccaatgcaaggaagctaagaaccttgaaaaagggttaaacaaattgctaactagaataaccagtttagagaagagcataaatgacctgatggagctgaaaaacacagcatgagaatttcgtgaagcatacacaagtatcaatagctgaatcgatcaagcattagaaaggatatcagaaattgaagatcaacttaatcaaataaagtgtgatgacaacattagagaaaaaagaatgaaaaggaatgaacaaagcctccaagaaataagggactatgtgaaaagaccaaacctacgtttgattggtgtacctgaaggtgacagggagaatggaaccaagttggaaaacactctcttcaggatattatccaggagaacttccccagcctagcaaaacaggccaatgttcaaattcaggaaatacggagaacaccacaaagatactcctccagaagagcaaccccaagacacataatcatcagattcaccaaggttgaaatgaaggcaaaagtgttaagggtagccagagagaaaggttggattaccgacaaagggaagcccatcagactaatagcagatctctctgcagaaaccctacaagccagaagacagtgggggccaatattcaacattgttaaagaaacgaattttcaacccagattttcatatccagccaaactaagcttcgtaagtgaaggagaaataaaatcctatacagacaaacaaatgctgagagactttgttaccaccaggcctgtcttacaagagctcatgaaggaagcactaaatatgggaaggaaaaaccggtaccagccactgcaaaaacataccaaattgtaaagaccattgacattatgaagaaacggcatcaactaatgggaaaaataaccagctagcatcataatgacaggaacaaattcacacataacaatattaatcttaaatgtaaatgggctaaatatcccaattaaaggacacagactggcaaattggataaagagtcaagacccatcagtgtgctgtattcaggagacccatctcacgtgcagagacacacataagctcaaaataaagagatggaggaatattcaccaagcaaatggaaagcaaaaaaaagcagggattgcaatcctagtctctgataaaagattacaaaaggtatcaacgcacaagaagagctaactatcctaaatacatatgcacccaatacaggagcacccagattcataaaacaagttcttagagacctacaaacagacttagactcccacacaataatagtgggagactttaacaccctactgtcaatattagacagatcaacgagagagaaaattaacaaggatattcaggacttgaacttagctctggacaaagcagacctaatagacatctacagaactctccaccccaaatcaacagaataaaacattcttctcagcaccatattgcacttattctaaaattgaccacacaattggaagtaaagcactcctcagcaaatgcaaaaaaaaaaaatggaaatcataacaatctctcagaacacagtgcaatcaaattagaactcaggattaaaaagctcacccaaaactgcacaactacatggaaactgaacaacctgcccctgaatgactactgggtacataacaaaattaaggcagaaataaattagctctttgaaaccaatgagaacaaagacacaatgcacaagaatctttgggagacagctaaagcagtgtttagagggaaatttagagcactaaatgcccacaggagaaagcagcaaaaatcgaaaatcaacaccctaacatcacaattaaaataactagaggccaggcacggtggttcacgtctgtaatcctagcactttgggaggccgaggcaggcggatcatctgaggtgaggagttcaagaccaccctggccaacatggtgaaaccctgtctctactaaaatacaaaaattacccaggcatgatggtgggtgcctgaaatcccagctacttgggaggctgagatgggagaatcacttgaacctgggagatggtggttgtggtgagcttagatcgcaccactgcactccagcctggacggctgagactttttgagtgcaactcaaaaaataaaataaaataaaataaaataactagagaagtgagagcaaacaattcaaaacctagcagaagacaagaaataattaagatgagggaagaactgaaggagatagagacacaaaaagccttcaaaaaatcaatgaatctaggagttggttttttgaaaagattaacaaaatagatagaccactaggcagactaataaagaagtaaagagagaagaatcaaatagacacaataaaaaaatgataaaggaggtatcaccactgatcccacagaaatccaagctataagagcatactataaacacctctatgcaaattaactagagaatgtagaagaaatggataaattcctggacacatacaccctcccaacactaaaccaggaaggagtcaaatctctgaatagatcaataacaggttctgaaattgaggcagtaattaatagcctaccaaccaaaaaaaaacccaggaccagaaggattcacagccaaattctaccagaggtacaaagaggagccggtaccataccttctgaaactattccaaacaataaaaaagagggaatcctccctaactcattttatgagaccagcgtcatcctgatactgccaaaatccggcagagacacagaaaaaaagaaaatttcaggccaatatccctgatgaacatcagtgcaaaaatcctcaataaaatactggcaaaccaaatccagcagcacatcaaaaagtttatccaccactatcaagttggcttcatccctgggatgcaaggctggttcaacatatgcaaatcaataaacataatccatcacataaactgaaccaatgagaaaaaccacatgattatctcaatagatgcagaaaaggccttcgacaaaattcaacacacctttgtgctaaaaactctcaataaactaggtattgatggaatgtatttcaaaataataagagctctttatgacaaacccacagccaatatcatactgaataagcaaaagctggaagcattcctttgaaaaccggcacaagacaaggacgccctctctcaccactcctattcaacatagtattggaagttctggccagggcaatcaggcaagagaaagaaataaagtgtattcaaataggaagaaaggaagtcaaattgtctctatttgcagatgatatgattgtatatttagaaaacctcattgtctgagcccaaaatctccttaagctgataagcaacttcagcaaagtctcaggatacaaaatcaatgtgcaaaaatcacaagctttcctatacgtcaataaaagagagctaaatcatgagggaactcccattcacaattgctacaaagtgaataaaatacctaggaatacaacttacaagggatataaggacctcttcaaggataactacaaaccactgctcaaggaaataagacaggacacaaacaaatggaagaaatttagatgcccatggataggaagaatcaatattgtgaaaatggccatactgcccaaagtaatttatagattcagtgctatccccatcaagctaccattgactgtcttcatagaattagaaaaaaaatactttaaatttcatatggagcccgtatagccaagacaatcctaagcaaaaagaacaaagctggaagcatcacactacctgacttcaaactatacaattccacagtaaccaaaacagcacggtactggtaccaaaacagatatatagaccaatggaacagaacagaggcctccgaaataatgccacaaatctacaacaatctgatctttggcaaacttgacacaaacaagcaatggggaaaggattccctgtttaataattggtgttgggaaaactggctagccatatgcagaaaactgaaactggaccctttccttaccccttatacaaaaattaattcaagatggattaaagacttaactgtaagacctaaaaccataaaaaccctggaagaaaacctaggcattaccattcaggacataggcatggacaaggacttcatgactaaaacacaaaaagcaatggcaacaaaagccaaaattgaaaaatgtgatctaattaaactaaagagcttctgcacagcaaaagaaactatcgtcagagttaacaggcaacctacagaataggagaaaatttttgcaatctatccatctgacaaaaggctaatatacagaatctacaaggaacttaaacaagtttataagaaaaaacaaccccaacaaaaagtaggcaaagtatatgaacagacatttctcaaaagaagacatttatgtggccaacaaacatatgaaaaaaagctcaccatcactggtcattagagaaacgcaaatcaaaaccacaatcagataccatctcatgcccgttaaaatggcaatcactaaaaagtcaggaaacaacagatgctggagagaatgtggagaaataggaacacttttacactgttggtaggagtataaattagttcaaccattgtggaagacagtgtggtgattcctcaaggatctagagccagaaataccatttgacccagccatcccattactgggtatatacccaaaggattataaatcaatctactataaatacatatgcacatgtatgtttattgcagcactgttcataatagcaaagacttggaaccatcccaaatgcccatcaatgatagactggataaagaaaatgtgcacatatcatggaatactatgcagccacaaaaaaaaggatgagttcatgtcttttgcagagacatggatgaacctagaaaccatcattgtcatcaaactaacacaggaacagaaaatcaaacaccgcatgttctcactcataagtaggagttgaacaatgcgaacacatggacacaaggaggggaacgtcacacaccaaggcctgttgtggggtggggggctagaggagggagagcattaggagaaatacctaatgtagatgacagggtgatgggtgcagcaaaccaccatggcacgtgtagacctatgtaacaaacctgcacattctgcacatgtatcccagaactgaaagtataatttaaaaaaaatgtaaataattacaaatactggccaagctgcaaagaaaggggaacacttataaatggttggtgggaatgtaacctagttcagttactgtgaaaaacagtttggaggcttaaaacaggtctactatttgacccagaaataccattaactgggtatatacccaagggaaaataaattattctaccaaaaagccaggtacatttgcatgttaattgagtcactatttatagcaaagacatggaatcaacctaggtgccaatcaacagtggattgaataaagaaaatgtggcacatatacaccatggaatactacacagccatacaaaataatggaattgtgaactttgcagcaacatggatgcagctggaggccattatctgaagcaaattaatgcaggaaaagaaaaccaaatactacatgttctctttataagtgaaagctaaacattggaaactcaaggaaatacagatggtaacaatagacgctggggactaatagagggggaagggagagggaagggttgaaaaactaacttttgggttctagcttcaatatgtgggtgatggaatcatccgcacctcaaacctcagcatcacacaatatacccacataacaaacctgcatatataacaccctgaatctaaaataaaagttgaaaataaataaacaagtgagcataatacctaaatgaacttttaagaaccaagcaaaaatagaaaataaatgaaaatgttcattgatttttaaatgctcactgaagaagacataattttgataatattatcacataactctagtggaatttaagatcttattacatcatgaatatatcatttctaaattttgattgtatatattacaaaataaagatattcatttaatttaaagagtcctataaacgcaggaaattttcttgattttattttttatttcattgtctagataaatttcataatataaccaaacaaattacatgtttaaaatgaaagcattcttacgatactcaattgctgtatacttatagtcatcatgctggttcctaatgatctgacagtctgtcaaaaaaaatgaaaatagtcattagaacattccctttcctttcaaacttagattgtaacaattataatgccatgaaagtaagtcatccaatcccagaagacaacatgcatgcataatttaaaataataggccatagtatgttgtttggtctaattagtgtcataaatagtgcacaacaataactggatttacaagaaaaattttaagctattaaagagattttgggcatcatacaaatgataaaatagaggggattttggaatctggacagctgctagagatgtgaaaggaaatgagatatcatgagtgtgtcagatttcacgtattcattgagaggcatgaaatacatttttggtgagctgcacatttgtccatgctttgcttttctttttctttctttcttttttttttttttaattgagacagtctcattctgttgcccaggctggagtacagtggagtgatcttggctcactgcaacctctgcttcccgggttcaagcaattctcatgcctcagcctcctgagtagctgggactacaggtgcacgccaccacgcccacctaattctttgtagttttagtacagacggggtttcaccatgttggccaggctagtctcaaactcctgacctcaggtgatccacccaccttggcctcccaaagtgctgggattacaggcataagacaccatgcccagcctgtccatgcattttcaaaccaagggtcattgaattatgcctggtgtctacactgtatttgagacttcaactaaaaatcttatcttttaaaatatggagtaagagggagaacagcaaacacaatgaatggcttactcaacttctcttcaacttcattttgatagtgtatgtattgttttgaagatatttttccttttttgtgttggttttaataaaaagtgtttaactgtgtacattgggatcaataatatcttatttataaaaattagacatctctattacagattcttgctgtctggcatgtaagaatgatttcaggatctttatcaggccagttgtgaagaccttcatagccattatttttcatctaacatttaaaaaattgttattagcctgtaatcccagcactttgggaggccgaggcgggcggatcacgaggtcaggagatcgagaccatcccggctaaaatggtgaaaccccgtctctactaaaaatacaaaaaattagccgggcgtggtggcgggcgcctgtagtcccagctacttgggaggctgaggcaggagaacggcgggaacccgggaggcggagcttgcagtgagccgagatcgcgccactgcactccagcctgggcgacagagcgagactccgtctcaaaaaaaaaaaaaaaaaaaaaaaaaaaaaaaaaaaattgttattagtggccaggtgcgatggctgatgcctgtaatcccagcactttgggaggccgaggcgggcagaacacgaggtcaggaaatcgagaccatcctggccaacatggtgaaaccccgtctctactaaaatacaaaaacctagccaggcatggtggtgcatgccagctactcgggaggctggggcaagggaatcgcttgaacccgggaggcagagattgcagtgagttgagatcaagccactgcactccagcctggtgacagagtgagattccatctcaaaaaaacaaaaaaaaatgtttttagcattatattaatgcgtttatgtatttatttacatattacatagtaatacaattaactattttggtcttcttaatatagcactttgtcgtaacattacgtcaatgactaaaacaggttttggaaagaattagcattctgctgaggcagacttgactgcagactgagaagaataacgtatataaaattactactaaatgccttcctagggtcaaaataatgacagatgttaaaaatgcatgccagtgtaaaattctcagattaatttccagaaaattaagtaaacactatagctgcatataaatctttggaactgttcttattgacctttcatctgtctttgctgatatctccaaattgacactacttgccatggtctctaaattgtataaatgcaatttggcttgaatgagcatgggaaatccccaccaagttgcaagttagggaaatgtgtcaaaatatttcataagtaaaaggactatgaaagctggtccactgagggatcctaatggagctccggccaacctcctccccagtaagatggccagggcagtgtgcccacaggactccaagtgttctgaagtgcctgcagtatatctgggggtgtctggcttccttttgtattgagaagtgacattttgcattatgggatgagtaaatcgagcctcaccatagtttggatcagcctatctgaagtaatcagtgtccttatgctacgagtacataaagatgatcagtgcagcccagctattccattgtgcctcaacatgtcattctgttcagagcagagtctctctagaagctcagcctgtctggctgtcactacagctcggcccattgggagatgtacatgaagcatgaacacccacatcttcacccagttgaaatgcatccaaatggaggccattttctaggccaggggttgtcagctccctgggtggcaaaccggtacacatagcaggaggtgagcaggaataaggaagcattcctgcctgaactctgcctcctgtcagattggaggtgggattacattctcataggagcgcgaaccctattgtgaactgtgcatgtgagggacctaggctgtgtgttccttatgagaatcaaatgcctgatgatctgagtgaaatagtttcatcctgaaaccatcctccacccccttcatggaaaaattgtctttcacaaaactggtccctggagccaaaaggttggggaccaatggtctaggtgacatcaaagtgagacagtgggaaccactgtctcagcaacagccctctgacttgtggatgcttccaaagagccttcactttgtgtaaagggtcatcttcccttccctttccccacatggcctctactcctgccctgcaaatcctatctatgatggtccatgacctgggaagatgggagagggaaccccaggagagatccccactatccaactccaaggacgtctgacgtttgtggaacactaagattatgaaagagaaacaacactgcagtgaggaccgctgattctggggcaaataaaaataatgaagtgagaaatgaagaaccttgaacaattctaattccttaagagatgtgagaacatacattaccataaaataggtagaggttgcaatgaggaaggactcatcagagactaagaaacaactcttggaaattaaaataaggctgtcaggtaactacccatgaagctgaattccacactagtcagctggaaaaaaaaattttttttaaagtacagaaaatttcacagaatacaaaataaaaaggcaaacagataatatgaaacaaacggtaagagaaatggaggctagacccagatggtccaataaatatctaatacaggtgtttgaaggacagacctgtggcagctgaagagcctttcttctccaataattaaaacataagtcctgggattcagtctcactggactaacttgaattgtaaccctatccttgaagcaattactgtaccagaaatatggagaaaacatgaaagtgatatattgattttcaaatgttaagatggcttaaagacagaacaaatacgtaaaaatttatggatctgaatgcaaatgttatcagtcttgcctatgtaaatataaagttgcagtttacataagatgagaaaaagaactacataagatatgtgtagagaataggttcctaaaattgaagcttcaagtgatgcttaaaattgtcaaaaacagaaaaccatttatgtaccttatttaaaggtactataatattaactgaagaactaaaataactttccttaatttaagaagagggactgtcaagctaaatccctcctcttatgtagaagagaatcaacagttagtacctaaagctgataaactgaagaagtatgttatttacaattacagtagggaacaccagcagaatttaaaagagaaattattacaagttctctctggagagttggatttggtttcaaaatggattgaggggattctattagcttttatttcatacccttctctatttttaaaaaaacaatttgcatgtagtcagccctctgtatctgtgggctccacatccatggattcaaccaaccgtggacagaaaatattcagagggaaaaaaattgaatctgtaccgaatatgtacagatgtttttccttcttgttatttcctaaacgacacagcataacaactatttatgtagcatttacattgtattaggtattataagtaatctagaaataaagtataaaaagggtgtgcatgggttatatgcaaatattacaccattttctatatcagggacttgagcatcccaggattttggtgtccctaggtgtcctggaaccagtcctccatggatacctagggacaattgtattattttgtgatacaaatgtgtgcataaatacatgagtaaaatatgtaattataaagctagaaaactttagattatcttagaatagtatctgtaaacatttaaatgatattactatgtatatacataaaacattgcgtgagcttgggaaatatacatatttttgcacttgtaagaactgttaagaggtggaaaatatttttctattctagcagttgacagtttctttctgtaaagggccagacagtaaatatttagggcttcgtgatcataaggaacaattcagggcattatgtatgtacatatataaccagggaaaaaaatcccacaatttgtattgtcaaaatttagaatatgataaaaattgactatgattttgtcataatacaaatttactaatgagaagaacaaaaaccttttttgaggggaaaggtgataatattttgtttagttgcggttcaaagtgagtgttctctcttgtcaacccagttttaacattcatctgtaaagacagactcatttgtgggccgtaaaaaaaaacacacgtgctggaccggattttgttcatgggctacatgtagttcgccgactgccgctctatttagtctgctcccatttagctggaatccagacttaggatttctcagctctctgttgtgaatcgccaggtttcttctcagtttgttgcagaatcaatactctgttaaacaaaataaaaactgagttactataaaaatgaaatttaaaaaaaaagcagacatacaaaatatagcccccaacatttaattattagaattaataaacaaaattatcctgctaaattactacaaaagtttctgaacacttacattttcaatttccatatttatatagtggcaaaaagataataaagagctttgcagcctgatcccaaatagttccttcatctttttggacttttaaaaaatatattttctaactgcattgtagtataatttctaacatatatggcattgccaaaacttggaatgtgcttttctgcatcattagtgacttctgacttctccgattggaacacacgtatgtttgtttcctttgcaggcctaattggcaagactgcagataccctagaggaattgaggaaaggtggataaagcaactgattgctttttttcaggaccctttagtctatttcctttgtgaattcgttcatttggaggacaaccttagaatgagcattagttaccagattgagccatcaactatcttccgagagacaaactataatttcctgaatttattacccaatattttataccacttgtcttgcagtattttgctgttataagatgcatttattactgatgatttccatctactaaggcgtaagtcaaaccagcattccattttgtcactcttctgcatttcatatttagccaacttagagttcgatggaatagaaatacgctctatcgaaattactcaattactgtattcaaaagtttccacaaatgctgtaggtactaagagaatatttatgtaaattcacattttccaaccatgctcatctatgttagtttaaaatgcaagagttaaatttttcattttgtggtgatactattcccaagtgcattatgttcattgctttgaagaagcatctattacatcttaaaacacacttgccatcattttctttctttgtaagaatgaaaacactttagagctacagcagactcttaattaacttaagaaaaagatgaaaaaaaaagccttgcttcctttctctgtctctgtcaggctgcaggaggactacattcttgagtaggaaatgaaagatttacgacatttttgagactacaatttttaatgagatgcacattccttttctcatgtaagccttgtctcagggggtctcggagcagagagggaagggtttttttgtctgcgtctcctgatggtcctcactggatacgttttgtggagtgttcttctgtttaagaattattttctttcatatcgttttccccattaaacacatatcttatggcatatttgttttgtgccatacaaaggaaacgaaaacgctaagtcctgtttatagcaaccgtttacctgagtatctggaatctatacagtgcacgattttctccaaattacttgtatgtttctattctttaaaataaagaataaggtaattataaaacagtattctgatgtgtaacttccaagatcctaatttctctcatacatattgctactaatggcctgacaaaaaagaaaatatacttcatatacttttctttacttcagtcgcattaaacctaaactgtgtaaaattgatccttcttgaatacagagttggagctcaaccattgttgtatgttctcatgtcactgttagaaaaacaaaaaggtgcttttaagatcaaagaacaacacaaacccagaatacacagtcatggtttgaaaacatagttttagaaatgcacattttgatcttaaaagatcaatgaaggaaagggtttgtgtactagactctgccacaaatgagtacctatattttgcatgtgacatgctgaatgtaatcatatcaacactagtgaatgaatatcagggtatgccacaaacaacagctcattctgattaactggctcatatgctgttttcagtcttcctcttgggagaaaagtatctcatatcaacaaagttgatgtttctacaactaatgtaattccaagctactctacatagcctaacatagagcaaccatgaggttttaaagcatttttcttatagaatattaggactcacaaatacacttctaaatctgcttcaaaataccttgagttcttatcaacactgacactaagttatcccaggtatccatattataaataagcagataagaataatttcatatttttgcaataaaaggatgctatgtagctcatactgcataaaattttcaaaaatataaatttttggctccacggccttcatttcaagcatcttctaaatgtgtgccatttctgcaatcagggagatggcggctggacagcaatctgaaggtgctgattagaggtgttcagggatgaacccaatcaaaacagttaagggcaggaacctgccagttccagggagtttcacactgaatggaaaatactgagtaatcagaatttcaagcagtggccaatgacacagaaaactcataaacattctaaaataaaaatgttgcaggaatgccacctaaagttttaaaaatctttaacaataataataatagttaacatagatgaagtgcttactatgtgcgagggactcttctaaacatttttacatcatttgattcttacagcatttctgtaagtatattattatccccattttaaaatggggaaataaaaacacaaagaagtcaatatcttgcccaagattacacagcacagaaattctgtaaataagattttaactctgatagtttggtctagagcctgggctcttaaccactaggtataatggtaagcaaacattggtgaaaaaaaagtccttatctaaaactatgaaaattaatgttaacatcatcaccaccaccatcatttaaatattggatatgcttgggtttaaagcacaatttagttctgctacttaggagctccatcgttaacatgtttcttaacctctgtaaaatggtacaatagctgtctttcagggttactgcgagattgttatgaatgtatgtaaaccaccgacacaacctcctggcacatcgcagttgctccaaaaggggtatttttattataagtatgataacggaagtgatacatgcatgctgcttacattaactgcttaccagatgattaagcagatatgtctgaatatgaatacaaaatataaatcccacaccagcaaacgtctcaataaaacatttcaaaaaatgtattgggtcatgaaaatgaacttcctagatgtagtgttttacggttgtgtatcacatacgtataacttagggcataaggagaagtctcggcccagacttcacagcctcagttttgaaaaaagggtgtccatggtaggtgtttgatacgtgcttggggctgatgtttatgctgagtttcaatgatcattctcccacattaacgggtttggctgaaaatatcaatatgcaagtagcagatgtgtatagcaactcaaaatgtttatatagcatgaaactcatctatgcaagacagagactttgctggtatactctccaaagcttgaaagtagaggccatttagccgtaaggcaacggtcccaatctgctggtccctaacaccaccccttaagggttcccccaacctacagtcgcaccaagtactatttgcaaactaatcacaagctgctattctgattaatagactacaaattaactcggatggattgttaaggtcatagtagcatgtgtgtgtgtgtgtgtgtgtgtgtacagaagattttctttctctggggtaaatgcccaagaatgtgactgccgagtcatagggtaagtgcatttttaaagatttaaaatgaaatatacttgatttttagagcagttttagagcaagtgaagaaagtgcatatataccctctccctccacacatgcacagcttcccccactaccaacgtcctgaaccagagcagaacatgttagaatccacgaacctacttggacacaccattattccccaaagtgtctgtggtatacattaaggttcgctcttggtgttgtatattctacaggttttgacaaatgtataaagatacatactcaccattttagtaccatccagcaattttcattgccctaaacatctactgtgttctgtctcctcatccctcccttctaccccaattcatggcactcactgatctttttctgcctttttcagaagatcatatagttgcaatcacacagtatgtagccttttcagagtggcttctttcactaaataatatttatttcaggatcctccatgtttgtcttccttgatagttcagttccctttgttgaggaatatgagtccattgtccaaagtggcacagtttttttatatagtcacctgctgaggggcatcttgcttgcttccaagtttgggcaattatgaataaagctgctgtaagcatcacgttttggtttttgtgtggatgtaagttttaacgcatttggttaactatcaaagagtgcaattgctgaatcctatgataagaggatgtttaatttttaaagaaactgccaaactgtcttccaaagtgggcgtagcatgttgccttcccaccagcaatgaatgcgaattcctgttgctcctcagcagcatctggtgttcatattgtagactttggccatcttaataagtgtgtagtgatatttcattgctgtttgaccacagtagcttttcatcatgatatagtatctcagtaaaaacacagaaaaagtataattactttatcataaggggaaactcaaaattttgttggaaagagggactctcatattcaaagaggtaagggatcactaagtaaaaggatcctgatgagaaaattgtacatttcaaagtacttgtgcaaaaatgtccccttttactttctggccacacaccattcctttacctgaaactctggtgcagcctcccagttcatgctgtgcctcctatttcttcccaattttatattccctcaaagcacataagggaaaatttctctttctctttctcaagagaaattctctaaaactgtgctccatgagatcctggtattatgcaagatgtcgttaaaggctctatgaaacaaagttccatctgtttaatataactcgttacacttctccttctctccatgcatggagatacacaatatttaatggcccattaaagggtttgagaagtattagaattaaaacaattaataaagtagcattccaaactatattcacatgtcaggggccccatgggtaggcggtggaggagagagattcagcagaattttttttcaggcagcaccataattacctagaaaacatcatgattagaagaagtcatgtgtctaagactgtcctttctgaaacaagggagcaatttctactttaaagatttttaaagggtgagagtggctgggcacagtggctcaggcttttaatcccaacactttgggaggctgaagtgagcagatcacctgaggtcaggagttcaagaccagcttggtcaacatggtgaaaccccctctctacaaaaaatacaaaaattagccaggcgtggtggcaggcacctgtaatccccgctgctcgggaggctgaggtgggacaatcacttgaacctgggaggcagaggttgcagtgagctgagatcacaccattgtactccagcctgggtgataaagcaagactccatctcaaaataaataaaattaaaaataaataaataattaaaactgtgagagaaaatatagtggagatatggataaagaagtcagaggagtatgcagcacatcacccttccttagaccatcagtaaaagtctgcaagatgaggaaagtggatggtactggatttcctatataaaacagtgacggacggaccagcacacaaggtggccacatggacaagggatagtctgcatggacaaggcacagaaggccgttgtgggccctggactcctgtcaatgagatcactcagctctccctaccagccagaattctgcccactcgagttaacccaagaagctcaactccagatacctgaaaccctttagaacatcatatgataagatgtaaacagtgtaccctctcatttctgatggcttaaactaactatgcattcattaggtataactataaattcattagctttttccacttaaacctggccaggccacatggaatctttgatcttgagccatacttttctccagacagagactgataaatgactttttctggtagttagaactgaatctttattcattgtttcagtatcttcactcttttatgctcctttataaaatactataagaaaaatagacatcttcattaaatagaattctttaaaaattgcctttcatggtatttgctaaattttatttgcttataatagatgatgctcaacacaaggccagctgttgatggtgtgttattacgtaaaacttgtaaacaaggaagcaaggaagtaaactgtttggtccataggcatgggtccacagaatatctaccccagaatcaacacaagtgggttctcaacatgctgattcctaaggctgccctggacctattaatcctgaggacctgggacgtggccaagcaatctgaaagttaatggtctctgaaccactgggttggatcttcatagacagcaaacctggcccaaagaattactcagagtacaaagagaacacaaaaggatgaagaaaaagtagttggaattttgcaatttaggggctgtaaggggccttaaaagatcatctagctcaaccctatgtctttatagtagagaaaaatatgttatttaacccagatcaccaagttgaatcagttgacattctttcccatctaaaatgtcgttagtctagaaattgaagaaatgaagaaaatctgaaagaatggaaaaggaaagaaacatatatctggaagaagtcaactaaccagtttcagagaaatgttctaattgttcaagatgtactcaacttgaatctgtgatcttttctaaagacatttttttaaccttaagatttgcttttcagtattagtattgcttgagacaatagaagctaaatatttgtggaaatctacatcatgaacaggtactcgcttgggcagcaaattacagagtaagtaatcattttctaatttcaaggttcctattcttttagtcatttaaaattcagacttcaagccaatctatgaatgccaggtttctgttaattacaaacaattcatcttaattagcctgaaagatggttctaacaagaaataaattattgagcacaaaaagcaagttttatgacatgtttaatgttcatttcaaatccctttcaaaacaaatagcagtggagaacgtggagggttagaaagataacttttgttgctggattgatttcaaatcttccctggctgcttgcaggtgtagcactgttcacttgaaaatttattgtaacagatcacaatcattacaatcatgatggtaatcaatgttcattaaagatacaatgaaaattccatgattaaaggccatttgtttcatcacaataagatcatttatttattattgggtaaattgttacaaattgcatatgtttggggcagttgaaacagggaacatgaatttggggattgaggccgtgagtgccttttacttggtgaaattctgacaattcaaagagaagactgcatgtggcccgtgaaagaaagacaggctgtgcttttactcaccacaattctacactgtgatctgatggtcattattcctcccaactcggctcttcatttttctaaattagacaatgctgaacatatcctggtgcctttgcgctgtgttataaatggttttaagcagcatggaagttgcactgttctttatttaattccatcagcactcttagctagtctactatgtaaaaagagagttgaagacattatatgggcttcttctctttatttttgttttcgttttaaaaccaaagcaaacatctcagatcaattcaaaaggaatgagcaggaaaccctcaccaagatggaaagtgctaacatttcacatgaaaagaagttttttccctgaattatgctccctgtttaaccatctaactcagattaacactatcttacttgacagccaccagcaagattcacctacccctgccattcaaattccaaacagtcagtacaaacaaattttttttaaagacgaattcaactgttctagtgtaaagctgttttgggctcatctgcaggccaaacacattggctcagagaaacctgtttgctgtcagacaaaggctgttgctgtcattaagagttgttcttagagggtggccaatcagacacggtgagtcaggtggtcccaaggaaagagaaagaaaatgccacccacccactctgcgaaggctccactggaaaggttccatatgatctggctgtcattgcccttgaattagggctacgggaacaatttgccttacgattcactgagcaggaaagggtcctcgtgttcccttgtgtacagagggtgcacatttccctaaactctcctacttggaagatggacaattgccgaggaatactaaatatggccagcaaattttgtccccaagaaatctgagtgatctctgaggtcaggcaagaatgtgatagcaatttagaattgggcggggtagacaattaaaattagtcatgaggaaacatgcaaaaaacttttgccttctctgacttccgatcccacgaagctgacttcatgttgctaaatattccgattacaagtgaaaaactcagacatatgaaaattctgtttatgagaaccaaaatctacaaagaacacatttttccccaagacactaaatttatgaggtctcaagtttattagtcagtccttagttcctatttgaggttcctattttgagccctcaacaagagctaagaggttatgccttgattaagaatcaatcagaactggagttttactcaatgatatacttaactccttacttaacctgacttagcacaattaattatataagccacaatttcctactccttaaaatgaaagaaatagtaatatctgtgccatggaaatagtaatagaattaaatgatacgatgtatggacacatcctatatggcacatgcttaacaatcaatgaaagctacttacaacaacaacaaacaaacaaacaaacaaacaaaaaacctagggccaggcacagtgactcacacctgtaattcaagcactttggaaggccaagatagaaggattgctggaggccagggtttccgtgagctacgatcgcactgctacactccaaagatctctttttagcctaggagttaataattaatttcatcattatttattgttctatttgatgtaaccacatacagaaactggaaaacagaaaaaagaagattttcttagacacacagaccgatggaacagaaaagagaactcagaaataagactgcacacctacaaccatctgatcttcgacaaacctgacaaaaaaaaaaagcaatgggaaaagggctccctatataataaatggtgctgggagagctggctagccatatgcagaaaattgaaactggaacccttccttacgacatacacaaaaattaactcaagatgaattaaagacttaaatgtaaaacccaaaacaataaaaaccctagaataaaatctaggcaataccattcaggacatagaggtatggggaaagatttcatgaagaaaataccaaaagcaattgcaacaaaagcaaaaattgacaaatgggatctaattaaactaaaaagcttctgcacagcaaaagaaactgtcatcagagtgaagagacaacctacagaatgggagaaaattttttgcaatctatccatctgacaaaggtctaatatcaagagtctacaaggaacttaacaaatttacaagaaaaaaataaatatccccattaaaaagtgggcaaaggacatgaacagtcacttctcaatagaagacatacatgtggccaacaaacatgaaaaaaagctcaacatcactgatcatcaaggaaaaaccacgatgagataacatctcacgcccgtcagaatgagtggcattattattaaaaagtcaaaaaacaacagattctggcaaggttgtggagaaaaagggatgcttttacactgtaaatgggagtgcaaatatttcaaccattgtggaagacagtgtggcaattcctcaaagacctggaggtggaaataccatttgactcagcaatcctactactggatatatactcaaagggatataaatcattctattataaagatacatgcacatgtatgttcactgcagcactattcacaatagcaaagacgtggaatcaacctaaatgtccatcagtgatagacaagataaagaaaatatggcacacatacaccatggaatactatgcagccatacaaaggaatgagattatgtcctttgcagggacatggatggagttggaagcagtatcctcagcaaactaatgcaggaacagaaaaccaaacaccacatgcaatcattcataagtgggaggtgaatgatgagaacacatggacacatgggggaaggacacacactggggcctgtggaggggtgcagggagagggagagcatcaggaagaatagatagtggatgctgggcttaatatctaggagatgggatgatctgggcagcaaaccaccatgacacatgtttacccatgtaacaaacctgcacatcctacacatgtacccctgaacttaaaataaaagttgaagaaaaaaaaaagagatgctcccaattgcaagatcctaacaacttctgttagcattttggtataattttcccagcattttttcctggctgcatttttttacattctctctctcgcatatgtgtgtgtgtgtgtgtatatatatatatatatatatatgtatatatatatgtgtgtgtatatatatatgtatatatatataaaacctatatatagtccatatatagagatatatatgagctgtctttccaacatttcttatagctttaatcatgaagtaaatcaatgtcataataaattttggccctaattatctgccattgtttatttgccttttttcaaagtcaattagaaaaagagagaacattattaagtatttattaagttaaagctccttaatattaaaaagattaatataggagaagatatgaggatctaagcctaaaccttaactggcatgaaaaaaaaatgactttatccgatgctactttgtttcatttaacacagtacactcatgtaggatgttctcttctttccctctcaacagaggcatgtggcactctaagctccacattgctgagttatctttaacttaggtttttctacgagaagaaatatgtgactgcatgcaatacaagtacctgcagagatttagtttagccttgggacaaaaattcataatggctaatttaaagcacaaaggtgacgccaccttgctggaatgaatttagagttgtaacagttgtaaagcatcagtcctgtagtctggatactcggggttgttgctactttctgtttgatttggactcaccatgatgtaactctggcaccactgagaccacgcctggaaaatgcatattcatttgatgccatatataatcaaccaaatatacattgtgtccttattttgatctagtcaccagtgatacaacaataaacaggaccagtctctgacctcaaagaattcatctagtcattctactgagctgatgtgtgccaagattgagttacaatcagcctagaacagtagcaaccatagacacttccagggtgtcaggctgattccccatcttctaaaatgcagtacatttcttgaataaattggccacccaaggcagacatgtgcctcttcactcatctaattcagttcatccatccatgactttagaattgttcaaaaattgcccagcttcctaataccaacaaatattgatacttccctgttttattttagatcacatggtatcttttccctaaatgtattaggtatatttgttaaatagcagactaccaatctggggagcaactgaaatcagaaacatagtgaaagtacccaagatgtatatatgggaataataatattggtgattactacaaggaattcttgtgagaattgaatggaaaattatatacatatatatatttatatatgtaatttttaacttaatcttggcccacatcacatagaaatagtagtagcagatattgtcttcatcatcatcaagataataaaaccatttcagcccctttggaaaataatttggcatttccgcaaaatgttgtgcataaacctaccatatcaccaagcaattccactcctaagtatctgtccaagagaaaagaaacatctatctacataaagacttgcacatcattgtttataacagcattattcataaaagccaggacctgaaaacaacttgaccacccctcagttggcgaatggataaaaatatggtctattcatatgatgaaatagcattggataataaaaaggaatgaactgctggcacatgctacatcatggatgaacctcaaaaacattgccctaagtgaaagaagccagtcacaaaagaccacagactgtggattccatttttaatgatcaatactagattagtagttgcctggggattaaagtgtgaaaaagaattaactgtaaataggcagtagggattttagatggggcatgaaaaaatgctccgagatcgatttatggtgatattcctatcatgccacagagttacaaaacagtcattgaattgtatacctgcaatggctgaactcttatgatatgcaaaacagacctcaataaagttcttacaaggaagataacagaaccaagttctaagtacaccaattatccagttgcctcctttgtatctttcatatatttagagaatctatgtccactaaaatcgcatttatccagttaaagatgagattaagaaattgtgttttcctgttgatagcctgaaccttaacagtataggtaatataggacttaacgtgatttttagattcggaatgatatattcatttgtgaaccgttttctggatcacataaaactttattccaaacataaactgtagcacaaatgacacagtccttcttcacacagatacacacacacacacacacacacacacagccatcagtacgagcagaatggggcataacctttcattcctcacataacatctccacatgatcctcctgccccattaagaagacggcccaaaccaagtacctcaaatccagtgtcccaagaactgtttttagtgtttgaggttgtgtacctgtctttacttgttcccaaattattctaattctaatcctttcaggtctcattttgatcttcccagctctgatctcccaactctgtgaccccaagcttgatcactaactatagatttatggctttgaattgatctctctctctctctctctgcacagtttgtctcctgtgtgtctgtctctgggagaaaccctctgctctagccatgtgaaaacaaattctgaaccaggccttctgactctgtcctcatccctccctcaccatctcctaaacccttcgaagaggaagccatctttttcttttccacatacagagccttttatctgtacatctattatgaaatttaatactttctactatatattaaatatagttatttatgtagttgttgtaacctcaattgtttcatctttacttaatatctttcaaagcatggaatacagagctttgctctcaagaaagtatattttccgaagtgtcccgatagattgaaatatctgttaagtttaagtgaaagggttggttctgctacagtttatttcagttatcagtatagcacgcactgatgcctgagttactgctggaaaatactaccttcctgtcttcttaaggcattgcaaaaggtatggggaaagatcctgaatttgccccaatttttaaacaaaccagagaaacagtaaagcatttaaatgacttattaatgttaacctatttatatctacatatttgttagcctgtgagtaaatggaacttcggatctttgcaaaagaactgccgggttgtaaaaaggattggaaagtcaggctcacttagtagtgtgcagagaaacagactctatgcctggagcaaaaaatcccagcatcccctccacctctacggtgtgatttcttaatgctgtacttggctcgacaaaggaagtctgatatttcagaggtgagttgcaaagtggccaaaccactctttaatgcactatagcttgacataatatttgctgccagcttctcgtttaaaaatgccatcagtttaacattaactgaaaaagtaattattctccagtttcacggagctattaagaaaaaaaaagttcattgaaactccaggaaatgaaatactgtgctttcaggacctattggaagcctttcaacattcagagcagaaaaacataaatttattttttaagaagcagatttaggaactttagtgaatgggaacagaaagcattaacttaagcctcaggggagataacgattcaacaaaattctgaaaaccctccttagatcaaactctcacatattctgaaaactcagtaccatttattgttacaagatccttgatgatttagaaacatgtacccacacatgttaagtcctctgtactaaatcaaagaaacttcaaattagcttgaactttgaaatgctgtaagttacatgaatgatgattcatttctttatattcagtcaccaaatgttattgagccgatgataagcttgaagacgttaaaggctttggggtacagaagagagatactaaagtaacagcctgcacatgagatcttgacctgtaatgaagtgccaatttagttgtaaagacagaacatgtcatctataacatctgaggaaaatcttgctgtgtatgcggcataacctcagtttataaaaatttgagaggaaatcacaagaatggagaggttttgcaaggttatggagtttgtacaccatttttttagaacatgaggtctaaaatcagatgcaaatgtgggctccacatcctattttttaggtaactttgaacaagtcacctctttgaacctcagtgaaatgcagctgaaagttctttgaaaactgtaaagattatttattattcagagatgatttctgtgggtataagcagaaaacactactttttgaatgaattacaaacataaaaccatgactttaatgctaacattttttgaaatttttataaaactttctaattcacgttcccctactgttccaaagtcagtaattttaagatacatgatttaaaaaggaaaaaaaaaaacctaactgtcaagaaatatcgctaactagattgatcatgttatttccttatttttataattgaaaaaacccaaaactttaatactaatttctggttgcttaaaaacaaattaaatataaaactgtgtggctgtcatagatgatgatattttaatctattgaaaattattacagtagaaaatttttaaagtctaggaagcaataatcagcaccaaaatattgtttttgctgttgtatgcacagctttagtttccattttatgaataaatacataaaaatatagggtaaaaatatatgtatttaataggattcttacaactttctattagcacaatgagtgcagagcatttgtgaataacatagaactagggtctcccctacagcttttgagttaagtctttttctaacaactgctatttattcagagaggatgcgaagtaacaggtctaaacattacattggcaaaggagtacctttaaattgtatgtggcacaagctaaatctgggaaaggaaatgaaacacaaatgaaagggcaacttcttctggaaacctcccttcctttgtggtatttttgtccttcctccattccatgaatcctattaagaaaaaaatttctcttttgctttctaattcccaaatctttactgcttttctttaacaaggcttccaagaagaatcggaaggtgaaggaagggatggccataaagaagactgttctttagatgagatttttgtcatattgttactgaaacaccaggggtttggtctaggtccccgctgctcccaacacataaggccaacgactagggtgatgagtatcgccaaggaagaagctctaatcaggtgctgcaggccaagagatggcagctcagtctcaaatctatctctgggacctactcaaactaggagtttatatagcaggaaaggattgtaacaacgtgtaagaaaacaggaactagggaggggaaaggaagcaatcatgatgaatgagggatctggcatctcattgtctggatgtgatgatctagtgagtttcagttctttgatactttttttgagaggtctgaagggtcatttcccaaggaaggaactcagataaaacaaatgtaagtttcaagctttaagaccagaaggattggctggtcacagtggcccacggctgggcgtggtggctcatgcctgtaatcccagcactttgggggtccgaggcaggtggatcagaaggtaggagttcaagaccagcctggccaacatagtgaaaccccgtctctactaaaaatacaaaaagtagccaggcgtgatggtgcacaccggtactcaggaggctgatgcaggagaatcgcttaaacccgggaggcggaggtcgtagtgagctgagattgtgccattgcactccagcctgggcaatagagtgagactccatcaaataaaaaaaaaaaccggaacgatcaatttctatatttatccaaacatgattgtctatgggactcctggatcagtttcaggcctccctttctatttatcaattcctcaatcatggggaacctggttgttgatcttcctggctgcttcctgctgaggaggggtgtcatgggcagctccataccatgggtgaccacatggccactcaggaatcaaaggttaatctcatattagagttttgttctgaaacacagtatttctctctccagcccccccacatccaccagagacaaattgttactgaaacaccagtgatttggtctgggtcctgctgctccccagacagaaagccaatcgctgagacaacagtgttgccaaggaagaaggctttaatttggtgatgcagcaggggtttatatagcaggaaagaatgtaacaatgtgtaagaaaacaggaactcgggaggggcaaggaagtgatcctggtgaatgaggggtatggcatctggtgtggtgatctgggttctttgatgctttttgtaagaggcctgaaggtcatttcttgaggaaggaattcagataaaaccaatgtaaggttcaagccttaacagcagaagggcccatttctatgtttatccagaagcaactgtctatgggactcttggggatggtttcaaaatcacagcaggaccaatctacctgcaaaataagcttcagtcccatatactagcctgattactcacacagaatgcaacaagatcattgtctacataggcattcctagacttgctttgctggagcctctgacaaggtcatttcagtcaaagccctgggaaataaccagttcctccaaccgggcggggtcggggggtccattataaaagcaaacatgttgttattatgcaaacaaacacattgccatgagttaagaatattcacaaatagtttacaaattatgaagaaattgagcagagagagaaataggcctcaatttctgtttataaaagtatactctattcggtacacttaaagcatacttaaagcctgtaaatatctcaaaaggaaaaaattattcagactctgaaaaacaaaacaaaaacaaacagcaatatttcaaacataaaaatcataaaagattatctcagtccttattagttcagtctatgcaatcagctcctgttctgcttcatattggattagtggcaatctttatacaacagcctttcaattaggggcctagaagttttctctctaatccaatggcacaatctccaaagttaccagaaacttccattcaagagtcctttttatgaactcttccaaagaagcaatgtttggactgtggctgattgtaagtcactttttgagaaggatcaaagcaaaacaacaattgtggataacaaaaagtcttgagacagccatagttagagacacagttgacaagaaaatttggttatttctgtggcatacaacaacttaataattataattattactgacaacatatatttaaaaataccagaattttaagaatctcatacaatcctggaacacatattatcaccacatttatataaatataacccaaaggaagataaacaccacctcagatttgacaatgcttcctgcataattctaacacaatgaataagcctattatgtctgtcttgcatgtcagggaacctaatatctagaaaagttagtttgaggacaaaaagactgaattcagaacttgaaattttactcctagaaagtttaccaaatatcaaagttttaagacacttaatatcacaaaataggatcacaagtcactataaaatagtccttcatttagccaaagtgataaatcaaaaacatttacgttttgatagagactctgtttcccaaacaaagacctaataaagacagcatgaggccaactgaatctgtctctccccactcccttttctctctgcaatttactcaaaaagtaaacaaaatcttttatctctcaatattacatattttgtttaaaaaaaccaaaattttcctttgaatggtatggtattaatgttaaagctaattttaataaaatattataaacaaatctatctaatttaaccactttgactataaggtacagatttctgtaaactttttttttttttttttgagacagagtctcactctgtcacccaggctggagtgcaatggcaccatctcagctcactgcaacctccaccgcccgggatcaagcaattctctgcctcagcctcccgagtacctgggactacaagcacccgccaccatgcccggctaatttttatatttttggtagagacggggtttcaccatcttggccaggctggtcttgaactcctaacctcgtgatccaccagcctcggcctcccaaagtggtgggactacaggcatgagccactgtgcctggccaatttctataaactttttgtaacctttttccaattttctattaaacagcagatcaatgcttcaagaaaactgttattccaagacatgggtccagacactattcttgtatcaatgagcttttgatattaatgttgtttaatgtatagaaaaactctgaactaatcctatgcctcaaaaatcagccctgacaatctcacatgactacctcttccacaataatccctgggcctagagggattaagtagttttaatttctggcctgtgtctcacgaaacagttccttgtgatcgtcaccttctccagagtctgaagagaaacctttgactgctgtcaatgctcaaaatttagcaggaattggtgccttcttcaacccaagagtcaaagccctgttacttaacagcacaagcgttagttaataggatgtttatactacagaaagtcctatcattccctctaacatgttacaaactaaaacactgtgatttggcatttgcgggttactgcctgcagcgcttcaaaccactgtgttaaagtagttaggttactcattgcataattgctaggattctagtgacagaactgtgaccaaaagcatcaaaacgtgacaggttctatgccaaacttttcaaagtaagacaactaatgtttcttgttgtcattttaaaaaaaatggtaaatgcaaatatcagttttggaaaaaatgtcatttaaaaaatggtaaatgcaaatatcagttttggaaattcagtataagaattaatcatctcctttcacttaaatactatacaacaaaacagggataaagtaaggaaaagcacacagcaatttattttcagctattttaaaagagcatcatcacacttttccaagattggtttctcgatgcagtgccgaccaccaacattttcaaagcagggcaacactggtgcatatcttgtttccaggtacacacatgaaggcccaccagtgataaacagcttaggatcagaaatcactacaaagtctcacatgttttaaatactattattgcttcatccaaatgaatgtcacttaatggtaataatgataaacacaactacaatagtttgaggaaaatcccaatcactataatttccttaaggaaaaggccaatatttcctgaacattaaatttgcatgtgtaacaggttttcctcattaaaagaaaagatctgaaaccaactcaaattattgactgtattgaattaccttggaaataaataccattgaaacatttttactctcacctactttttcaaataataaataatgtactatttctgttcagaagttataaaaaatcttttatgcagtttttttgccaggaaccttaaagctctcatagctctctagatcatcagaggtaaggaaaaccaacaaaattttaaatggctgatgtcctctatcaatttttggaggcttcacaaaggtatattaggaactttagatcaatagaacaaacaatgaattgttggaaatgtatagaaaacaaatgactacttatagaaccagatagtttcaagctttaagaccagaatggtcgatttctacgtttatccaaaaacaactgtctacgggactgttaggtctgttttttggggttttgttgttgttgctgtggttttgtttgtttgtttgttgacggagtctcgctctgttgcccagactagagtgcaatggcgtaatctcggctcactgcaacctccgcctcccgggttcaaacgattctccagcctcagtctcccaagtagctgggactacaggcgtcctccaccacgcctggctaattattgtgtttttagtagagacggggtttcaccatgttggccagactggtctcgaacacctgacatcaggtgatccatgcacctcagcctcccaaagtgcggggattacagacgtgagccaccacgcccagccgggtctgtttcaatcttcctatttgcagcagaattggtaaagtgagttaacagagtagcatcaaaatgatggtagtattgtgactgggacataagatgcatagattcatgatacagtgacaaaatgcagcgttcaaataggatcccccataactctatgctgtaggcatatacaatattgtgactagtccacttataggacatttctgtttccaaagttggcacgaaaaaaaagagacaaaaaacaaagacatgcccagcgaaggtcttgagtgctgggatctagttacaaaggtttgggaagtagattttttaatcttagaggactattcatggctgatactttctcaaatgtgccttagagatgcttccatttgcagcacacattccatagaccgcatcaatcactccattcagtcatccttgtctgtgtccttgtcttgccacgtgtgtctgctattctttccacaataggtgactctgggtccaggattcagacttgctttagccaataggatgaggtgagatgacagtatgggcttcacaaggttcacagtacctctgcttgcccttctgtgtctcggcctcagccatttttgggggtctcaggaggaagataaaagacaagtgggacagagccacacccaaggaccccaacccaacccagacggcttacactcggctggtgacatgcgtgagttggtgcaattaagactgcaacttctgatcctgtcctgcctggatccatccaccctgggaacttgtaagaaatagtgagtgattatagtttgaagtcattgagtttggtgtgcatgtgcctgtgcatttggggtggggggaggcaacaggtaataataaaggtaactaatctcaaaattgtggccttttctatttccaggacctctgtagaaatcatgtttttagtatgtacagactgaatgctaaacttttgtctccaaagagtaaatactgtccacaggggaggtctacagaaaagaagtaaatatatgagtcataatcagtctcaagatatagtacacatgtcactgaataaactgatgaaccaaatggctgaagaggaaaatttttaatgctctgcttcacactaataaaaacacagtaggctcaatttccatattctctgaaataatataaatgattttgcaatgatatatttacttacatttattctgctcattgaaatatttcctttaaggaaaaatacttggaatccaacaaatttcttcactcagtatcttcagcacatattcatacaggtaaataagcaaacaatttttatttaatatttaaagtatcaactaaaactatctgaaaattatcaagaatgtaaatgactatagagcagttaatttttttttaagaaaacttactgtcaacttgtctttcctttgatgggtgggataaaaggagtaagttacaatttcttccttcatctctgcctctttcaatgtcccttcctttatgctcatgtcagtctctctttaaccaaacttgtaagctaagtctggcaagacacatagcatttttcaagaagtcaataaacatttagccctctgaggagacatcaaagaagcaaattaaatttgttacaacgacttgatccgtgttcttttggtctaatgatttaagccccaaatccaaaagttaaaagaaagcagaattagttttaaatcactttgcacttaatctctctttgcctcttctctccccacagtactcattttttttacctagaatattctttcttaaatatactaggatacaaactctaatatacacagggaaatttgagcctttagtgcccaacagtgctcctcacagcacttagcatggggatttgtgacaggtgctcactctgctataaaccaatgttgtctgatacaccaattgacctagcatgaccattcatattgaaaatctttgtgttatcaaggttaatcttttcctattcacaaattccttgaaaacatgatacatagtgtcaaatattgccaaaattgtgaggtgttgtatctaaaactgcagcctttattttttaaggtgttataatagtaaaattccaggaagaaatatgccaagattgatggaaatactattgtgtttcacaaacaaatctcaatgtatttatatgtacgagtagtcttcaactttacaacaacagaaaaattaaataagaactctaacaaaaatttgtttttctttttgaatgttgaccaatttgtgattttaaaatttttacttgtgtctctgttaagtctttgagactatccattttgcttttctgatcttaagttctttccaaaaacacagaaactctccaagctgtcagtgtcccagatggaaccaaagttgtagtttgcactggacattaaatgccgaacttgaaattaatcagatctctacttgagtaaaatgaaagctatccaacgaaaaagcaccaaaatattgtacctacacagccaggaaaacatcaaaggccttcaaaaagctaatatatctagtgttgacaacctagtaccacacaagaactatgggaatgccaaggttacaatgtactaaaagcgcctccatgaagagatgaaatggtcaaatgtccaggactctttgagaaaataggggtaaatagctaaagaatattgaagttgctccaataatcaccaatatgtttcttctggtttttcttccccaactagaattaaaaattgtgtatgctccaattttatgcttgaaatataaaagaatcaaaattttgaataacacacaagtagatgtttttatttactttttaattttatggatacatagtaggtataaatatttatggggtacatgagatattttgacataggcatgcaatgcataataatgacataagagtaaatggtttcaatttagaaagatatttttgctggatacagaattctaggttgggagggacttttgctcttgttgctttttggcacagtcttgctttcattatttgtgataaaaagttagcaggatttctcatttttgtttctctttatctctgactgcatttaagagtttctcttaatgtattttcaacaatcttattataatgtgccttgatatgtttttcttagtgtttctcatgcttagggtttgtcaagatttttgatctacaggtatatttttattagaaaggggatcatgagttaaccagacatgagccatgcttgggaagctgttactgctcctgcggctacagacacaatggaaagaggtaaggtttccacatggacaatcacggcgggtttcctgacagaagcagggttcactgaaggtgggtgactgggagaaatactttggtttttccatacctgttcttccctaatcttctgtcagtacctcctatagtcagaatttaccctgtgatgaatagcagagcatgtgaaggctggaaacggagctcagagaaaatcagcagctgcccctcacaaaagcaacgtattctgatttcttcactgttggattcatgccatctggaagaacaactgggcatatatttgttgaatgaatgaatgaaatataactaaactcatgttttattattgagaaaattgaagctcctgcgggcttcacaatttactcaggtggttaagaactaggacttaaatttaggctatttcatattttaacatagcaatcacctctgacttctgtaaattgaatcatattttaaatccatatgagaactttctttccaaagacactctgtattgcgttttttgcaaaactgaaaatcctttatcacctttttaggtagatttttcaaatttcagtttctcttcaagctttctggactatttctttcgctgggaggttttacataacaactctattttaaaagaacagagcatttcaaaagggttatcattttggtaaaagagtcagcataatgtgaaagaaagagcatggtttttgataccagatagtactacattctgatctaggatttgcaagtaatagcaattagacattagagaaaacacttaactttcctggtccttgattccttattctgtgaactggggataataataccttctctaatcatgtcacagaactgtaagaatgaaattagatgatgcgtatgttatgcaaatacatttcttactattgcttagctgtgagtcaccttctctccagattagcttttattactgatactcattgtggacatagagtccagctgatagctggatgggtgggtatggctgaagcagaagcatagaatgtaagagacctgcaatagagacttcattgtctgatgagatctagtgagaacagcaacactcatagcaggtaaaagtgctgcaaaaagttggtaggaggcagtaagaaagtaactgagatgaatctacttattttgcatttcctatgctaatggtcatcttcattaataaagacaatccagtcactttaaaccagaggctggcatcacagtaaaaagggaccatttccattcttccagtatctatccttggcacttaaatccacgtgattttttaacagctttattgagatgtaattcacagaacacacaattcacccatttaagaacacagttcaatggcttttactgtatacacagagttatgcatctattgccatgatcaattttagaatcttttcactacccccaaaaggacctctcttgggtcccttagccattaccccttgagaaattcccccagccctggggagcccctcatttactttctgtctctatagacttgcttgttctggacgtattcacatgaatggaattatacaatatgtagtgttttgtagctggcctatttcgcttaacataatgtatttgaggttcaccatgttgtaacatgtatcagtactttatttctttttatagctacataatatttgctatatattttttcaagcattccacttcactgttatttgtttttccacttaatttacctgttctgatcatatgtaagatcaaaggagtccttgggtgttatgaattcaaccactgtttaatcttgaagagagaaagtctaaattgtcagagggtcctgagtcaaacactttcctgtgtgcaggaggacacggggccaggccctgccctctgactgtgcaccactggcttcctctaacaccgactccaaaatggtagaaattctcctccagataacatttaatcattataaaatgcttccttatcaaggaactcataatctgatcccaaatttgtattggtaaataggtaaaagagaactatatatttgaagcataaaatataattactggccaaaattctccagataattttaaaatagacatatcttacaatgagccccccagattgccttttaaaatgataatgtaaaatgtttgcctggtctcactgattacttggtaaattctgaatatgatgactttctgttcttacaatccataaacgcaacagctataaaagccacaagagtcttgatgacaatgaagaagcatttctgtgctgacaaagtcattctgctttagaactgtggatactataagccaacataagtcttctcttttcctccccatagcatgtcataaactttctgagaccatttgtaccaacgagacccagagcatgcatttatatgcaattgctgacgtttaaaatgcgataatttaataccagtactaacagaagctgcagaatcaagtgctattggtcctgctatttacactaaaatgggtaaccccagtgtgagtgacggcgaagtcctttcaaacccagaggttaaaatcttacttcctttcttacactccttttcatctttgcttcggtgtaaaatctgcatgacttattatgccattgttgaactgctctctgacctcattaacattcttatctcccagaaaaaaaaaaaatgttacaagagacctgtctggttattatctctgccacctaagacttaaagcttcactataatttccaaatacatctaccttgaaatatctaagcttacgtgtctcagctacttccccaagtatgctgaattctaacggtagagattcactaaacctattttctttttcacacttcataatccctggtacaggaaatggctcaaagcactaaatttgatttgtttttcaaaaaacaacaaagccataaaattctagaacagtaacactcaatcttaggatatacaacaggatacagctacagataagagctcttggtttattccggtgtttcaataggtatgaaattgatttttgcaaatagaaaattggcagattataattttacttgtggaacatttagcatattaattatgagtttgaaaattgcattttcgaatgatagtgagggcagcataagaactgtgaaaggataaaaggcatatctcgaaaaaattttaagacatataagtaagtatatcttcaataataatttaatgattgaaataatattacttattactgttttaggagcacttgatgtttctagtaacaccctggcagttctgtgctccttcccagatctttccatttctaccccaacttaaagaaaataacattacagctgaaatcaaagagaatttaagcatcatttggtttgagaattatctttctcactgggtggttgtcagacaacctaaacgcttggcttctttttttttttttctttgagacggagtctcgctctgtcgcccaggctggagtgcaggggtgcgatctcggctcactgcaaactccacctcccgggttcccgccattctcctgcctcagcctcccgaatagctgggaccacaggcgccccccaccacgcccggctaatttttttgtatttttagtagagacggggtttcaccctgttagccaggatggtctcgatctcctgacctcgtgatccgcccgcctcggcctcccaaagtgctgggattacaggtgtgagccaccgtgcccagccaacgcttggcttcttttatagcttcctccaaaagtgtgattcaagtcggtatgagggtagggtgtagggctgtttgctgagacagtgttgtccccaaactcacacacacaaacacacacatatacacctgtgtttacctatatatgcctgtgtatatgtgtaaacgtgtggatctctatctatagattcatctactgttggccaataggacataaaaaaacatccaagttttttttcattcttctgctctgctgggcggctgggggtcaggggaattgccgtttcttctcacaacagagacttattttcggtatctgtcctctacttcttcctcattaataaaaccctgcatttcagatggactcaaataaagatcacatccatttctccccttgaagtcagcgacagtaatgcatacaacttactatacctgttctttaaaaagggagcctagtcttctcttgctgtttcctgctggtaggaacacagacacacgtgtgcgtaaacacacacacacactgtgggagagatggagcagttcttgccccctcggactacagagtggaagctgcatgctcccagcctgcacatggcaagcatggaggttcctgaggcttgtggagctcctacagcctcactgggctcacttcacatgtaagtgttcaccaaacgtaggtaggcttctcatcaatattcactgggtcaatctccactttattctttgtgtctaagttcaaatcctcttaagctcttacctagggtttggtaatgatctcaaaattgttctttctctctccagatctctccctcccttattgtcttctgcctgctgttgccaaaatacaatttgtaatgtacaagtctgctcatagaaaataagtaacagaatcagaattctaacttatgtctatcttgatacagagctagaaatattagagacattgtggatagctaggaaaaaaaggagaaatttgacctaaaaagagggcacgtgttaaactcaaatgacagatgaaaggtatgcaagggctgagcatgccggagaagacgtgacggctatgttccctgtgttaggtcatgggtgagttattgcttgccattatttcatttgtacctttatatttagcatcatatctgaagcagcttttacacaacctggaattgctgtgaatgagcagccactaagaacgagtgcaggagatgagaagtgagtgacatttcccagcagttaaaaacccttcctgcacaaagccatgcctgactcacattcacccgtgaacatcattctctccctgtaaattctgcatgagaataatcctagggtttctcagttattaccatgaattgttcattagattgcgcacatggtgattttatctattgaacagttgaacctacttgaacaattctatacttctccataacaacccacggtgtaatatcacatttttaaaaaacactaaatgaatgagcttaattgagttgggtattttgtaattgaggaagaggcaaaatacattttttgaagagtaactccttgatgagagatgttaaatgattcatgaatccacatcagtgatggggctagataatgcagggttttcattcttagatcagaatccttagtctatcattagacccaccagatccaaaagataactttataaagtcaaagaaatgattttgtctacttgacttatagcctggatcatacaggaatattttgttttcatacatgaaaaatgatcatatttcctcactgatgttttacaatccaaactaaagcaaatccaaactaaagcaaaatcagatggttttacaatccaaactaaagcaaaacggtactttgagaataaagagttaaagacactgcctttatacaaataaaacaccatgtgtattaaaatatatgatccctaatgagatggtatttgaatgagaaaagctgggcatatcataattcttagcctagatatcgtaactgtgctttagaattggaccaagacactttcttactaagaactatctttagaagccattgtgtgcaaataacttctttctttaactagttggtggccttttattctgtgaggtatttaacatttaagtctgagtcacttgcttttaatgtgccacaatgatgtgatcccttaatatcgctgaactatgacagtgacatcctctttgaaaagaccaagctaccattagaaatgggtcatgaagcaaaagtcattaactcatttaaaaaaggccagagcccagcaccgcattactgacaaacctccttccctgtgtccatttgtctttatcaaatatcactttaatatccatctcccaagcatgagatagggttgtgaagcagctccctttgaaaaattaaaacccttagcaattaaatttgctttcaagtttcactttagatgagcaacttaattcttgtatgcaatattataaagtaagtattaataactcccagtaatacaaataatgattccagagttgctagtctgaaaacatttgaggactctttttttttgagacggagtcttgctctgtcacccaggctggagtgcagtggcttaatctcggctcactgccagctccgcctccggggttcatgccattctcctccctcagcctcccgagtagctgggactacaggcgcccaccaccacgcccagctaatttttttgtatttttagtagagatggggtttcaccgtgttagccaggatggtctcgatctcctgaccttgtgatctgcctgcctcggcctcccaaagtgctgggattacaggcgtgagccaccgcgcccagccttgaggactcttaaaagaggaaaattcaattaatagagtcaatgatgaaaaagtcaagacagagtttctaatattttccttgatgttagttttgcagaaagacaacatgagatagaggtcgtatcttttccacataccaaatgagaggtttattttaaaataatgttaaagtagtaacacaaatgatagggaataatatatgtcaacgtgagtgggcttcttgtactaacattttaagttttatatcagaatgagcttccaccttcagcattcaaatggaaatttctcacaacaaggaaagataatctatgctctaggaatccccttctggtagacaacctttgtagaatcaatttttacgtctgttttcctctgttatatctctcagaaaacaaaaagtttcatgaattttttcttctctgggctctcagctacagatgctgttgcaaaatgaggcaagagtgagttctgccaagagcaatgtccatcatgcaaaatgcctactacctaggagctttcagaagaagtaagacaaaggctgaacatagtagaagtttgtgtttctttccttcaactgaccccatgacaggaagcaggtggtggcagctgtttatccaataaaagtatttttgtttgttttgttttcttttgctttgaatggagtcgcctatcatctcagatctcagatatacctataaataaaattttaaaatttaaatattcaaatattttggccaacgtgcaacacaatccggttgctctttaaaagcagagataaagctattttataggcaaagcaaagcgcacagtcacaacagaacagcactggatgtttgcgttttacttattttatttttattttttattgatttttatttttgtttttttttacaagacggtactttcattattgaactttaaacatgaaagattacatttctacaaatataatagaacaaaaatgaatgtggagaaaaaaggaattatggtaactgtacagggcatgaaatgggcactttccgatgattgagcaagaaattaagtacagattataatacattctttttaaattcatttgacacattttatctttatttataacctattcttgtcttcattttcctcctccctcctcccttcctcttccccctttcttcctttgtctaccactctgatcttcatttttcatttcacttttttcttttttattaagcatttgtcatgtattttataaatctatactcctctgttacaataggtattagttattctgcagcagatcacctcagagggccccacgcaccccacaataatccctccacaaaccccctccacatttgtttctcagagctgaatctttaaggccacctgctgctgggggcaggcgccctccaatccggcagcttggatggagctgaagctgtccacgcggaggctcctgggcccctgacctggcctcacggtgtctccttcggctgctgctacatccttcctcctacctctgctgctgctgctgttctattatacgtccgaccttgacccagctctgttgcggtgttgacacctgtctgtcagcactcgttgaattttagaaaatgcttgacatattttctccatcctcttattttcagtctttctgagtattcctgttttcagtttctcttccagacaagatatttcttcatccaattcagggtgtcacgttcttttgtttaccttgggttttaatttgtgtaattagtattaaattagatcttatttttgacatctttattcacattttcaatttaggtgtaaattataattattattaaattaagggccaggtgtggtggctcacacctgtaatcccaaaactttggggggccgaggcaggggggatcacttgagatcaggagttcaagaccagcctggccaacatggtgaaaccccgtctgtactaaaaatacaaaaattaccaggcgtggtggtgcatgcctgtaatcccagctactcaggaagtgaggcgggagaattgcttgaacccgggaggtggaggttgcagtgagctgagattgcaccactgcactccagcctgggcaacagagcaagactccctctcaaaaataataataataataataataataataataataataataataattaattaaaacttatttctgccatctttttttttatttcttctctttcttcagacctttctaccccccttctttcctcctttcaataagataacttcacattttctctttctgatttaaaggtaacatctttctatttttataattatgattgtcatatttatgacccatactctttttattctgtccttattaatttcctaaatttatatatattcacatcttcctcctaacacaataaaaactagattgtttctaatatttattttgtcttgcctctagtgattatgttgttatttcctagggcttcagttttagattgctgtggatagacttttacttgttttcatccttctacttacctaacaaaaatgagttttactaagatatatatttatccttaatatctgttttttttttcttcaaaatgtgttttaaatgagggccattttatagttaaaagttctgaggccttttaaatgtatgaaaaaacatatgaaaatacttttataaagccttcatttttatgagtcagcttctctttagattcatagttctttttctttagtacattaaaaataaccctaaattttcctattatatttagtttgctactgagaagtcagctaatctgattgtttctttgcagatgatctttcttgctgacattctttaaattttcctgcctttgaattcttaattctcattataatatttaaatgcaaattgttccttatctttccatttttccttgataaactcttcaatttgaagtctttcaagtttctttaattctgaaaaatgtctattaattctccgcatttttccccttatcttttcacttttctctccttttgggactcatccaggtattgatatttattgtattctctatatctttcagtttttctattatgttttctctttctttattccctcaaggaattccttaatctgatctttaaactcacttatttactcttcagctgtaaacatcaaaatattccatctattatgttctttatatcagcaattatattttattatataatatttttcctatattctattttatgattatttcttattttatattgttaacatcttagattatcatcttaactatacttatcatccatttataaaattcttagtctacctgctctgacaattctcatttacaggatatatagtgactatttcatcttgtttctttatttcagctcataaaggtgtaagggccgtatttgtgccagtcttgggtaagtttgaggaaaaagctagggttaagataaaatgcagagagcccaggcattgtaggatccctctcatccaatgacattcctccaaacagtccttctgatcatggctgtacttcaaagtcttaagatgaagctctggccaggcgtgttggctcacacctgtaatcccagcactttgggaggccgaggcaggtggattgcctgagctcaggagttcgagaccagcctaggcaacatggtgaaaccccatctctactaaaatacaaaaaaaaaacaaaaaaataggcatggtggtgggcacctgtagtcccagctatttgggaggctgaggcaggagaattgcttgaacccaggaggcagaagttgcagtgagccaagattgagccactgcaccccagcctgggtgacagagccagactccatctccaaaaaaaaaaaaaagatgaagccccactcggaaagggcagcctctctaggatccggtccaccagccctgagtgctgtgagaggctagaggagtgaatgtctaagggcggctggtaggtccacatttttccaaagatttcccaaccttacaagacttttgatctgcttactataacttcagaacacatctgtaagaaactgggctattgttactttttgctattctggaggaattttttttaatgaattatgaaaacttttctacaatctattatgttgttctcttgccaaaactttcaaccatggttcaaaccaggaccatctacctagttttcccatccacatcaactcaagccagccttcagtctccctagggtggtttctctctcctctctccctccatctctcccttcctcattccctccctccatcccttctctctctctatgtctgtctgtctgtctctctctctcttcctggtatctttctccttgtatctacagtttgtcccacattgattttgggggactgcagcaatcagcagcctcagcttttcccagaggccttgctcatacctcccaggcctgaacacctaaagaacccatagctgctggacccaggagggatggttgaccagttgattggagttaggagggaagcacagttggaatgcgttctaactgccatatccctagaatcctttggtgtttaatatttagtgcaataattttcatgtagattgaatttaactaaagcaagtgtcatggctttgtcaggaatcttaatcatgaaactttccttggcttccagtatctatttgtggtaaatgttaacatgtacctgactaggtggctcctgttgaaagcaattgcaaaaataaaggcatagagaagtatgagtgaaggtctggattacactttctttcaaataagaattcagcatgcattcttttttccagagatcttaattcaagatccataatattgcatctttctcttttcttctaaaccacagggtaaatgagccctaaaataattgtgggttctgaatcttcactggattctacttatgtcacctgtctcttcaattctctaactacaccctccagacacaacctctgaataagtgtccccaagcacctgacactctcacttccacgcctttgcagattccttccggcatggaatactccgcacttctcatcttattctcttgttctgcctattctctgctcatgctgaagaggcttcttggcgccttttcactaagacgattggtgacgaggccttctcctggaagcatgacatcactcacctctcccagccgacgccatgctcaagtctccttgcatgagaccatcatactctggtttggattttgtaatttttatttgactttttctgccactggaatatagggtctttgagatcaggactctatgtcctagacatttttacactcaaccttagccccagttagcttttagacaagtaattattgaatggcagtaaatattccttgggtttcactgaagtctgctctaaatgcagttgagtttaatgatcaagagcttggactctagcatcaaatgtgagttcagattatttctccattacctcctagttgactaacacctactttctgactataacaacaaatgttactgataactatttctaggaaattcattaataacatatctattatgtagtaacttatcaataaagacaagctgttgtaatttgatcaggtcaacttcctttcattaaaaaaaaggtgaaattaactaaatttatctttggtatgcccaaaaccactctcccatctctccagtaacttctctgtgtctttatgtgactcgggacacttctttgtcaggagataaaatactttgatgaggagatttacataaaggcgtaagtaagaacgacttaaaaaattatctttgataacatagttgctgctaatccaaaggagaaactttaatgctggaatggcaggcattaacaataaataaaccgctggaagtaattttgaacgggatggcctatgggaaacatcctagaaatcttactatgtaaggaatctacttactcatttattcactaagttgaaaaattcatactgaattcttgctgtgggaaatatttttctgggtgtgtagaaatgtagagatttatattacttacttttatcctcaaacgtgctcataatctaacaaagcagacaataatatcttgtatttatattgttttacatatatttacttataataactatcttgtgatgaaggttaagaatttcattcccagtgttcaggtttggaaaaggaattggatttacccaaggtgatacagctagaaagaggagaaatctatactcatatgcagttctcctgaatataactatttttcccccatgacacaatgcctatacaaccataatccaaataaactgataggtatcataagtgccaaagtaatacatttagatgagagtaaaattaatgtttgcaattaattagtaatggtctcatacatagggcatttcagtgcgtgggcactgaagaatgaactggattttgacaggtggagatggtggaaaggacattccagactggaaaactggagaaaaaataggaagtgcacaacagaggtgggaaagaacagatcttttttttttttttttttttttgagaccgagtctcgctctgtcgcccaggctggagtgcagtggcgtgatcttggctcactgcaagctctgcctcctgggttcacaccattctcctgcctcagcctcccgaatagctgggatgacaggtgcacgccaccacacccagttaattttgcttttgtatttttagtagagacaggggttcaccatgttaaccagggtgatctcgatctcctgacctcatgatccacctgcctcggcctcccaaagtgctgggattacatgcatgagccaccatgcccagcctagaacagatcatattgtaggaaggccaaccaccctggctgactagaatatggggtatgtgaaagaaagaagtggttttgataatatttaaaatatagattggaactagattatagagaattgtaagttttcactcttttccaaagccagtagtactcaggcctggctcagaatcagagtcgattttgcagcttttttttgaaatgcccacgccttggcagcactcccagagatcctattcattagctctcaggtgcatggacatctgcatattttaagattcctctattgatcctgccctgtaggtacagtagagggtccgcgtcatggtgattgaagcgcggtccacttggcgtgtggtctgtagactgtgctagttttcaaaggattagtgcccatgaagagaaattgaatagtgaaagggtaaaaactgtatagcagtttgatgaagtaattttatatctgttgagacacagaacttaaaaatggcaatgtgttttatatgtgttttgttcattcttgcacaattcatcttattatattttacaaagatattgttacctgagaattggaaattaaaaacaaaaacaaaactgggtttttcacacagataatccaggaagtgtcatcactccaggccacggtggcattcgtgaatgggaaacaatgtttggaaagtgtgccgttttgacatcagtgtggctctggcacgttggatggatgagatgagtaggaatcagtgtgaagtccgcattacaacatgcttggattcagttatgccaatggtaatggaaagaaagaggaaagatttcagagaagtatgcaaagaaaaaaaagaaacaaactgtcaatagatagaataaaagaaaagataaaatctaaaaatgttcttgatgtttcatgcctgcgtgactgaaaaaaaaagtgctactatttagaagtatgtagatatcattaagaacatttgggggcaaaaagggggtggaagtgagggtggagacagtgattttagctctaggcacattcagtttaagaagtctgaagtaaggccgggctcagtggctcacgactgtaatcccagcactttgggaggccgaggcaggtggatcacgaggtcaggagatcgagaccatcctggctaacacggtgaaaccccgtctctactaaaaatacaaaaaattagccgggcgtggtggcgggcgcctgtagtcccagctactcgggagactgaggcaggagaatggcgtgaacccgggaggcggagcttgcagtgagccgagatcgcgcccctgcactccagcctgggcgacagagcgagactccgcctcgaaaaaacaaaaacaaaaacacaaagtctgaagtaagtcaaatggaaatgtttccaaagccggtgaacatatgggccctggaacagtgacagtcacagcagttgggatcataatcaggggtggtattaaggacatattcaaagtggccagtggagcacagcactgacagccccgaaggcacagtggccataaatgcacgacgttgccaagggagtgcctgcccactgaagggcagccctggctagaggtgggataaccctggataagagtgggcagggagggggatctctgagggagagatgatagagaaagcaaagagattgtaaaataactcttagtgaaagtgagaggagaaaggggatgtgggaaatgtggaagaatgatataaagttggttttctttctttcttttttttttttttagacagagtctcgctgttgttgcccaggctggagtgcaaacctccgcttcccgggttccagcaattctcctgcctcagcctcccgagtagtggagattacaggcgcccgccaccatgcccagctaatttttgtatttttagaggagacggggtttctccatgttggccagactggtctcaaactcctgacctcaggtgatccacccgactcggcctcccaaagtgctgggattacaggtgtgagccaccatgcccagccagttttctcttgaaatcaggaagagaagaaattttaaaatgaaaagaacaagatgacaaacattgatgaaccatacagagaaatggaagagaatgagaaataagtaaagactagatttagggagcaaaaataaacaggaaagcttgaagaaatcagctttagtatgttaggaaaaatttaagatatagagcaatgaatagcaatatttggtaaatgctaccggctggattgtgacgccctaaaacccatatgttggagccctcattccaatgtgatggaatttggaaaagggaccttggggaggtaattaggtcatgaaggtagagccctcatgagaagatgagtgtccttactgattttatttttatagatttaggaggtgaaagtgcaggtttcttacaggcatatactgtgtactggtgaagtctgggcatttagtgtactcatcacctgagcaggaaacactgtacacaacagttaattttcaaccctcacccccctcccaccttccagcttttgtagtctccaatatctaattttccattctgtatgtttttgtgtacacattgtttagttcccactaataagtgagaatgtgctgtttctgatttattttacttaggataatggcctccagttccatccatgttgctgcaagacataattctattctttttttttattattatttttgagacggagtctggctctgtcgcccaggctggagtgcagtggtgcgatctcggctcactgcaagctctgcctcccgggttcacgccattctcctgcctcagcctcccgagtaactgggactacaggcgcccgccaccacgaccggctaattttttgtatttttaatagagatgaggtttcactgtgttggccagaatcgtctcaatctcctgacttcatgatccacccgcctcagcctcccaaagtgctgggattacaggtgtgagccactgcaatcagccgattttattctttttatgttcacgtagtattacaaggaatatatatgccacatcttctttatgcagtcgtctgttaatggactcttagtttgattccatatgtttgctattgtgaatagtgttgtgataaacacaggagtgcaggtgtcttttggatgtaatgatttatttccctttgggtagatacccagtagtcagattgctagattgaatggtagttctttttttagttctctgagaaatctctgtactgttgttcagaaaggttgaactaatttacatttccaaaaacaatgtatatgtgttccctttttcttgcatcctcaccaacatctgttgtttttagactttttaataataggcattttctctggtgtaagatggtatattcttgtggttttaatttgcatttatctgatgattagtgatgttgagaatttgcttatatttttcttgaccatttgtatgtcttcttttgaaaaaatgtcttttcatgtctttcccccactttttaatggggttgtttttgccttgttgagttgtctgaattccttgtagattctggatattagcctttggtcaaatgcatagctcacaaatattttttaccattctgtagattatctgtttattgattgtttcttttgctgtgcagaagcaaatacaaaacactgatgaaaggaatcatggatgacacaaacaatagaaaaacattccatgcttatggattggaagaatcaatatcattaaaatgaccatactgcctaaagtaatctacagattcaacacaattcctatcaaattaccaacatcatttttcagaattagaaaaaaaaatcctaaaattcatatggaaccaaaaaagagcccaaatagccaaagaagttctaagcagaatgagcacagctggaagtatcacatcatctgatctcaaagtatactacaaactacagaaactaaaacagcatggtactggtgtaaaaatagacatgaagaacactgaaacacaatagagaatccgcaaataaagccacattcctacaaataactgatctttgacaaaatcaacaaaaatatacactggagaaaggacaccctattcaataaatggtactgggaaaattggagagctgtatgcagaagaatggagctggatccatacctctcaccatatactaaaattaactcaagacagattaaagacctgaatgtaaaaccaaaaactataaagatcctagaagaaaacctacgaaaaattcttctggacgttggcctagcaaagaatttataaccaagttctcaaacgtaaatgcaacaacaacaaagacaaatgggactaaattagattaatgtctttaaaagacaaataggaggctgtcatctgcaagccaggaagaagtcccttaccaagaactaaatctgcaggcacccagatcatggggcttcctagcccccagaatggtaagaaaaattttctgttttacaagccacccaagctatgacattttgttatggcagcccaagcaaggaatgacactaaagaagtggaggcagtgaatataaagtcttcacaatgctaccaaataaatgaaagaaaaggtaagattgtcgtttaagaagggtgaagaaaacaaaggcagtatttgaagagtgagtggctgaaaattattcagaaatgatgaaagacatcaattcagagatactggaatcccaagaaatatcaaacaaaataaataatatatattcaatccattttaatgaaactgctgaacatcaaatacatggaaatcttaaaagtactcagagatagcaggcatgtaacttgctacgtaaactgaaaacagatttttcaacagaaacagggcaagctggaaaatcgtagaatcatattttcaaaatgctaacagaaaactcagaaattcatttccagcaaaaatcttccaatgggaatgaaggcaaaataaagacattttcagacacacagaacagagcttgtcactaaatacaattttctggcagaaggaaaataatcccagttagaaagttgtgaatatagaagggaataaaatatgacaagactggtaaatatgtgaaaaatttaaataaagatcaactacattaacttggcccaggctggagtgcagtggcacgatctcagctcactgcaacctccacctcccaggttcaagtgattctcctgcctcagcctcccgagtagctggtattacaggcacatgccaccacatccggctacttttttttttttttttgtatttttagtagagatgaggtttcaccgtgttagccagatgatctggatctcctgatctcgtgatctgcctgcctcagcctcccaaagtgctgggattacaggtgtgagccaccacacctggccaaaacttatgtcttgtagagtttaagatatggaaagtaagtgacaacactgtgtaagtcacagagcagtaaaagaagttggaatattttaccacagttgcaaaaaggagagggtttgtgaggcccgggcttctttatatacaagaaaaggcaacactgccaaatccgagtctaggcgcccagaaagctaatgcaaaaccagtgcctaaaggaggaaagtatcaatgtcaccttgaaagtgaacagagacactactgttattaaaaagaaaaacaagtcatgaggaagaagaatgtattgagtcgttagcatgctcaaggaggtttccacatattaatattatcttaatttatgttatttattcctgttatattctaatactatgtattattatttatgctaatactatgtattattatctcctttttccaaggaggaaactgactctgtagggtgagctaactcatcctgaatcaaagctgcaatgtggagattggtgtgttccattacatctcattgcccctttagaagcaggctgtgctggggaccaggaggaggccattggatgggtgccaggaagctcagggcttcaggcatggctgaccctgtttccactgggccccagggaaattgaagccaaatgtatgaggatggaacagttctgaggctttcataagttattttctgtaatccattgaccattttgatgatcatttttcctcccagaaaaattcacttaccccttttctcttctgtggactgcattgccacattttcctctctcatttgatttcacaagtgtccataatcttacttgctcctttcctttggcattttctcttggaatctaagtatctctgttttttatattttatagtcacttgcttcatgtttatcctctttttgttttctatctctttctttccccaaagaaataagtctttgctgcaattcataggggctgatattgaaccatacgtccagggtattactttacaatgtccataagctcccagaaatgcaccagaaatacgccaacaattaaatgacactttatttctgggcgtaggtaggggttcttgctgcccaagcacagcctggcagacagaggcaggacttcaaatgaccactgcaagcctctctttttgacggatgcagctcatccaatacaccaagagaaggattgtccaaattaaaatctatttctaacaggaacccatcaggaacaatccctaatactgttcttccatgaagaataaaaaaggtaaaagtcatataaaagagggaagacatggcaagatagttacaagaatattttcagagtataagttttaggaaatatgctgaattatccagtgttttaattaccctgaagctggactttccaaccaaaactcataatctaattaaggaagtccatcatatcaacagcacataaagcaacaagcaattaacattttccaaaaatgaaactgatgcaggagcatttcgatttactctaattatactgtgaatgctgtgcctaatgcaacaatgcctttgcatttaaaaaattgtctttaaaggtctccctccaaattgtaataggcttatatttctcccattctagctgcctgtaatatacataaaaatgagaattacaaagaattctcaactcatggatattataaaatatagatgacagaaacttggccctgaatgctcccacaagaacagtttgcagcaatcacactacaaagagttgtaaggatagcactttgatcaatctgcttcattcatctctatgcgcttgaaagaaatgtcttggaaagggctaagagccagcgttcctgaacctccgaatacaggcttgttcttgcaccagatatcgtgcctaccgcagtgcagagctcgctaagccttcaggaagcttttgtttcagaccacagtggtgtgcactcctctaaagcatatgctgcagtacatgactgagccttctgtcagctgatgaactgcatctgactcctggtgtttaaagggtctgaaacaagcatatcattctgcaaagtctgagattcaaaataagtaaatcctattgattatatcagtagaaattacaatcatgggattctagaagtacagggaaactggaggaaactccagatgaagaagctgacatccaggaaataaatagttgcccactcctacacaaagtgggaaacaaattggctttattgactcctaaacttttggaatcagaaagatctggcttcagattcaacttttccatttaatgtgggaatgtgagcgagttacttccctagccctttggtttcgtggtctttaaaatggaaacagtaatacagaccccttacaacatgaagatcagatgaaatgacacatggggaacctttgatgttcccactgttctgagctgcaggctctctgaagtgatcttcttccttctcatgtcattttctgaggtaataaaaagcagatgtgaagtaaaaatttgtcagataattaatcaagaagaaaaaccagagcaggcaggaccttcagatattcaaaatcataaagttgacattttatctaaattcctcaagttggcttttcatagaagctatataactggtgtttcacactgcacgtcatgtttttaccgaaataagaggaagattacatccctaaatacaaatttactaccaaatcatgacgtgagaataggagaaatagctccgtgggacattagccaagaaccgtgataaataagaagagagaagaaggttgggtgctaagttagatgataaagttaccatgattttctagctaataattatcctacattctcagatgcctgaagaaagatacatgtgtttgtgtgtatatatatatatgtgtgtgtgtgtgtatatatggcatgcaacaccataaattaattagatgtgccttgtatcacatagcttgaattaagaccatagaaaagataacagaagtaagaatttaaaaataggacccaatataaatatctatttgatttatgagtgcatttattaattcatatatttattgatacttcctctgtgaataactgtgcaagttttagaaatataaaaatgcagctggtgcagtggcttacacctgtaatcccagcactttgggaggccaaagtgagtggatcatgaggtcaagagatcgagaccatcctggccaacatggtgaaaccccatctctactaaaactacaaaattagctgggtgtggtggcgggtgcctgtagtcccagctactcaggaggctgaggcaggagaatcgcttgaacctgggaggtggaggttggctccactgcactgcagcctgggcaacagagcaagactccatctcaaaaaacaacaaaaaaaagaaatataaaactgaattaaatatgatcccagccatcaaagaatgcacaattctagaataacaaagcataagcttatagcactggcatggtttcctgctgagtctatagagcctgcttccaatgttatcatgccactgtcaaaagacatacaaaattaaacaatattttaaagagcaaaaaacctctgtgtctcaaactccaacaaatactatttctacaggacatacaagttttcaaatgctttgagttagcctttcacaataaattattttccaaaaaaatgatttttaatgtgtaaaaatttttctgctgtgagaaaaaataaaatattgtttaaaatcttaatactttaacactttacaatactttatatattattttatataattgtcctcatagagtatatgtaagtttgtgtcatgtattatatgcctagtgttacatcctaaacatgtccccagtggtaaccactgtttgtttttatggcagcactgtattaaatttaagtaataatttactgaataatgtctgtattgttggatatttagaatttttctgctttgtgatcataataaacaatgtaattggtacagggctttaaaatgtgataattatttagaccatcactgaagtcccaaaatactagctaccatattccaaagttaagtcaagaaaccatgaagggccgggcgcaggggctcatgcctgtaatcgcagcatttcggaggccgaggtgggtggatcacatgaggtcaggagttcgagaccagcctggccaacatggtgaaaccccgtctctcctaaaaatacaaaaattagcagggcgtggtggcgcttgcctgtaatctcagctactcgggaggctgaggcaggagaatcgctggaaactgggaggtggaggttgtgagtgagattgcgccactgcactccagcctgggtgacacagcaagactctgtctcaaaaaaaagagaaagaaagagagaaagaaagaaaggaaggaaggaaggaaggaaggaaggaaggaaggaaggaaggaaggaagaaagaaagaaagaaagaaagaaagaaagaaagaaagaaagaaagaaagaaagaaagggagaaagagagaaagaaagaggagggaaggagggaaggagggaaggagccatgaaggacctgtgcagatattgggaaaaactgtgttaagccgggtcatatccctgccccccacgaatgcttcctcctcatctcaagtgacgtaaggcgatttccaagagcatgctatgaggctctgggaatttggaacctcgtggcctggtctggctcagacaagagaaatgtaaaacacaggagaccttggctggcaaggagaggttactgcattgttggacaaaggatgtgtggcaattgtctcaaatactgtctaaaacacgtcagaaagagaaagacttcccagatgcctcaaagattagcgaaattaccagcaacctgttaaaaaagaagtctcaccaatattaagagaacgctaagtaaaagatccctggaaatacggtcttcaaagaacccatgtgagcatccaggagggacgtgttggcttaaatacctgccagaccaaaggagcgcctgtcccttctcattccaatcagtgaagtgaaacatggcagcctcctttaagtgaatgtatgtagtgtgtaaggggtcggagagggaagccacaaaagcaaaggagggaaaaacagaggggaaatcttcctccctcccatcacaggactgaggctgaggagacaagaaagaatctttttaaataaatatgaagctgtaatcactctactagagtaaagaaactaatttgtaagtgattcttctttgtttttctaaccataagcatcagtaggactcttcactatctaagaatgagttgggggaccacgagatctgagctccttgtcatccaggaagatgggaggaatgagttttacagaatggttgtaacaagaagtcagcagatagcaagctgatacctgataccgtaccaagagtcttgcttttccaacataacagtcagactataatacagattacaatttgtaatcccagcattttgggaggccaaggcaggaggatcccttgagcccagcaggtcgaggctgcagtgtgctatgatcacactgttgcactccagcctgggcaacagagtgagaccctgtctcttaaaaaagagagaaaaagaaaaaaagaaaagaaaattatgttgcaattacattttgcattcttttagtatatctcctttggataaatcctcagaagtgagattgctagggatttcatgcaggtgccatcatttacttaatcaaaccctatttgcaaacaatctaggagtttttccttcattttttatgatgatcaatgatgttgaaatggatgtaattttatgtaacagatttttcctccttttgggctatttactgtttatgtgtgacccatgggtggaaattgtttttgctcttgatgcatttacaaatggctctctaaagggattgttcccccttcattattaccagtggtgtgtgaacatccattttactagaactagatattatttaaatacaaattaataaatataaaatatcaatcttttaaatttgaatctcttctttcactaaaaatattatcccattcacttaccatttacaatttctcctttgtggagtggtttatatttttgtcaatttatcccaaagggattttctgattatagactgctcatgttctcaccccaggctctccagctgcatctgtaccagcagggggaaaaggaataaaataggtgataatataatcataaatatttgcaggaatcctgctgtccaagtttcctactactctgggcattcacatttatttatttatttattatttattttagacaaggtttggctctgtcacccaggctggagtgaagtgccacgatcttggctcactgcaacatttgccttctgggctcaggtgatccttctgcatcagtctcctgagtagctggaactacaggtgcatgccaccatacctggctaattgtgtgtgtgtgtgtgtgtgtgcgtgtgtgtgtgtgtatgtgtgtacagaaggggtctcaccatgttgcccagggtgggttcaaactcctggactcaagcgatccacccaccttggccttccaaagtgctgggattacaggcacgagccaccacatttaattcttaataaagacaatggaatttctaggaagaacttcctcttacgaaaggagctaatttgttttcttttgcaagatatgttgtatttatcattataacttagatcaaatgaaaaaaataacaagggaattttgcatctttttggtaaaaaaatctgataagtttcagcaatattaagattactgtaaaggcttctcttcacaaagagtctaaataggacattgaatagcttcttaaccaaaatgaagtaaaatttgagtaactaaagtaaaataaaatttttcatgtctgagccagaccaggccacgtggctccaaattcccagaacctcatagcatgcgcttggaaattgccttccgtcacttgagatgaggaagcattcatggggggcaggggtatgatctggcttctgacagctttttcccaatatctgcttctcttgccctcatctccaaaagcctcagacctttggctcacaagcccttcatggtctccttctttcttcttcttcttcttttttttttttttttgagtaaaagaacactaaaacagcaagaaaatttttctgtagttatcagaaatttcgctgttatgcggatagctttgtttttcattattaaacataattttgtgtttcttctaaaagaaattatattttgcatctaaacgatagccacaacaaaatcattagaaagatattatacaaccatatccaagtaggataaatagttgttgtagaaatcacaaagcagaaatacgttatcacaatcagtgaatttgatttgaattttagataatcatatatttctacccaaatgaatcttgcatttatatctatgtgacagctgccaaattggcctggaatggaatttggctgatgtaatttacaacagttcatctatttggtttaaacaaatagcaaagaccaggaataccagagttgggacatacctgatttacaaagagcaatcagacgaatcggtgttttcattctactcagatctacccaggttgtgtcactttaggttaggacacagtcgtggagattttgtctttaactgctatgcggttttggttgtgagaagccaatcaccttagaactggcttctgccactttttggagggaaacatcagaaaaaagggcaaagtagagttttctctccttggctttctttggttattaagagctccccaccctctctctagtatttgtgatgctgcttctgtccctctacttaatcctattgaagctcacatcacactctagcctggcatcatttttgtgagtcttagagataaaaatggtactggagtattacttaataaaatccacccacttttctaaatacaaacaaaacaaactgacaaatgaatagaacaattacttagcaaccaatgggtggaggatgacctcctgacaaagggtgggtaccaacagtatttaacctgcagcatatacttagcagaaaacatcagaagcctgcttgttaaatatcccagcaacaagacacaaatactccctatcactggtactattcaaaactgtagagaaagtcctgccaaaaatatacaagctaaacgtgagtgataggattactggaaacaacgaaaaaagaaattctacctagaaaagccaaaaaaaaatcaactgacaaactggtaagtcactttagccagctcaaaatataaaataaaagcaggacaaaatcagtaacatcagcactaggctacttgaaaatataacttaaaatgttcaattacactagcaacacacttatctacataggaagatacctaattagaaaagggtgagtcctgtatgaaaaaaacataaaattgaatttaagaacataaaagaaagtgaaaacagacctacatcctacgccaggttaagagagttccatataatagaaaagtttttaattcctaaattaataaattctgttcaatttttaaagataagcatgtttccaagaaacactaccattcaaagcttcatctggaagagtgaatttaaaaacatagacaaaggaattttttttttttgagatggagtctcgcactgtcgcccaggctggagtgcagttgcgccatctcggctcactgcaacccctgccccctgggttcaaacaattctcctgcctcagcctcccaagtagctgggattacaggcacccgccaccttgcccagctaattttttgtgtttttagtagagatggggtttcattatgttggtcaggctggtcttgaactcctgacctcatgtgatccacccacctcggcctcccaaagtgctgggattacaggtgtgagccaccacacctggccaacaaaggaattttttaaaaagaacaagactgtgaggtgaagctaaagaactagcccttaacaacataaaaacataccataaagttgtaataattcagttaatctccattactgttttaagtgaggatttggcataagaaaggaaaaaatcaatctgtgaaacagaataggaaatatagaaactgacccatgtgtataactcatgtgcagaatgataaaggtaaatcattcaaaattgtaggaaaaggatggataggaaaatacaataaaaatagaatttgaaaacctatttatccatttgtggggtaaaaataactttacagctcacatgtcatatattccagattcagtaaaaccataatattattgtaaaaaatagaataattttcagaatatggaaggccttgtaagtaataactgggaaaaaaacaataatgggaaagacagacaagtttggctacatagaatgtaaatttttgtataataataataataaaagtaatataaatagaagtcaagagacagactgggagaaactcttccacttagaaaacatacaaagacaataccacacattggtgaagaaaggatgtagactgcgtttgtctgactgtctgactttgtgcccagctctgccaccaactgtgaccttgggcaaggtcattgtcatcaatttgtttaatatagttgctgctttggcatccattcctaagccagacattttatatatatatatatatatatatatatatatatatatatatatatatattcccccccagacggagtttcgcttatgtcgaccaggctggagtaggagtacaatggggcaatcttggctcaccgcaacctctgcctcctagattcaggcgattctcctgcctcagcctcccgagtagctgggattacaggcgtgcgccaccacacctaattttgggatttttttttttttaagtagagacggagttttatcatgttggtcaggctggtcttgaactcctgacctcaggggatccacccaccctggcctcccaaagtgctgggattacaggcgtgagccaccttgctcagccgttaatatattttttgaagctcagccgcaccccatcacctttgtcctagttaaacctcccctcgcgtgtgagtagttgtgatacagcctgcttcttcctcatctcactgacctgaaacccagcacaccccacggctgctggtggtggtgaagcctcctggtcagcaccagaaactataacaaagttcctcgctttgccgtggtttctttacagtcgcccatccacacctgcacagggaaggcctaggggaaaacacccatggaccccaataaaggcacagcccccaagtcctccctctctcagtcagccgcaccttctgcttgagcctgtgtccctgacagccctgactgctccccgcttcctgctggccccgtaaggtctgctgccctcccgccgcggggtctgtgagtaataaaactgctctgttctggatttcgctgtactgcctccactgtgtctcacctggccgactcacctgaacccagcttctttctccgtcaagactctcctagagatcggccatcctggtaggaataaactgcacacaggtcaggcaagagccacagggtgtctgccagtatcaacaagcttcttgtggaagggaggcctggtcacaggttggacatttaggcagtaggctgtctgccagaatgaagtcgttagtaaaaggcacactgtcaacatccgtgaccaaatgcccaggaatctcatcagggcagggctaaagtttgtagccactctgctgagagagacctccagacgaaatgagaagctacgtgcgcgcacacacacacacacacacacacacacaccccagtctttcagctctctgtgtctcaattcccttatttgtaaaatggggacagatgtgccggctcactgtactgaaagaatgaaatgcagtcatctataaaaagtgcttagagcagtaccaggactcaattaccattgggtgttattattattatatacaaccaaaaacatctagaatatttgactatgcgaaaaactcctaaaattagttttagaagtataaacaatacaatttacaaatgagcaaaaaataaagacaggcaactcacaaaagaaacatgaatagccaataaatagaaaccaaaaattttcaaccacaatgataatcaaagaaatgcaaattaaaatatcagtaagatgccaacctgcatgcatcaggttagaaaacgtatgggataactatggcgatggatacgacaacaccatagtcagacagcctgttgacaggcaggcagtcattcctaccagtgttggtgaatacaaacccatgcattcttttggggggtgaatttggtagaatattataaaatgtaaaatgtaaacactctttcatctaacagctccaatccttgagtctgcactagagaaatactctaaacaggtattgttcatcactgagaaggtaggacagcctctaaatgccctacttacaatactgtaagataattagtagttcatggttcaatgcaacgatgcatatctgtacatattgccaagaaattttcagtcatactgttgttattttttaaattgaagaacaatatataaaaactggtcccatatatattttaaagcccacaataaaaaatagtatataatatagaatttacacatataaacatatgtggcatataaaacatatttatagaacatatgtaaaatcatatgtatcatatgtaaatgaagagcaacagtgatcaattctaaggggaaggcatatgggtaggggattggaggaacagagatttatcaaggttgaattttgtttgctgtgtattgactgaattatttacaataaggatgcattcacttacggattgtgaaattttaaaattaaaaaaaaagacctgacatataggtaatattcagtaaataattgctgttattgtagatgtgaatgtaattattaatcttgaaattatgtattagtctcttgctcttttttttttgagatggagttttgctcttgttgcccaggctggagtgcaatagcatgatctcggctcactgcaaccctcgcctctcgagttcaagtgattctcctgcctcagcctcccaagtagctgagattacaggtgcacaccaccatatccagctaatttttgtatttttagtagagacggggtttcaccatgttggtcaggctggtctcgaactcctgacctcatgtgatccacccgcctcgacctcccaaaatgctgggattacaggcatgaaccaccacgcccagccatctcttgatcttaaggcaccaagagtctgcttttctgacaaccagaatgccactgtactattatttttttttaagctgaagtcttcaaaccagtttcatacaaccaaagcaaagaggaagcctacagagtttcataaagtgaccaggaacagctgtctggattgattcgaaatgaaagaaaagctcgaacttccactgcagcaatcttgtacagcactttacttcggtagacctgacccaagcagcacagagcccggcatttgcaaaggggagtatactttcagacataatgggaaagaagagaattagcattttaagggttgtgtcttttttgctttatttattcatgctttattttcatctttttaaataaatcacattaataggctatatctgtgtagcagacagaaatgtaatttatttgagaaaggcaaaaataaattgccattggtttttaattttgattgttaataagatgatacagttaatactgatttaaaacgcctgcaaacaagctctgcagaattcaaattatttatagataaaacgttaaatattctataacaagcttgtatcacagaaacatcagtaattttgggtctgccttgcagcttatgtcacagaaacctgtctttttttggtgtgtccttcagttattagatataaggtcaacagtctcatgtattatacttaatgcgatggttgtgtccaattcatctctttatcacctaatgataattcttattaatgtaagttatttggaatagatggagtcaggccaatcacaaaatcccttgactgtagttttgaaatatgctcaacatcataatgatggaaagtcatatttggaaactctgagggtatcttcaacttggaagttaacttctttaagtaaattaggattgtccttggcagatggtgaaggacctcactaaatgaaacacataattagttttacactgacataaatatatctccttatgcctgtatttgttcattttaaaaatgagatttgattagatgatctaatcctatctttcagttacaaaagaatgtatatacacatatatgctctcctatagatatcataccatataaaattagaacaattgtaaattatttctaaagaagaaaataaaatataggtctaactctgatgaaatttcagaacagatcatcaaagatgtgttccattagtacttggcaaatgaaaataaaatgatagtaaatgtaataatagtgattagcatgggttgcatgagaaattttatcaaacaatactaatcagtaaatacgacatgccttcgggttgttatcaagatattttttataagaagattgaaaagtttcaataacaaggtcttcttgtggcttgtagaataaaaaggattgattatttgtccattatcaggctgaaagaggatatctgttttcttctgaagtttttgtccatggccccgactcagtgcacactttttttagatcaataacttgaagatatagagagtatcaagtttacaaatcatttaaatcaaagaggcatggctaactgtacatctagtagcaaaaatatgattccaaaagtttaataggctgaaaacatgagattaaaactaaaacagcaagatgggagctggaggcagtggcagacacctgtagtttcagctactctggaggctgagactggaggacagcttgaggccaggagttggagactgcagtgagctatgattacgcctgtgaatagccacagcaccccagcgtggacaacaaagggtgaccctgtctctaacaaaagaaaaggcaaaaactgagcaagatgaaatgtagaaaggataaaataaatagaaaacccaaattaccgatattcgctgtgaataagacatagaagtttatttgttcacagtgagctcaatatgagccagtggtgtgattggttgtgtttcttccttctgaaaatgactgcagtttaaactaaactattagtgttcaacacacacaaaaatatagtggcacttggttagtttatgtctagaaatccatgtttagttctggttaccgtatttaaaatatttggttacctttttagttctggttactatatttaaaagcagattacagacatgcgtagacaaaaggtagttttaaatatggtaatgatattgggaagtgtgtaataggaagccaaatgtttttagcctagaaatgtaaggtgtatgcatttgtgttagggtgcacgcttttagagagggtgactattatgattgggaggggaaataaagagatgccattactatgcaaatatttataggactatgtcttagaaaacacatttgtcttacatttatctttttactctgctttatatttttaatagatgtttaaaaagaaaattaaaattattcttcacagtcaccatttttgaaaagacaaaagtagcaaaaagagagataccagctcatgcaaactaaataaaacaaaagtgttcctgtttctccacgtgtgtccatctttatgtactcagtgtcaaatatactggcaggcagacagcagatgttacatatgtactggccaaatgaatgaataataaatcactatgaagtgaatggcttgtgagagcccagccactaggcaagcctggaggatgaccatctatgagggacctcagagaaagaactgctgaaagaagcccatgggcctccttgacttctaagatacatttagacataatactatttaagagagcaagtaagagcaaattttctcccatagttctgattatcattatagtttaagcgttagaccttgttcaaacaagcttggaaaacaagctgtcttgtctgttaaggggagagtaagtgatataaaaatgtaaaggttaagatttctgataagttaaagcttggtaaaatatttccacgtatgtaaatgattatgccaatttaatttgtttccaaaattggaatatcctttagaatagaaataaaatatttaatctgaatggtaatacactgatctccttttgtcgtgaactaccgagtcctttctacagttttggccatacacatgaaaattaaattacagtattttaaaatagtatttgtatattccatttgggatcctaacttacctaagcagctcgaatacattttaaattaaaatcaagtttggatttttttcccagagaggtgacttattgcaaataagtagctccctctatttcatatttgtccatttttattctaaatattttaatactataacttaaatattctattggttttatttttcttaatatgataatatttttataaagtatttaaagtaaacaaaatgtattatagttattgttagataaaggtgatagacttaaataaactaaggcatgagccatatctggggttcatggatattgaaataatttattcttttaaagcacattattgagatgttacacacatttggaaacacaaagggtaataactttagtttctatcgataataaaaattagataacctgaggaatctttagaagagcatagcaatgtaaaaaaaaaaaagaggctaaaataacacacatacgttttaacagtgtttgtcttttgctggtgggactatgaatgatttttctccccactgtctacatttttacaattaacattattttaacaagaaataaaaatggcgtgttactttcttttaaaaaaaattgttaaatgttaagagtaaaataatggcactacactatttcaaaagcaaaatattaatttcatgttgagcataaaattcttattaaggctgagtctctttgtgtcatactaataaaaaattctccaattatatatcttaagggtacctgggcagagcaaccctcaacatcactaggaaatgaatcccttcttggaactaaattctccaaatcagggaagtcactttcttaagcaataaaatatttggaaaattaaacttatttataaagtctgtttttctactaagtcatttagctcctttattgctttctttatgtggctatttttcaacattctcttaatgattcagagatattcttgtgattgttaaagacttcacaattaaatacgcggcacctgttaggatgtagcgggcactagtgactagcaaagctttggttttgagttacagtgtttgttctttatggaatttctgtattttcccctgtagccttcctgttagatattactgctgttactgtatctttctttaaccacctcttctttcctcgtcttctagcttctggcttttaataaatgtgctatggtaaaaaaaaaaaaaaaaaaagaaagaaaaaagttaatattgcttacagctatgtgtaataatattcagtaattttctcaacaacaaatatcttctatggccaggaatagcataaggccattaagttgctgtgagataggagcagagtgcatctgcaggtgtctgaaggaggagagcagaatgagaatgcactcagagagttcacgcagcccctcgttccctcatttttaggccaggaagtggctcatctggcttatgttttaaatatcattatgattggtctatgccaaatagattttagagaaacaagtggtagaagtaaaatcaggatagaaatgacagaggcttggactagggtagcagtggtggatatgatgagaagcagtataatacaatttctgttttgaaaatgttaatacataaaatcttgtcaactttttaaggggctcaatatgggaaaatgggttatagatacgggtaatggcaagagccactgacaagtttaccagtgacaagatgtgccaaaggtttaggtatgggctgagacacagaaagaaataataaaggacacctcccaggttttggcctgagcaactgcctgaaggtgataccacttactgaggggcccagtaagaaaagcaaacttggctggggaagaactagaaaggaaatcgagagttcagacctgccatgttaaatgtgagatgcagccatacaagtggacgtgatgacaccattctgtagttcaagtgaatgttctggctagagatatccatttgggaattttcacagtagatacagaattaaaacctatgcaattagatattatcaaccagagagcaagtaatgatagagaaaaacaaagtataaggaaaacagtaacttgggcagtgcaatatttagatgtcataaagaggaggaagatccatcaacgcagatagagaacacgctaatgggatagagggaaaaagtaacccaatagtacgtggtgtcctggaagccaaataaaggaggaaaagcagctggactgtgtgatatgctattcagagactgagtaggtcaccactgctttgagttccagaatctgagtctagagggtcgcacataagacttaatatttaacgtatgtaatattagttacatgtattttccacctcctaaatttctcccaagcccacccttctttcagttttcctacctgtacaataaatggcccttattaacccattcactcatactgagtccattataaaaacacaatagtccttaactctgaaatatatttcaaatctactcacttctctccgtctctactgccaacctccttgtgcaaaccatgtttgagaacttttgtaactcattttttgagaactattgtaactgctctttaactaattcctcatcatcccttctttccactcttggcttttataatctaacatgcggagctctcaaggtttgctgccatgttaaaaaaacagtagcagagaaaaccagaaaagaaagcggattctaaggttttggtctgagaactccgtgaatggcaatgccatttattaaaacagggagctctaaggaaggtgagtttgatgagggattgagaaacgtggaaatcatgtgtcttattatgtcatttccatttttttttttttttttttaaggcagagtctcgctctgtcactcaggctggagtgcagtggcgggatctcggctcactgcaagctccacctcccgggttcacgccattctcctgcctcagcttcctcagtagctgggactacaggcgcccgccatcacgcctggctaatttttttgtatttttggtagagatggagtttcaccgtgttagccaggatggtctggatctcctgacctcatgatctgcccgcctcagcctcccaaagtgctgggattacaggtatgagccaccacgcccagcctatcatttccatctctttatcagttctaaaaaattatattcacaatagcataaaaagaataaaatatgagggatattttaacaaaagtagtgcagagcttgcacactgaaaaccataaaacatcgctatgaaaaatcagagaagatctaagtgaacagagagatagtccatgtttatggattcaaagactgagtgttgttaagatggcaaattcttaccaaattgatctatagattcaacacaatccctatcaagaattcagcaggcttttctcatttaaaatttttgcagaaattaacaagctggtgctaacatttatataaaaacacaaaggaatcaaattagccacaataattttgaaaaataaaaatgaatttagactacttacacttcctgaatttgaaatttctataaagatacaataatcaagacagtgtggtactgacataagcatggaaatacagatcaataaagtagagtcaggaatccagaaatagctccttacatataaaatcaactaatttttgacaaagctgtcaaggtacttcagtagggaaaggatagtcttttctacaaatgtgttggaacccctggataaattcatgcaaaaagaggaatttaggctgggcacagtggctcatgcctgtaatcccagcactttgagaggattacttgagcccaggaggaggattacttgagcccaggaggtcaagaccagcctgggcaacatggcgagacctcatctctattaaaaatacagaaatttctgggtgcagtggctcatgcctgtaatctcagcactttgggagtccgaggtgagcggatcacgaggtcaggagttctagaccagcctgaccaacatggtaaaaccctgtctctactaaaaatacaaaaattagctgggcatggtggcaggtgcctataatcccagctactcaggagactgaggcaggagaatcgcttgaacccaggaggcagagattgcagtgagccaagatcgtacctgtgcactccaacctgggtgacacagcgagactccgtcctccccaccaaaaaaaaatattagccaggcatggtggcatgcagttatagtcccaactacttgggaggctgaggtgggaggattgcttgagcctagatggcagaggatgcagtgagccgagattctgccactgcacacactagcctgggagacagagcgagactctgtctcaaaaaaaaaaaaaaagagagagagaaatttacacactttactcatataatacacaaaaactaactctagatagatcatagacttaaacgttagagttaatattataaaacatccagaataaaaacatagaagtattttttgcgaacttgtgttagagaagagttcttagacatgacactgaaagctcaattcatgagtaaacaaaaaaagataaattgttcttcatcaaaattaaaaacttcatcatccaaaatataccattaggaaatgaaaagacaagctacacgctggaaaacatatttgcaaatcatatatttgacaaaggacttgtacccagactatgtaaaaggctcctacagctctattagaagacaactcaattaaaaactgagcataatatttgaatagatattcacttaaaaagatatatcaatggctaacaaacatgaaaatattctccatgccattaattaatcagggaaattcaaattaaaacatgcatgagaaactatttcacaatcagtaaaatggtaatatccaaaaaaataaaagataataataatacaccccctaccacatgaatcagcagttctactcagaggaatctactcaggagaaataacacacatagccacacaaggacttgtatgcaagtgttcataccagtaagaaaaggcaaatcttataggggcacagagtagattaaattaatggttgcctagggctggggaaagagtgtggattaataaaaatggacacaagagatcttttgggagtgaaagaaatgttctaaaactgaattgcattaatagtagcataagtctataagtttatacacattgatttgtacactaaatctcagagaattttatggtgtgaaattataactgaatagtattgttaaaaaatgtaacgttctttctgcacaaataaagtcaattaatccttaataaaggagaaaagcaattcaatagacagaaaaaatagtcttttcaacaaatggtactggaataattggacatgcatatgcaaatataaaaagtaaatatattgaacttacacttttcacaaaaactgactcaaaacagatcttcaacctaaatataaaccaaaatattataaaacttctggaataaacaagaggagaaaaattaatgtgattttgagtttggcaatggatttttagatataacatcaaaagacataatcagtgaaagaataaaaatgtcagttttattaaaatttaaaacttctccacaaaagacactatcaagagaatgaaaagacaagccacagaataggagaatatatttgcaaaacagatatttgatagaggacttatattcaaaatctacaaagaactctaagaaactcttaaaactcaacagtaagaaaacaacacaattcaaaactgggcaaaagaactggaaaaagaccaggctgtcaaagatacagagacagcaaacgagcatgtgaggagatgctcagtgtcgcgcgtcatcagggaaatttgattgaaaacagcatgctgataccattatacactcattagaatggttaaaatcaaagaaactcacattaccaaattcctatgaggatacagaccaacaggaactctcattttttgtgggaatgaaaaatggtatagcagctttagaagacaacttggcaaactcttacaaaactaaacataatcttactatacaatccagtaatctcatccatatttgatttgaaaacttatatctacacaaaaacatgtatgaatgtttaagcagctttatatataattgccaaaattgaaaggaaccaagaagtccttctataggtgaatgcataagctagtagatccatataatggaatattattcagtggttaaaaaaaagtgcaatcaagtcacaaagacaaggaggaaactgaaatgcacgttggtaagtgaaaaaagccagtgtgagaggctacatatgatatgatccaattatatgacttgtaaaatgaaaacctgccatctatgaaaacacaaatcctgattgctaggaagtgaagtcagaggggatcaagcactgggcttggggcgatggtgaaaccatcctgtgtgatgctgtaatggtggatgcacgacattatgcatctctgaaaactcatcaaacttcacagcatcaagagtgagccttaaggtatgcacaatttaaaaaataggaggctgggaatcccagaaagatatgcagaatatgacagaggaatgcgactgtatcataaatatatcaaattacctcactgaatagggtcaggagaaaggggctgacctaaataactttggaattgagcaaagtttctaaaaattaaagaacagcaactgcacgtaagcactgtactgtagctggcaaagttgtctcccatgggaatacagcttcacgattcttagccctccccttacttctctgtaaattctcagtctaactgtaagaacctggcttctctcacccaccatcgtttatgtagctgttcagtgatatgacacctttatacaactattcgaatggctgaaatataagcaactcacgtgaccaatgcttatgaggatacagagcaaagggagctctcattcatttttggtgggaacaaaaaagatacagccactttagagtttggcaaactcatacaaagctaaacatgaataggtatataaatgaaggtgggttggaaaagccaggttattttttggttagaatttacagataagagaaggaggctagaatgatgcctttgttagcatatttgaattggagacatcagtataagctcacatttagcttaatatagatacagatggccacctatggaaatatttatagatgtatgtatatacatgcgttaggatacacacatctatttctttgctctatcagctgagaagatctaaaacaaatggcaccctcgtatcaatgaacacacctagatcttgcattgactacctcctccaataaaacaaaccaagtcttcttgtagagagggctgatactaacaccaaggccaggtgtatacaggatgagcctggagcatccagtagtcacagaaagcagggcgtgcaccctcctccccacagaaaacctcacatcatgagggtgtgtgaagggggcacaaagccaactgaaagcgctcccaatggccaaagctggaacgatttgagccacaaaataagtcgtgttggattataatccaaactataaaagaaatatccatggcctggtgcagtggctcacacctgtaatcccaccactttggaaggccaagatgggtggattacaaggtcaggagatcgacaccatcttggccaacatggtgaaaccccatttctactaaaatacaaaaataagctgggcgtggcggcgcgtgcctgtaatcccagctactcaggaggctgaggcaggagaatcgcttgaacccaagagacagaagttgcagtgagcccagatagcaccactgcactacagcctggcaacagagcaagaccctgtctcaaaaaaaaaaaaaaaaatccacgagtctacactgatataaagaatgattgaataaatgaataaatcggggagtcaaatcaaatcccctgccaaatcatttctaataacttatgccactgttttgcctttaaggaagctactccagccttgagggattggagcataactcctaatccctaagtgtgagctacacatacagactcccttccaaggggtagattctggaaagtgcagggcgaggcagcggaggagccactttacagggaagaaaacacgacctcagccaggtgattcaagtcgaagtcagaaccaacagtcacaaatcatgctgacagtgcttgcccacgatatgatgcaatgaaaatggcggcttagctttgtgattttcctctacaaaagacacaaatctagtctaatcatgaggggaaaaaaagtcagaaaatttccaacagagggcaacctacaaaagaggacttctcaaaattgttggggtcatcaaaaacacaggaagtctgagaaactatgacagccaagaggagcctgaggagtcacggccactaaatgtaacatggtgtcccataggattccggaacctaaagctgatgttgggtagaaactaaggaagtctgggccaggcacagtggctcactcctgtaatcccagcactgtgggaggccaaggctggtggatcacctgaggtcaggagttcgagaccagcctggccaacatggtgaaaccccttctctgctaaaaatacaaaaattagccaggtgtagtggtgcatgcctgtaatcccagttactcaggaggctgaggcaggagaatctcttgaacctgggaggtggaggttgcagtgagccaagatcatgccactgcactccagcctggggaactgagtgcgactaagttaaaaacaaaaaaaacctaaggaagtctgaataagctatgggcttcagttcataagatatttataatattagttcattaattatgcaaaggtaccatgctaatataagctgttaatgatagtgggaactggcttgggtgtatgggaactatctgtaccatcttcctaatttttttatgaacctaaaactgttctaaaaactaaagtcagagtcgatgtttctatcagtatccccactctccagccatgtctttgtgttcctcttcctcgcagtgcatgtgaggatttgctccttggcctggaacactgtttctcttgctgtggatcaacataagcctaatccatttaatcatggcgatctcatcatcagctcccacctaaactgctcctcttcacagaagagttttgctgccttcaatctactccattgcactctcactactccctcgagtttttcttcacaggacaagccatatttgtattatctgagtgttattaattagttaaagtctatcacctccagagactataagctccatgaaagcaaggactacatttgctcccaatttcaatactgagagtaacattgaatattcgatcattttaatgaatgaatacacgacagaaaaaatgaatcctgacctctcaaagattatgtacttatttttacttccttcttggcagcatgtaagattacatatattctaaattattgatagtgaacttctgtctaacccacgtggtattctaaaagacattttaactattcagatacagctgaatatttgtatcagggtaatacaggcataaatatccagtggttaaacctccatgaatgtacaatattttagtccatattttacatagtcattaaatgctttattgaagcagagtaaagtctgaaaactaaagccaaatcctttgacactaaaaataaaaaaaaagcgggtgtccaagcaacataacggtcagtgatttgctacttaacaaatgaaaaacaaagaaacaaaatccaaatcaatgtaaacaatatatacctctctgttgacaatgacaacaggtgctatcaacacagaagatgatataaatgtaagtgctttagtcaacattacagccagatgataataagaacatttcactctgcatttataggacccagtagcagtcggctgttaaagaaaagtaacaataatcaaactgggctaagtattttctatgtgaaggtatcatgaaatttatgaagtctgtgtaagaaagataaaggcattcacttttgaaagaataagatagtttaaacctcaacattctctatgcttaaaattgagctaatttgaataaacagaccatgacatggaactgtcactttacaagttcctgctttagtctttaactctcaaactagcattctttaaactgtctaacactgtgaactagttttaatgcctccagctttgtctcctattattatgagcacattatatggagtgaaaaaagaggaatattgttggacttaatagtaaatataatatggaaaataatgcaatgagcacttaaacaaagttataaccatggttaaacaaaagaaagattgtatgtgtcagctgctgaaagacattctaagttatttgtgtgcaatatactgttgtttgacagaactgacacctaaatgtgaatgatggtttgctttcgctaatattagggcatgaatctaggtttaatccagtccagtcaaacctggactatgcctcactttttcttcatagatttgacaatgggtcttcattttaaaatcacttacaaccacgaagagaaaaaaaaaatctcttcactggtccgtttggcaaatgacagtttgcttgagatttccttctgagatcaaagaggaggaaataatgtcacgctgcaggaatttctaatgattaatgttattaccatgaacaccaaaggaagtgataataatttgccaagtgtgctgcccggttttccagtattaactcatcactatttgcttcctcagagtaaggatttctcacaaataaggaaaagggatgaggagatatgtattgcttttgttttccgagaatgccacgcacccacactcagcacaccctagcgagattttagcctatgcatgtgcgtctttcctgcctttgcctgtttctgcctcttgaccagcgtctatcaactatggagctcgactccctgccattaaggagacagacttcctggggtgctctgctcccacctgctcccttttggactaaacaatgtgtgtgctcttctgttacagagtcagttccttccacaaaattaccgtcttgctgtcattggtatggctgccagcaaaccatgccaaggtcttctggtgtgcctacagctaaatacttgaggagaaagaggggaactttgaagctcttgatgccacactcagcatggaacaattttggcaaagcaaccatttgaaatttgcttactcttcaatttagggacggctctgatgatttatgagttcagtgagttgaattcaaagatagaaaagagcatgtttctcctggacaattatggagaaagggagaattagctgttccttattcttcttgttagttaagtcctatttgaactgttcttgcctcatgtgatgggaatgtctaaaaatgccaaaggagccatccatttatttccagaattagcaaaaaccacaaacttcgctgctgaagagcaggctcccacaggaactcatataattctgcagcgtgccattgactttaaatggccccaaatactttcttaaaactctctgatgtgatctatctttgtggtaaccttccacacaaagtgctggaacagtgagaaatagaaatatacatgcttcataatgacttgctagtttaaaatgagtgctttgcacatggcattgggcatatccaggccctctcttgcttgggcataaagccagtctgaaaagtgaatgtataaatcattcagctagatatgtcagcttttagatgtatacgcttcagcttagaggcctaaaatatatcacactgttttcagagttttgtagcttattatcggagcaatagagaaagattttgattgtagaatcagtgtgtctaagtgcatagtatggggcaaatgtgggtatctaatgagttaattcaaaatcataagcagaggcgctattcttgcttcttagtaataaagtgttcctattggagtcatcaatgataatacaactttagtctaaagcaaggatggaatcaaggaattttatttatagtactgtaacctgttaatttgatgggcaaagactgacaaattcaggaatgaaaagaatgtgcttttctttccctttcctctcctctcctcccctcccctctcctctcctctcctcccctctcctctcctcccctcccctctcctctcctcctctcctctcctctcctcccctctcctctccttccctcccctctcctctcctcccctcccctctcctctcctcctctcctctcctcccctcccctctcccccccttcctcccctcccttctcctctcctcccctcccctctcctcctcccctcccctctgctctcctcccctctcctcccctcctctcctctgccctcccctacccttctctcccttccttctcttcttcctcccttccttcctttatccctctctccttcccaccctcttctcttcctcccttccttccttctgtataaagtaagatagaggtaataaactcagtagattcagtataccgatagcatataacactgacaaatcaggtaccagaggcaagttctgcagtagaatctacaagtgaaacttctagaattgtattattaaaccataaaacatgcatccctcccaccctaaagctattttttcttaccacttagatgtaaatcatctgaaataaagttacagattttgagtaacaatattagtatgtgaatatgtgttgctgcttctctaagaacctcctagtatacccagtacacctgttggtaagcccctgtcaacagacagagctggtcatccccagccacttcacaggagttcctgccgtttacagtatttcttcagaagttacgttcaacaattctgctacttatggttttctttttctgtaaatttactaggcaagtcatctctgcctgacttgcaaattcaatgcttgactctcagattactactgctttcatatagatgtggatcttcctttgcaatggttttttttttttttttgaggctggaattcaaacgtattattgaacctctagaataaattaatatttcttttcagggttactatcgatgagactatatctaacatgtctgcctgagtaatttgttttctataattatggattactaaagggtagaatcaaaatatttctgaggttctcatacagtataatgtctagaattcaaaacttttttgttaagtgaaaagacagactgtcttattcaaaaggtgcacattcgctttaataaatgttgacaaagattctgtctttgaaatttagccaggcttctctgagcccattcttaccctggccttggcctcggtctatacagacatgtttgtagtggcctccaaacactaagttcgtttctcacagttgaaagctgcatccccagggacgaccccgaccccggctcggcttcagtgcctgcctgaggacactgcaggctgcccaaggagtctactgtttgctccagccaacccctggagagagggctcccatctcctagcctctgtgggagggtaagggcctcatcttgacaagctccagttaacaaaacaatgtgggtttcacacggaccaatccccgatttcctgctttttgtaattttccacttctctgaccagactgatcccccgtcacccatgctctcttctctcgctcttgctttaaaatgcccagtctcctctgcacaaataaaacttgagttcaattcatgctggactttttcctactacgatggtacgttatggattaaaaaacctgtccttccagctttacctaatggcaggctttgtttctctttggaccatgtgcatggtgtatctttcttctctgctctcagtgtgccagaagtaaaattaagggattgaaccaatggctagaacatctccaaaattcttactcactctgggtatggtctgctatttttgcatttaaaaaaaataacttttactttagacacagggactacatgtgcagatttgttacatgagtatattacacccaggtggtgagcatagtacccaataggcggtttttcagcccttgcctgctctctccctaccacctctagtagtctgcagtgtctccatttttcccatgtttatgtccatatgtggttaatgtttagttcccactggtaagtgagaacatgatgtatttggttttctgtttctgcattaattcaattaggattacggattccagctacatccatgttgctgtgaaggacataattttaccctttttatggctgcatagtgttccatagtgtatatgtaccacatttgctttaaccagtccaccactgatggtcaccttaggttgatttcatgtctttgctatcgtgaacagtgctgcaatgaacatacgcgtgcatatatctttttggtacaataatctattttcctttggatatacacacagtaatgggtttgctgggtcaaatgctaattctgttttaagttttttgagaaatcttcaaacggctttccacaatggctgagctaatttacattcccaccagcagtgtataagcgtccccttttctccgtagcctgaccagcatctgttgtttttttaccttttaataatagccattcctctgatatgatatggtatctcactgaggttttgatttgcatttctctgatgataatgatgttgagcattttttcatgtttgttgcccacgtgtatatcttctttcaagaaatgtctgctcatgtcctttgcccatttttaatggggtcgttcacccttcgcttgttgatttgtttgagtttcttataattctggatattagacctttgttggatgcagagtttgcaaatattttgtaattcccaggctaatcatattatacaaacccaggtctgttagcctgagctgcagtttgagataaataccagtaggtggcagtgcaggtcacatggtggcttattctgcacaaagctgctttcccatgggggtatgcccttgggaagagaggactcaggcaccagtctggacaagcacccttttgttaacgcaaaggaaataagtcaatcaaatcaacaccagtaaagaaaagtatacttagaaataccaaacaacaatattaaaagaaaaacatccttaagagtactgttttcttttctcctcatactatttttgagtttacattgctgctgcattttatgaactctttttgcattgcagccccaggttcaaggcttggtggagtcctgtagtagccacccaagatttcactggtcttcagaaacttggaaataatctctcacaattcgtcttaaaaccactgaatgtatggttcttatggaggagaggctggctaaaggcaaagtaaatgtagatttcgtgtctcatcacagaggttcagcaatcactcgccctgtcctcagtagttccccaatagtcccctcccaggtccccactcactgcctctgggatgcatcccccactccctccccactcccctggggtctgaacaataaatggaaagcaactcggcctcttccctttcaaggtgggcaccgccactctagtttagtgaaaaatctttccctaaaatggtcagattgataaaaggtaggcaacggttcaggaatatttgtgcttccattagtgagatttatgaacttactccaacattctgaaacaatgggggttgatgatacagttccctaaggttctttttataaatttagctccaagatctttatttatctgtaacttctgtgcttctcctgagcctgtggtaacacacacctcttaagcaagggctgctcaattaagaacaccctaggaggcttgcacctgaaggtttggctttatgccagataccatatctgcactaaagagcttgtcttactaaaggggctcactcccattcttttccattttaacaaaggttaacttaacttaaacataaaatatttgaaataattctatagtgactgtcccatagagagagaggaaatgtatttacattgggagctctatggaaatttcataaagtgaatagttctaaaatgaaaagacagaaatctctagcataggttatatgttccagtgttatgaattaagtctcaaagaaattaagttcttcaaaaaagttcctgttataatgacacatgctgaactctttgtgtgtgtgtgtgtgtgtgtgtgtgtgtgtgtgtttgtggggcctctaataccctcatgttttcagtttatattttacagtatccccatttttcagttgaagaatcataaggagatgctttaaatagtttgcccaagaacatcaagtgagtaatttgaccaagccagaaaaattgcaacaaaagctgggtttctgcattgcatcagccagaaccgtgctttctcagaactctaattcagtattataatatttctgctctaacaccttgcagtggggaaaaaattaaaatctgatattatacacacactttggaatcctttaaagtaaatgaaatatttatgattcaacctgggttcaaatgaaggaagtgtaggcatatcagctacagtaaaccaattgatgactcaagatggccaatgatgataaagttgagagtcagctggattttcactggggctggcagcaagacaggcctgatgttgaaaaaagcagacacaacaggtggaagaacggcagagtggctcttgcttttggtctgaacactcccactggctgcagcactgagttctatagaagcatctgctcacctttcctcttggctggaaagacttacatcaaatgattacaggtttaatgagggagaagtgtcaagattagaaagactaagctgtaggtttcatctggtaaacaatacgggaaagaggctgggcacactggctcacgcttataatcccagcactttgggaggccagggtaggagggtcacctgaggccaggagttcaagaccagcctgggcaacacagaaagaccctcatcttgacaaaaaaaaaaaaaaaaaaaaaaaaaacagctggacatggtggcatacacctctattcccagctacttgagaggctgaggcaggacgatcacttgatcccaggagtttgaggctacagtgagccatgagtgcactattgcactccagcctgggtggcagactgagacactgtacagaaaaaaaaaaaagaaaaaaagaaaaaagaaaagaaaaaggaagatatttactcttgcaaagaatatgggaataaaggctatttttaaagatatgtgtgcatttttattttatcttaaacaaagctctctttttacagacctattcaaaaacactgtattatctacatttaaggtttctgaattgttcttgaaaaaggtaagcttagactggtaattgtggctcatgactgtaatcctagcactttgggaggcccaggtgagaggactgcttgaggccaggaattcaagaccagcctggacaacatagtgagatcccacctctacaaaaaaatttaaaaaattagccgggcatggtggcacacgcctgtagtcccagctacagaagaggttgaggcgagaggataacttgagtccaagagttcgtagctgcagtgagctatgatcatgccattgccctccagcctgagtgacagagcaagactctatctctaatgcaaatgaaagccacaatgagataccatctcacaccagttagaatggcgatcattaaaaagtcaggaaacaaccgatgctggagaggatgtggaaaaataggaatgcttttacactgttggtgggagtgtaaatcagttcaaccattgtggaagacagtgtggtgattcctcaaggatctaaaaccagaaataccatttgacacagccatcccattactgggtatatacccaaaggattataaatcattctactggtcgggggcggtggttcacgcctgtaattccagcactttgggagggcgaggtgggcggatcacgaggtcagaagatcaagaccagcctggttaacatggtgaaaccccgtctctactaaaaatacaaaaagtgagccaggtgtggtggctggcacctgtagtcccagctactctggaggctgaggcaggagaatagcatgaacacaggaggcagagctcgcagtgagctgagatcgcgccactgcactccatccagcctgggtgacagagcaagactctgtctcaaaaataaataaataaataaataaataaataaataaataaataattctactataaagacacatgaacacatacgtttactgcagcactattcacaatagcaaagacttggaaccaacccaaatgcccatcaatgatagactggataaagaaaatgtggcacgtatacaccatggaatactatgcagctataaaaaaggatgagttcatgtcctttgcagggacatggatgaagctggaaaccatcattctcagcaaactaacacaggaacagaaaatcaaacaccgcttgttcacactcataagtgggagctgaacaatgagaacacgtggacacagggaggggaacatcatacattggggcctattgggggttggggggttaggggagggagagcattaggagaaatacctaatgtagatgacgggttgatgggtgtatcaaaccaccatggcacgtgtatatatctatgtaacaaacctgcaccttccacatgtatcccagaacttaaagtataataataattttaaaaagactctatctgtaaagaaaaaaaagaaagaaaaagaaaaaggtaaccttgtctgaaaatcttatttatttgtatgagattttcatactatactcaaatattcatccaaacatttgatttaaaaaaaccctctttctcagttttcagttacgtttaaacaagttaggcaaagttactaaatcatgatacaatgaagatcgtattacattttaaaattgctaaaatataaaaaagaacactatatatcttatttttgttacaaactcataatagatcaaactctataatatttagatttgtgacttctttgcatttaagtttgcaaaattccataaaaatacatcccacaattttgtttctagtcttatttcactgaaacaaatttaaacgatttttatgtagattagcaaaataaatgcgatttttatttcagctggaagttgggattattttttgtgagctggaagaagtgataatttactaatcactatactaaggggtcacttttgcaaagaaaatatttcttttacaccccattttaaaaatattattgttttgttgtatatgtaagttttctttggttattatatgtctactcatcttaacagtttttgctttacttatgaataagaatgataaagatcactgtatgcgtaacagctgaactgttgctcattttcctattgaatataacacgaaggaagagtttctaaagcattggaggaagcaggaaggagttgttctaacaaagtgatcatattcacaacgaggaactgttaaaactactgccaaagttcctaactgacatgaaaatctgatggagtcctgggggtagtaattttccctgtgagctctcttcaagaagtccctaaggaaagaatattgcaaaatcagaagttgaagagaaacatacagaaatattcaggttgtgtcttccatgcagaacatatcaaatagctaagagtctgcttaataaaagagaatcagaacaggtagattggaagaaaatctaacaaaagtcgatttgactttttgtttgtttgtttgtttgttttgagacggagtcttgctctgttgcccaggctggagtgcactggcacaatctcagctcactgcaatctccgcctcccgggttcacgccattctcctgcctcagcctcacgagtagctgggactacaggcacctgccaccacacccggctaatattttatatttttagtagagtcggggtttcaccgtgttagccaggatggtctcaatctcctgacctccgcctgcctcggcctcccaaagtgaagccccttggcactgcgcccgaccatttgactttttaaagtgttttaatttaacaacaatgtgtagctggctatatattggtaagggaaattagtgaagtcaaatttgtagttgaggagatcttttcttctgcatttccgcacattgctgtgtaaacatgagtgcaggtgaccgctggtaattctctattggaaacttggtgtcttcattctccatcctccacgtggctccgaagccctgctctgcctcaggtccctgtgtgtccaggccctctatggtcatattctctcacctacacttgggccaatgacatgaacagaattttgacagtttcacaaagcactttcaccttgtgggtgggttcagtttatttccttacaggaggatattaatattgcaggttctaaggcgagaggagctttgtgataagttaagaaataaggaatgaagagaggcaggggaaaagacttctgtgtgaaaatagaagaggcccattttaagcacataattttccttatttcaaagggaatacgcaggcaggttactgtagcagagtcacaaacaagccaatgtgacttaaaagtatgagtcatggggaaatggagtgacacgagatcagctccagggatcacgccttcactttgcctgccttggggactcagagatctgcttgcgggtttcctgactcctacgtgaggtgtcagtgaaagcagcagtgatgttaactttgaggaaatttggttattgtgacaggatagataaatgaaccgtatcggggtttcttcattttcgtaactgtggtgctaatgaggtattcagtatctgtggttgactgatttattccccaccagaaaagatgcttgggctgcagatttcacatttagaaaaaaacatgatcctttggaaaagttgccaccaattactcagtctccagtttcagtccatccacggaatgatctgtctatacctctgtaatgtactgcggccccagtcagccacttggcagctttgcaatcccatgacctttttaaatcctgaaaataaataaaattgtaacattcttgccttgttagctcttaaattttcaaatttctatgtgccaagttgttctgcttaataaatcaccaaggaggtattgtcatgatggattcgtattttatttttattttcagtattgtatgcagtttacttaaaaaagatttgtgaaaaaaagagatagcacttttagctattgctaaatgagatcaggaaattgtcttccaaataggcaagcacaaagctgaaaaaaaatgaacaaaatcatccatttccatactgtagaaattgagcaaaggcttaacacaaatttgagaggcacggatgcttaaaaactgtcgaacttctgggaaaaacgtgggaactatgtcactctggcctgggctgcccaccttgtccagggtgggacgaactgtagagggttttctgctgctggaagggcctctgtggctttggggagacggcagcgccagggcccgcggggcggcaggagggactgggaggcccacagcggtcccgtgggaaagctctgtagggacgggcaggagtgaacatgttgtgttttgtgggctacaaacaggctctatttcctctctgcctcctcctcctgctttttcttccacttttttttaacatttgtttttaaatggaaagtagtttttagctcacaggtcatacaaaagctggcaaacggctggcttcgaaccgtcctggcttcgaaccgtggctgccatgtgcctcccgctgctctactcgcctgaggttgaccctggtaagcggttgccgcctgcagacacggcgcatgcgagggagggtgcaggccgagactccgccccgaagggcgcggcgtgcccgagagatgcgagcgttgaggaaacggaaatccagcgcacacgtgaaaacgccccggactgcggctgcgccgcttacccgcacacagacggttggcagaggaagaaagccttgtcacactaaaggagagacagcggatgttctgaacagtcctgtcgtgaaacgttagacaacgtggacgaaacaggcacattcctaagcatcacacattactgaaactcagtcaagaagaaatagaaaatctgaatacatccatggcaagcacagaaactgaactaggggattcgaaatcttcccacaaagaaaagcctaggcccaactggcctctatggtaagttctatcaaatagtcacagaagaaatcatggcagttcatcacttactgttgatgtttcagaagatagtggactaaggaacaatcccaaatcattttacaaggctagtagtaccctgatagcaaagccaaagatatcacaagaggaaaaacatcacagaccagtatctctcattaacatggttgcaaaattccttaacaaagtattaaaaaagtgaatccagcaaaatataaaaatgattatatactatgacccgatggggtttatccaagaatgctgggttcatttgacatccaaaaaccaatttaatgtaatataccaatcacattcaatttataaaggactaaaatactccgtgattatctcaacagatgtaggaaaataattggacggcatgtaagacctatttatgatttaaaaaaaaaatcttaaaaaactggaaatagaacaaacgctttttaaactgacaaaaagaatttaggaaaacactacaggtaacatcatatctaatggcaaaagactgaaaatccccccttaagaacagtagaaagatgtctacttttattatttgtattcacaattatactggattttctagccattccaagaaaacaaccaaccaatcaatcaatcaactaattaaatgtatccaaagtggaaataaaggagtaaaactgtctttatttaaaaagaaaatgattctatatggagagaatcccaaaaaatccattaaaaaaatctagaactcatcaatgagtttaggaaggccttgggatacaagatcaatatataaaaatcaattgcatttttatatactagaaatacaaaaacacaaaaattaaatgaagaaaatttcattcacacatatgaaaatgtaaactttttggaaattaacaaaagaagatgacatctattgaaaactacaaaatgttgctgagagaaattaaatatgtacataaatagacatttcatattgatggattagaagactcaagatggaaattctctccaaattagtttagaaattcaacacaattcaaaagcccagcaggcttttttttgcaaaaattcataagctgatgctaaaacttatctgcatattccgacaacctgttaaaaacaaaatactgttaaaaacaaagaactacttgatttcaaaaattttgttaaagccacagtaatcaagacaacgtggtgctggcacaagcttagacgcatgcacatcaatggaaaataattgagtccagaaacaaattcctgcctttatggaaaatttacttttcacaaatgttctaaaacaactcaatggggaaactatagggctttcaataaaagcctgcccacacacacacacacacaacaacgtctacccctaacccaccaaacctgtgactatgttaccttaaacatggcaaaggagagtttgcagtgtgattaacggtatagatctagagatgggggggatcatcctggattatctgggggcagaggggccagtctagtgacttgagtcctcaagagaggaagggaaaggcagaagggtgggttaaaaagactcactatgagaagtacttcatccttcatttctagctttgaagatgcaagtggggaccatgagccaagcagtgtgacaggctctaagaagctgggaatgtctgtcagctgacagtcaataagaatttgaggaccttcttcttgcacccacagtaaattcatttctgccaacaaactgaatgagattgtcccctagagcctccagaaaggaacacagcttactgtcatgtttattttagtttggtgaaacccaacccagactttccatctatggacctataattaaaatagtttgggggcattcttagtccacaaatttagtccaaatttaataacaaatttgtgttactttaagcccctgagtttatgattaattcattaagatagcaatagaaatctaatacacaatgggatgaaaaagaaattaaagaattataaaaggatttatgtgaaccatgttaaggaagattatttaaaactaggaaaaaaggcaaaaaaagatgagtagtatgtcctttcaatgtcatattggaacactttatcaatttcaaacaaggattatttaatttcctataataatgcatttttacgttttgctaattggatttgattgacagctcaagttttaggaagtaacatgttaacttgacaggtttcatttcagtagaaaagatatttccaaaagttatggtttcattgccctgtagggtattagccagttttgtactaacctagcaaccctatgacaaaggtctatttttaaaatacctgtaaagactgtgtacttcacagactcttggaaatgctttatattctacctagtttgctcactcttgagctaacaagtctttggtgtatattaattttatgaatcatacttttaacttttttaaagcattatagctggacaaccataatgtattacttttaagaattctggataattttgagacatgccaaattagacccatcagtaaaaaacaagatttaataaatagaaaaataatgaatgaccatatgaataaatagatacagaataaacaaatggtacataaaggttgacaagaaaaagccttgatgattctggaatgttacataataatataggaatcaacttaggctgtcattttcaatatcttcattgctatcaatttatgagggattttgttagcattaatgtgatatacaatggaaatttgaggaaaaaaatgacattgttttaggtgaaaatggaaaatttaacaggaatataaggaaaaaaaatactcctgggaaacagtatttcccatacttaaagcaagaagacattctggtgaccaataggctcacatgctagttttgagagaatttgtgtggaaattgatcagtaaattttttctaaatgtcctagagactttaggtgatactttggatgatgacaggatttttaaattataatatttctgtagctacttctctttttaaagaaaaagatagcaatttttttctatctcctgggtagaattttgtagtttaacacatctctatagccaagagttcatttttttccctcagatcagatccttatgcctgtatctctagctctgatagaacttatgtttcattttaattatatattattacattgtccctcaaatgatggacaatgcattttcctgttaaattttaaaattgccttaattatgtagttgagggccaaggtactttacatacatcacaattataccagagagaaccatgatgcaatagagtgcaattgtgagagctagagtattgcctcattctgctactaaatttaaaatagtctgggggcactcagtccaaaaatttggctcccgtttcccactgttcctaactcagtttcttgtctcattttgtattctctgaccaaagttattcaggctaaatcagtattaggaaacaaagattagcaagtgaattgtacttttaattattcaatatgcttgtctgtaaaataaagctgaacaatggccgacttcaattcgtggttttaaaataagtggctaaggaaaagccaaactgctatgtggatttttttttcctctacccaagtttgtatcaatcccaggcactatcgtagctaccaatctggcacacgtgacacactttggggctgagatcagcattttacataaattttcaacccagccatccaacttgaaagacagaaacttccatctccagagtggttttatcacccatgaggaaagctggccccagagaagttaggccccttgggtctatggtcacacaagctgacattcagacccagttctgcctgaacccgccggctctgtccttcccattaaaatgagggaattgggaaacctgagttctggagctgctttgtgacttagagtcaatcatgttacctctctagatctttgtttctccaacaataagagaatatgacaaggctaagtcaggttgaacatctcttccaaacttaaacgcagatatgacacatagtgcagtgtttactatataaccatgttgtgcttatcctttgaggaaaaataatagaaattctagggccaaacttttcaactttttggcctgggtgacttgttttcctccttaaaaaatccatatcacagagccacctgcttccacagttaccatattaaaatcatcctaggattttaccactgatcttcatacatgtgtatttggactgagtcacattttgttgtaaaaataaatgatgtcagataaaacattgtgtttaaaataagtggtattaataatctctttaaaatgcatgcccatgaaacattaagttgtctgaaagaaatataatctgctttcaatatattttctcatttaagttgagcgttcatgtgttcaattcaccctaaatacaaaataattcttactttcctaagaatttttcatgaaagcatgttaggtaactggtaatgccaaaatgaaactaaggcactaagtaatagattatgataaaaagaaagaattcatgctgagggaaaaaaagaaaaagatgagattggacttaaaataagttacatggacccatttggagctgagtctaacaaaatatgatttatgtgcaaagcattttttgttacataatttatgaagcaaaaacgtggaacatagcatatggtgagttgatttggaagaggggatttaagcataatcattcagcctggggtttatgccgtgtttgaatatctgtcatacctctgcctggctcccatccccacatgtgacctcctgcatggtgagacttacatcacatcccacacactttctggactgttttgattattcactgttaaccttaaaaagtatggcttcctgttaggcacttttatttcatacaacataagttgtatgcagtgtgcttcaaataagtaaacaaccggcaggtcagaatagcttttatttatttgttttgtaaatcccagctttctctgggtcctcataaagaggagtaatagagaaatagtttctggccactctgctttattatttcagacatgcatggcctcctatataatttgcttattgatttcaataataaagaccaggaaattacatcctctcttgtctgtggagctatgaatcacagattgcttaaccactgtcaaattaaacaacttgcctgtgactgagaaaggattcatataaagactaaaatgatcatcagcctcccactaatccagtgtgtcccccatgttaaatgaagtcagcatcactctgggcagctgtgctgcctcctttgaggaaatcagcctccttctcaatcatttgtactgccacacagtttgaatcccggattctggaagattatgccagatacctttctctcctgggagataactgctcaaaaacaaagacacaattaaaataaaaattagacatgagcacagtggctcatgcctataatcccagtgctttgggagacggagtcaggagaatcgcttgaggccaagagtgtgagacaagcctgggcaacatagaggatcccaatctgtacaaaataaaaaaattaaaagaattagctaggcgtggaggctcatgtttgtagtcccagctacctgggaggctgaagcaggaggatcacttgagtccaaaagcttgaggcagtgagctatattcatgccactgcactctagtttgggccacagagtgagattctgtttctacaataagaataaaaataaaaataaaataataataataaaaataaaatcaaacaaaacattgaaagaactctggtttctgattatctaaaagctcccaactgataccggaaatactgttttctaatgctaacatttgaatacccaaggtctctcatagatttattgcatcaaatctctgggttaaatttagaatgaggttgatcttcaggagcagattctcattctaaatcacacaattgtatctagaggctgagtgtttaaagggacaagaccaacagtgggctctgggtgcccagccgagcaacctctagaagtgttttgctttttcagaaagcaatgaaggggcttaaaatcatttgtgaaaatgatttaaatgatttaagggttgaaagcaaaaaacaaacaaacaaacaaaaaaacctcatctgggcccagtattctcattataggtagaataatgatagaaattgcaatgcacaattttactgcaaattttgcttgaaagcagacaaatcatcttggaaaagtagatttgactccctgcactttagtttccttatctaagcctgagggtttgatgatgtcttcgatgtttttaggagttctaactgtatatattttaatgccaaaataatctttgtggccaatcttaattctacaatttgaaaatagttttaagttaaagattttaatgcgcttggataacctgcaaatttacatttaaacctgtttatgtaattattcactcacatttaaatgtggtaacttctgcccatgtgatcttaaattaaaacattctttgaagctagatgaatacttagcatgttaataacatctgatgagacccagatgaaagctggtatgaagtacttcttggtcaagaagttctctctctttgttaatgtaaattttataagtttccattacccaatgaacaaggtatataaattggatgagttcttcttttttgaattatcgtcaggttatacaaagaggaaaggtggaacattaaaaagaatgaaaattcaaaggacttgaatcattggtctgttagtaaatttgcaattttataaaccgcaatgatttataaactattcaaaacattaatatttacaagcaaaattatgcaaagcatacacaacttttgctgtcttgattagactgcatcttttgtctccaggtaaaaataacttttaaagttattttcaaaaaatatttattttttgatgcttaatttttagttgcctagtgaaatgattgctattcatatctaaaaggaaaacgaacctcaggtggtatgtcacagtgagatgtcattaagttattattaaaaatggcttatatgcaatttaaagccagcttccacgaatgactcttgtggtgaacaagaaaccaatatagattatttgtagaaataaatattccttgattcctagactcctataaaaccacctgaataatattgtgcactgactgtggaaggattttgataaaatgtacgtttttcatgtcagaatgaatgaattatgtgcatgatataaagcaatagctcccaaatttcccacaaaggacatcttttgttatcactgttttttttttttcatcagtatcagtggtttaaaagatatttttctattaccacgagatagccagcagtaccatattggctttctacaaggcatttttaggttgtgaggtgcttctgaggctaaagatatattacatttggctttttgaaatagtgaaatataaatctctaatagtctgagaagttgaaattgggaattactagtgtaaagaaaataacttataaacaaggcccttgattcaagtcttttccatgactttggttaactttatctattaaaaaaaaaactaggcaatttttaagtttcccttttaatgctaacatttcatattgtgttttcagcatcccacttgatgaaaattcctgttataataaattagccccttgaggttcctggaaaagcatgaagacttgatatcacctccttcctcccactctccatgtatacaaacactccaattgatactttctcttatattattatttaaactattttctttctgactctgcgttctatcttctgtcttgactttattcacccaagatgaccaaaaagacaaagatttgagctatgaggtaggtgtatgatacataggggaaaaacacatacatatataggttatatgaatatatgtatatctccatatatatatgttatatacccataaaatatgtaccaaattgctccttcaagctatatattagaccataaacacaattaaagtataaaacaaaatgaaaatataataaaggtttttaatatcaatgactggtataaaggcattcataaatagcattttaaagaaaaatacatttaaaataattaaaatataaaataaaaaagtattttgaaacattatctttaatgtttatagcctaaaatatattttttaaataaataaagtacctacattaaaaggtctaagttttttttaacaaaataaacacaggtctaaagaaaaaaggaaaacataaatgtataaaagagaatgtagcaaaataggaaataacaaagaggatcagtaaatataaaagttatttaccttccccccccaaaaaaatgaataaaatatacaagtctttaagccaacttttacagggaggtgctgtggtttgagtatatgtgtcctcccaaaattcatctgttaaaacttaatccccaatgtgataatatcaagagctgtggcctttgggaggtaattacgtcatgagggctccatgtttatgaatggaataacacttttaataagtatccttacttattaaagaaacttaagaggaactctttgcccttctaccatgtaaagatacagcaagaaggtgccatctatgaaggagaagacaagccctcaccagacaccaaatctgctgatgctttgatcttggacttcccagcctccagaactgtgagcaagaaatttctatttctatttcacccagtccaaggtattttgtaatagtagcctgagcaaactaagacaggaagaaaaaaagtatatatagctgtatcagaaattaaaaggggacataactacggtagaatatatacttatatatatatttatatatattttgacaatatatcaaaaatttaagttaatgcatttgaagaagataaaattaatacctttctgaaaatataattttaaagtattccttaaattacaaaatttaaatacaattatagaaattgaatcagtaatttaaattgccacaccccaagttaccacagatgtaattttgcagatgcattttagaaaactttaagataaaaacttttcattttcccttttttatttcaaagaatagaaaaatgttcctcttccattcgtggctaagcaaattcttattgaaccaacccttccacagatagcaactctaaacaaaatgttgaaaaagcaactacctgcaggcactggagagtgaaaataatgtgggagacactggagggaagttatgaataagataacagtagggtgtgactctccacttgttaactgcttttagaatgagagcagtctgcaggtgttgccacacaaagcaactaaaattcatatggaaacccatggacttactgacttgaaaggccaggggcaaagactcgggcaactgcagctgttggtaagtgaaggagcatattacaaagaagaaaggacaatcacagggaaacaattttgcataaaaagcagtctgaatctctagacttcaaaaggccaactaaggttttacccacacaggggagatagaatcagaagttcaagttcagctactgcttaacattttttcaataagaatgaaaatccttcagagtaacataatttagaatttagagtctctacaatgtatcacagtgttcaacaatcttatattacttggtatacaacagaacagaaaataataaacgttctcaagaagaaagaatgtcagagactaaccctgagaccatccagataaagattttgaagtagccattataactgtgcgcaaggatagcaaggaatagattgttaaaacaaatataagatagaaaatctcagcagagaagttaaaactattacaaatgaaaattagaaaactaaaatatatctgaaataaaaattttgctggatgagtttatcagcaaaatagagaagacagaagaattagtgaacttgatgactcctcaatataaaatatccaacctgaataagaaggaagacgattcagaaaaataaataatagaacctcagagaactgtgggacaatatcaaaatgtcaagtgtgtgtgtgtgtgtctctcagaggagaaaaaagagacaataaagcagaaaaaaattttgaagaaataatgtctgaaattacacaattgtgatggaagacataatttacagattcaagaaactcagtgaaccctaacaggataaagttatacatatgtacatactcatgcacacacacagaggccttaatacatcatagacagactactaaaaaccaaagataaagagaacatctagaaaaaagacagaggaaaatgataaattccatataagtgaataatgatttgaataacctcaggcttctcatcagaaatagtgagagccagaaaaaaaaaaaaaacaacttttttaaaatactagaagaaaaaaaatgtcaaccaagaattctatattcaatgaaaatatcctttaagaatgtagataaaatgaagacattttcagaaaaatgaaataaactaatctctactataagaaatgctagagggagttcttcaggctaagataaaactataaagaaacatgaatctactggaagaaataagatgtattgcatttacatgtgttacaatccctgtaatattttaaaattagtattatagggattatagcacatgcaaatacagtacatatgacaactagagaatcaaaactgagggtgtggtgaagtgatcatgcacttgcaggatttgtacactgtatacaaagtggtttagtattaactgtgtaaactatgaggaggtaaagattcattgtaattataggaacaaccactaaaaaagaaaatagctacaaaaataaaaaaattaagtaaaagaaaataaaattcctaaaaaatttatatattccaaaagaatgccaaaaaggagaaagagaagtacaaaaacaaagagacaaatgcaactcataataggaaaatgatagatataaatccaactatatcaagaattacattagatcatcaatcactccaattataaggcagaaatttttgtaagaaataaaaaagcaagattcaactatatgctatctacaagagaaacatattaaaaataaagaaatagaaaggttttggttgacagtaagtatacctaccatgcaaatagtacacataagaaggttggagtgtttatggtaaaatcatatagatttcaagataaggaatattaacagataaaaatgatgaaagttttgtcaggaagacaaaacaatcattaaagtatatttatcaaaggatagaagagaatgaaaaactactcatatccttaaaaagattataaactatactgaaactagtcaattttaagataagaaataagatgacaatctcacatagtatatatacaaaaattttcaataagctatcagcaaattaaaattgtcattataataaaaaattatagcaagaagtgttcatctcagaaatataaagataatacatcacaaaacataatacaacacatttacatattctttttttttttttttttggggacagagtctccctctgtcgcccaggttggagtgtagtggcgtgatctcggctcactgcaagtttcgcctcccaggttcacgccattctcctgcctcagcctcctgagtagctgggactacaggcacctgccaccacgccccactaattttttgtatttttagtagagacgaggtttcaccatgttagccagcaaggtctcaatctaaacaaaatagtatgtttataatggcaaaattaattttaaaaatttaatactgactcatcaagaaaaataacaacaaaagaggccattttcaaagcaggaagagaaaggattttttttccccgagtaagagtttctagtaaaaactttaacatacatcagacttaatggtgacaggttagaaaaagtattcccattaaacatatgaataagaaccaagatgtctgcaatgttccattatgttagacattacattggaggtatgtgtaaagataaagattttatgaggagatattccaaagacagatttgtgattctttggatgtggcactgttgaaggtgaatctaaaagcttttatggagcaatgtcaaatttgtgagccacacggagatggagatgagattataatacacttttatatgtactatcatagatgtaaaactctctatcttaatattaactttgaaaatgttaaattgagaatcctgttaacttacattttatgaattggcatattgtattactgcaagatatatttgattttcagcataatgccaaaacaaaagattttttaaaaaactataaaaatgcatatatttttctaaatttattttgtcttaaagcacactttaaatgtcatttctcattgagcaaaattgtcaaatttctatggaaaattttaagataaaaagaaataggcaaagaattggaaagagacaaaattgacaatatttatatccaatttaatattctaagtatataatccaagaaaccatacagataagttactaaaacttgtaagaagatttgatatagttgccagattactatataattgaataattatatagaaaataagtagcattctaagtgcctttaataatttaagaaggacttctgcttatagccacaacaaaatagccagaactggattaactgtcccagctaaaatcactaaaaaataatcaaaatatatgtttttaaacacagtttcagactttggacaacatgtagcccaggacagtgatccctgagaaaaggaagacaaatgaggtgacactgtgatagacccagatcaacgcctggaaaaagtttcaaagctacaatgtgaggagtggggacaaaacagtctagtggctttgctgagtggagaaggcaagtactggagtccaggcaaagtattggtgaaggtggagccctggagaaaaagaactctagagatctgtaagaggctctccttgaaacttctactgagcacagttctgcacatgcatgtatagaatttactcaagatgaagaaagaaccaacgaaaaaaagcatagtataatgctgagaactcataaaatcgagtaggaaatcttgcctattgaaagagcattgagacagagtcctcagaaggaattttctcagtggtgggaacaaattagctataaacccaagtttgctctgatattgctataacaaagcttaaaagcaactctcaaaaggctcaaactgagtacaaaacatctaattgtaacccagggtacttcccaacagtattcaagggaataaaatattttgtgtatattttgtattacaggaatatattgtattcctttatatagcatattgtatttctttatatatgaaatgatatatcatcctaatttagagcatgaagttacagatgtatattataaactctagaacaaccactaacactattttagaaagctataaatgataagcaaatagagataaaatagaatgataaaatataatcaatccagaatatgggaagaaaaagaaaaagggagcaaaaaaaaatgaaaaaaatgaaacaaattgcaagatgacagatttaaacctaatcatattataaccacattatatataaataggctatatactccaattacaaaacaaagattgttgaataaaaaagtaagacccaactacatactttcagcaagaaacccacttcagatataaagacataaattcagtaaaactcataagtcaatgtcataaatacatatatataatatgctcgcactaattaaaagaaagctggaatgactgcattaatatcagaaaatgtagatttcagagcaaagaatagtaccagggataaagaggctgaattcacatattataggggtaaaatatttgagagaacataagattagtctatgtgtatatctgatagcccagcttcaatatatatgaaagaaaaattagtggaactgagtggctagatatacatatctacaattgtatttgcaaagttcaacaacttattcttaatcattaatagatcaagtagagaaagtaaggatttacaagaattgaaaacatcaccaaccatcttgacatttatcgagcaactccacccaacaagagcaggaggtatattcttttcaatttcccatggaacattgaataagatagatcataaaacaggtctcagtaaatgcaaaaacattaaaaccacacaaaagaacggtccatgtccacaaatgaattaaattagaaatcaatagcagaatattttaaatattcatccatattttcaaaccaaacaatatacttctaaataactcatgggtcataaaagaaatgacgaggcaagtcagaaagtattttgaactgagtggtaatgaagcactacacatcaaaatctgagggacagagataggtaatgtttagagaaaaaatcataaaattaaatgctcatattagaataaaaagtttgtcaaatcaatcattttgaagcctgcatcttaagaaatgttcagtcttcaagatggtggaatagaacctttcagcagttgtcatcaatgtgaacaactatccacacttgaagacacctttgcaagcattaaggaatccaggtgagagactatgacacctgagtgtagtatggaactaagaaatgcactgaagagagtggaaggacagtttcacatgacccatgtcacccttttccatgcccaggcagcacagcacagagatgccctctgggtgggaaagtagagtgatgtcaccacctgactttgtgtggagcccagcaccaggtacaccccagagaaacccagtgctgggctgattccagcagccccaggatccagattagcctctgtagatataggctgcaggcttgcccggcatcaagctggcccctgttgccccagactctcggctggttgcaatggccacatgttcccagctgacccagtccccaggcccatgtcagtgccagagacctagccactgcggacctagccttcaggccagcatccacagatgcagtctcttggccaggctccatgtacccaggctctatgctagccccatagtctcatgtactaggccagcactcatggacacaggcttgagactggcccctgcagacccaggttcccaggcctgtcccaggaccaagacagcccaagctccatgtcagtccccacatccacaggcttcagtggacccaaggtccagtcttgctccagtagattcagagtgcaggctcacctcaaagtcagcagaaggaaggaaataataaatatcagagcagaaataaatgaaatagatagtttaaaaatcagtgtaaatatcaatgaaactaagagatggttttttgaaaagataactaaaattggcaagtccttagctaaagaaagagaaaagactcaaacaactaaaataagaaatgaaagaggaagtattacaactgacaccacagaaatacaaaggattataagagaatacattagccattagccatataacagcctgagccattatacattgccaacaaattggataacacaaaagaaatggataaattcctagaatcatacaacccaccaaggatgattcatgaagaaatagaaaatctaaatagagcaataatgagtaaagagattgaatcagtgatcaaaatatctctcaacaacaacaacaaaaagctcaggtcctgattacttcactggtaaattctagcaaacatttaaggaagaattaatatcaattcttctcaaactctcccaaaaacttgaggggaaagaaatgctatcaaattcaatttacaaaatcagcgttattctaatataaaagccagacagggacactgcaggaaaagaaaattacagaccaatatccctgatgaacatagatgcaaaaatccttaagaaatactagaaatccaaattcagcagcacattacaaagaccattcatttaggtgagatttacccttggatgcaaagatggatcaccatatacaatcaataaatgtgatatactgcattaaccatatgaaagataaaaatcatatggtcatcttaatatatgcagaaaaatcttttgaaaaacatcagcatcttttcatcataaaaactcttaacaaattaggtatagaaagattatacttcaacattatagagatcatgtatgacaagcccacagctaacatactcaatggtgaaaaaggtgaaaaactaaaaatttttcccccaagatagggaacagaacaagggtacatactctcactacatctattcagtatagtacaggaagtcctagccagagtaattaggcaagaaaaagaaataaaaggcatctaaattgaaaagcaagaattataactgtctgtttctgcagatgacattttttatatagagaaaatccctgaagactccccccaaaaactgttagaactaataaacaaattcagtaaagttgcaggatataaaatggacataaaaaatcagtagtaatttatatactaataacaaactatctgaaaaagaaattttaaaaaagatctcatttacaatagcatcaaaaagaataaaatacttaggcatacatttaaccaaggaggtgaaagatctgtatgctgaaaactataaaactttgattcaagaggctgaagaaaacacagataaatgggaagatatcccatttttatggattcgaattgatagtgttaaaatgtccataccaactaaagcaatctacatattcaatgcaacccctatcaaaattccagtggcattttcctcagaaatagaaaaaaaattctaaaatttgtgtgaaaccacaaaaaaaagtcaaagcaacatggaccaagaagaacaaagctggaggcatcacaatacctgatttcaaaagatactacaaagctatagtaactcaaacatcatggtactggataaaaacagacatgtagaacaatgaaacaaaatatagagtccagaaataaatccatgcattttggtcaattaatcttcaacaaagatgccaaaagcatgcaataggaaaaggacagtctctttgatgaatggtgatgggaaaccggatatcatatgcagaagaataaaattggactcatcttacaccatatacaaaatcaactcacaatagattaaaccttaaacttaagacctgaatctttaaatttattagaagaaacaataggaaaaaagcttcttgacatagaactggccaaagatttttttgatatgacctcaaaacacaggcaataaaagcaaacctaaacaaatgggattacatcatactgaagagcttcagcacagctagggcaacagtcaacagagtgaagagacagcctatagaacaggagacaatatttgcaaacatacatctgataaaggattaatatccaaaacatacaaggaactcaaataactcaatagcaagaaaacaaatcactggattaaaaaaaaaatgaacaaaatatttgaactgacatttctcaaaaaaagacaaagggccaataacaatgtgaaaaaaatgcttattatcactaatcatcaggcaaatgcaaattaaaatcacaatgagataataacagcttatatttgtattctgtatatataggccaaacattgtttcaaaagctttatgtaaattaagccatgtaatccctacaacattccaatgaggtaagtgatattactaccattttatagagaagttaaataatttgctgaaattcaaacagcaaatcagttgacagtcaggattttattctaggaagattggtagtcatttcacaaaagagaaaacagaaatggccagtaaacttaaatatatactgtctcaaaaataatatgagaaatacaaaaagtgctgttacaccatgtgctagcaatgatactaagaaatgaaaatgcttacacatggctggtgtgaaaatacattaagatgacaagaaacatagcaaaatgcaataaatttgaacatgatatattttcatccaagcaattttactccaagaagacaagaataaaaacatattgtagcgtttttaacttgtaacaaaatactgcaaataatctaagcaccctggactggacaagtaaatggacaaaaaaaaaaaaacaaaaaaaacaaaactcatggcatattcataaaatggagtaatgtgctaatagagataatatatgaacttgcagtacctgtaccatttcagatatgctcaacaatatactcaagttaaaaacacataaggttgcagaatgatgctaattttgtaaaactaggaaatctcaaagcttattctactgattgattctgaaacaggaagtaaaagtataagaaacattcgtgagaataacagacatcaaaccaaggaatgtggctccctctgaacagggcagatgggaatctctattagagaaaagtcacagtacacttcttcttcatgcactaatgggttgggatttgaggttttaagataataggacttgattctacttgaaggatgaaaattttcttccaataagatgactttaccctatttcttgtgaagtgatctttcttgatctgctttgtattttaaaccaggctcacacccctttattaactgaagctgacttaacccgaactatctgaagctgactcaacccgaactatccgagatcacacgtaaatgttttccttctgatctcaacttttctccttatcgtggggcatggaaaggaggagatcgcagcagggaagtttttgttcttgttcacatgctaacaatggtaagcttcttaaaagtgaatcacagtagcatcacagagtttggacaggtgatgtaactaggagctacgaaaattgagtgccataaaagaatcatctttaaatactgaagtgcttctgtatgcttgaattatacagcatttcctgtttcaaagcagtttcacacaatctcatttaacacttttaaagtcatagtagttgaaccgagtatatcgcacccctgttacggctttttcttgattataggacaaaatgaaaagaacttttatgatctggctccaattatactttcaaggttcaagtcttcccatccggtaagatttttcttctttacaaaatgccccaactgaggcactcatgtactaggcacaggagactacctgtttgaaatatcccttgcttctgctggaaatgctgttcccacactgaactcatgtgccaactctcagctcaaaagtgcatgtttgtctctaccagtggactaaggaccagctcctaggatgggagcagtttcttactcatgtttataaagtgctatgcagaaaatagcagggctatgggaaagaaagagaccaggttagaaaagtcatttgaatcggatctgcatgaaaaaaggcactttagataagacctgatagcaaagggctgtaagaggagaaaagggcaaatcaaaggtaccgacagaacatattaagcatggcctaggctgagcaaagccaaatttaaacataattttgtatgttgaagcacattattttccaatatgttaatgtgtagccattctcacatacataataaagctaatggattatttattcaattgtatgttttgttataggagcctctgtcattaaaaagaaaatttattttcgtatctgggaaaagttgccaaggcaaaaaacacacacctggccatgcatctttagtttgttattgtttttaggtttatttgaaacttacaaagtgaaaaaaatcaatgacttctcagaaaaaggaaaaaaatagatgtaggtggaagagaaagaatacataggattataataggtttggcgaggatctcatgttgctgaagaaaacgagtcttgggattctttgtagtgggtcttcagaacaggcaaagaaatggttacgagtgaggataccagaaggagaagaaaactagaaatttgaatagaaagttgaacaaaatgaactttggataccaataaccttcagtgaatgggtgaagaagaaaaaacctttctctagttctgtttcaaaggcagtaatgaatagaatagcaaaagttaagcatgaatgaaatccatatttatctattttttgaaaggtaatgcatgtcttattttcactgcattatttccagagcataataatttcagcctaagttaactttcaatggtcagtctttgctgtccagcactgcattgctcaggagattcattaatcaatcaatcgatcaatcaatcagttccttctgtttctttcccacctggagctctgctgtcagagttgcacatgtgagtgagatgtagctcacttaggaatccatgcctgcagctaccctgggagctgactgccagtctctgctcagaggcccttgttcccacaggcatttgctctctgctgtgtaatttatagtttaagtcaaatgattccaaacacagtctctaacatttgggtaaaatctgtctagtactttcttgtgacacagaaacatagagggaaaatattgctatatttatgcaaatatagaatctttactctgaggcttttcttaaattcacagtcacccatatgccaagtggatttactgttcattactcagtgtctttactgtttgtaactcagatcacgttttccttcacaaagcctgcttactgaatatttgtgtgatgatttgaactcaattagctacttattgctaggttatattttcccctttgcagcaagcatgtcaaagattatacatttttttaacagattgcttttaattgtattagttgaagagcagtctttatatgtaaaatagtgaattatagttaagggaccaagggccattgtgtcttaagttttaattgttcaatagatcacctaatagtttttaaaatttttataggaatgtctgatcttatccacaaactttaacaaatgggcataaaaatattcctcccttaatttttctgacctgcactttttctgttttgtttttgtattttttattttgttggttactccacgtcattggttacttcatgtcaggattatttgcagcaatcttctgtccttaatatattgatgttttgggggcttctaacctaagctctattctttttccattctttaaattctccaagtaatcatacattcagttggctttgattactatgtatattaataattctggccaggcgtgttggctcacacctgtaatcccagcactttgggaggctgaggtgggtggatcacgaggtcaggagttcgagaccagcctggccaaaatggtgaaaccctgtctctactaaaaaatacaaaaattagctgggcacgatggcgggcgcctgtaatcccagctactcgggaggctgaggcaggagaatcgcttcaacccggcaggcggaggttgcagtgaaccgagatcacaccactgcactccagcctgggtgacacagcaagactccatctcaaaaaaacaataataataataataataataattccaacaccccatctctatgtccacccatttcttttctaaacttcaggctcaactgcttgttcaagctctccattgtttacctcacaggaatctcaaggtaacttgttcaacttgagtgtctctggacctcccctctctactggcttctctgcaaacgtttttcttggtgagtgcatctgctttcccagctgctcaaaccagatttctagggctctccctttgctgtttcccatccgacactccccatcctggaaatcacatagctttgtcaatttcatcactagaaacaccagcccctgcccttctgtcctaccggcatcactgtacagcatgctactctcatctcttgtagcctcattgcagtttacctccctgtttctaactgggccctgctccaatccactttccacactgtatccaagggatctttgtaaaattctaatctgattgtgccattcccttgttaataccaatcaataaattcccaaagttcttaagtaaatctaggtaagttgtttataaattccttcatgttatcatctccatttacttttttatcctcgtttctacccaaccaaaacacctttaagtgcaacagtcccacagttctaaattacattcattttttatggtatgctatttctcactttcagcatttctatttgctgttgattctgcccagaatgccgtggacagtcccctctccttgcctctcatgctcatttttaaccagcttctactcatctttatttttcatatatcgtctcagatatcacttcttctgagacacaatctttagggcctcaaagctgatctaggtgtccctcttatgtactttaatttcttgatcacatcaaatatagtactgaaatattatttttcagtgatgcttaacactggttctatttttctttttcttttttaatacttggaaaactttcactaactaacttactatcattgagtttcttgactggggtcccatactttttttaaaggtggatattagatttggaataacctcatgggtgattccaatacatctttggggcaacatctctgactatacattgagaaacactacttattgcaattcttgtttatttatttatattctacattagcctgtaagctagctctatcagggttgtgcctctatttaaaaatcttactgctgtatcccccgtacttatcaggcactttgcaagtaacaggaattcaacagatgatggagtcattgaatgaacagcttttgtcaatgaatgaaatgttcaggagcactttctttctttctttctttctttttttgacggagtcttgctctgttgctaggctggagtgcagtggcacaatcttggctcactgcaatttccacctcccaagttcaaactattctcctgcctcagcctcctgagtagttgggactacaggtgcatgccaccacacccagctaatttttgtatttttagtagagatggggtttcgccatgttggccaggatggtcttgatctcttgacctcatgatccgcctgccttggccccccaaagtgctgggattacagacgtgagccacagtgctcagctgagaaggagcactttcaagggaaggaaaataaccctagaaatgtcagatttgtgtctacataattaatttctactgttattccaggaatgtgaccaaaatttattagatctgtgcttaagaacagtaaagaacttaaaaattatcaaaagccttaaaatgtgcatacagcaattctaattctgggaatttatactggcaaaacataaaaattagcattagtatttaattaccttgagtttttataatggtaaaaattgtgaatgacctaaatgatcaataatagaggattgatttatgaacttatggtatatttatacaataaactataatttagacattaaatcatatttttaaatgttatgtgtatttttttaaaaactttaagtatattgaaggtttattacataggtaaactcacgacacaggggtttggtatacagataatttaatcgcccaggtactaagccttgtagccaatagttatttttcttaatcccctccgtcctccctcctccctctcttcaccctcaagtaggccccagtgtatgttgttcccctcttcttgtctatgtattctcatcatctagtgcccacttgtaagtgagaacatgtggcatttggttttctgtttctgtgttagtttgctagggatagtggcctccagctccatccatgtttcagcaaaggacatgattgtgctcccttttgtgattgcatagtattccatcgtgtatatgtaccactttttttattcaatctgccattgattccacgtctttgctattgtgaatagtgctgcaatgaacaaacacatccatgtatctttatggtaggataatttatattcctttgggtatatacccaataatgatattgctgggtcaaatggttgttctctttttagctctttgaggaagtgccacactgctttccgcaatggttgaactaatttacattcccaccaatggtataaaagtgttcctttttctccacaacctcaacagcatctgttattttttgacttttagcaatagccattctgactggtgtgagatggtatcacattgttgtttgaatttgtacttctctaatgatcagtgatactgagctttttttcatatgctttttggctgcatgtatgtcttcttttgaaaagtgtctgttcacgtcctttgctcacttttgatgggattgttttctttcttgtaaatttgtttaggtgtcttatagattatgaatattaggcctttaacaggtgcatactttgcaaatattttctcccatcctgcaggctgtttactctattgatagtttttctgtgcagaagatcttaagtttaattagatcccatttgtcaatttttgcttttgctgtaattgcttttggtgtcttcatcatgaaacttttgccatctcctacgaccagaatggttttgcctaggttgtctttcagagttttgacagttttgggttttacatttaagtcttcaatcatcttaagttgatttttgtacatggtataaggaaggggtccaatttcaatcttctgcatattgctagccagttatcccagcaccatttattaaatagggaatcctttccccattgcttgttttttgcagctttgtcaaagatcagatagttgtaggtgtgtggccttatttctgggttctctattctgttccattggtttatgtgtctgtttttgtactagtaccatactatttgggttactgtagctctgtagtctagtttaaagtggggtaacatgattccttttttgtaatagttttagcaggaatagtaccagttcttgtctgtacatctggtagaattcagctgtgaatccatctggtcctgggctttttttggttggtaggatatttattattgtaaaatcatattttagaagtgtatctactgatatgcatttaataatatataatagacaaaaaagattaccaaaaactacacacataatttcatttgttaaatttatattttatacatttaatatattatataagaaacagtgttcactgatatgtacaatcatattcataatttttatcaccctagcataagataattttgtatattctctttctgttttttggttttagtaattattatttttttactctgaaagtgtgtttcacaaattacaaaatgttcctaaatattaaagtatgtggaaactaaagagaagtatttgctcaaatttttactgaaatcttcttcatccatcacttcccactaacccagtgtttttctcaggaggcccacacaattgcctattatcaagaaaagatactttcaaaaaaactgaagggagcggttatatgctgtggcacagcaatttcaatataagttgtggatatttcccaaagaatagtgtcttgttcatggaaatgcactcttgcttaatcagatgatgacctgggatatggtgttaactagattaaaaaaaaggccatctgtgcctgaggctcttctggtaggaaaaacttggagcttaaattgttttcattactagaatttgcatgacagtggtttttagtaacatacaaagaaaaacatggtacttaaaaatactatcaaaatacttttcttactttaaaagaaaaaagttctacttttttttttttttttttttttttttttttgagacggagtctccctctatagcccaggctggagtgcagtggcgcgatctcggctcactgcaagctctgcctcccggattcatgccattctcctgcctcagcctcccgagtagctgggactacaggcacccgccactgcccccagctaattttttgtatttttagtagagacggtgtttcactgtgatctcgatctcctgaactcgtgatccgcccgcctcggcctcccaaagtgttgggattacaggcgtgagccactgcacccggccaaaaagtactattagatagtgttactaaatattaaaaggaacattgtaagaattcttacacatcttatagtgtgaggaaaatatcctcttattcttaattgtgttattttagacttactgcctttacattttaaacctttcctgacacttttttttattatgaatacattagtgttatgtactttaccaaaattattgctttagggtaaaaacactattgaatagtttagactaaggaattttgaaggctcattagttttgttcatataaattgcctatgaaattagggattcctgaaaggatagtggtatcttttgagtcaattgtgttgtcagaaataataataataataataataacttcacaagcccatgcttcggatcctagctctgcagccattctgtgacctcacaggcgttggaccctacagtcactgctatagaagtcacatctgcatcacagaccttagagcaatggttgctccacacaaacccacattctggaccccggttccataacagctctacatgtgccagtgcctacaacacaagagccactactgctttagaagcacccatgccctggaccatacagaaactataggtatccacatgcctttgtttcagaccctggctttccagctgttccataagcatctgttcattgcacattgagaccaacactggagccggggtgcctgcatgttaagcaccagtgccactgccaccatgaacataaccatgaaccaaacccaacaccaagagggatccccttggccatgacttcccacacgggagaacaagaaatcaggagggctcctaccaccttcaccaactcttaacccaacagccctcaccaccactgtggacatctgcagccttggccactgaggacccttgcaatcttcaacggatggaaatacacagagactatgcttttgtatcttcactggagctggaattgctgcatcccacccatcagtaccctcataccacctgtaggtgaaggactttcctcacagaaagtagcctgtaaattctggaataggtgactgccccagcaaatatgcagacatcaatgcaagacaagaaaagcagaaaacatcaagaaaacatgacactaccaaaggaaaaccataatttccagtagccagtcttccataatggagatctacaaattgtcacagaaagatttcaaaataaatgccttaagaaagctcaagctacaagcagactcaatgatatcaagaaaacaatacatgaaaaaaatggggtaaataaagagatataaataattttcaaaaacaataaaacaaattctgaagctgatgaatacaatgaatgaaatgaaaaaaatacaacagtgacaaagcagacttgatcaagcagaaaaaaaatttgcgagctcaaagacaggtaatttgaaattacccagttaaaggaagaaaaagaaaaaaagagtgaaaatgagtgcagaaagcctataggatttatgagataccatcaagcagcccaatttacacattatgataatgtaaggagaagagagagaaaaagaaataatatttaaagaaatagtggctgaaaattcctgaaatctgaggaaatatatatacatcaggatacattaagcgcaaaatttcccaaacaaatttaactcaaagaggtctccactgaggcacattataataaaatttttaagtatcaaagaaagagagattttgaaagcatcaagagaaaagagactcttcacataaaggggaaatttcattagactacagatgatttcttagcagaaacttttcaggccagaagaataggctgataaatcctaagtgctaaaataagaagagaaaaactaccaaacaagaatactttactgagccaatctgtccttaagaaatgaagaagagataaagactttcccagaccaaaaaacaaacaaacaaacaaaaaacaaatgagggagtctgttaccacaagacctgccttacaagaaagttctccatgctgaaatgaaaagactttagtaagatgaaaatataagaaaatataaaaatcattagtaaaaataaatacatagtcaaattgaaaatattcaaatactataatagtgataggtaaatcactcttaactgtggtataatggttaaaagacaaaagtattttttaaaactatagttaatttttcaataaacatacataataaaaatatgtaaactgtgagatcaagaaacataaaatatatttagggggagtggaggaaagaaagggcagagtttttgtatgtgattaaggttaacttgttattagtataaaatagactgttataaatctaatgtgttttgtgttagcctcctggtaattgcacaggaaaaacctatagtagatacagataagataaagagtaaggaatcatcagatatcactacagaaaatcaataacaaaggaagtgtacaagagaggaagaaagaagcaaaagaactacaaaagagacagacacaattgaaaaaaggcaatagtaagtccatgcctatcaatacttactttaaatataaatggattaaattattcaatcagaagacatagagtggataaaaataaacaaatgtgcacatatgcacacacccacacaaaccaaactatatgctgcctacaagagactcacctcagctttaatgacatttataggtcaaaagtgaagggatggaaatggaaatggaaaccaaaacaatggagaggttgctatacttacatcagacaatacagactataagtccaaaactgccacaagagacaaagaaggtcattatagacagacaaaagaatcaacaaatccagagtatataacaattgtaaatacatacgcacacaacattgaggcacctacatatataacataaatattaccagaactaaatggagaaatacacaacactacaacaaatagtaggtaaattcaacaccttcactttcaacaatgaacatactttccagaaacaaaattaataaacacattggatttgaactacactcagaccaactgtcctaacagacatatgcagaacactccatccaacagtaactaaatacacatttttttcaagtgcacattaaacatcctccaggacagatcatagttgaggcaaaaaaaaaaaaaaaaaaaaataggccatagcacaggtaaaaaaattgaaatcatatcaagtatttttccaaccacatgatatgaaactagaaatcaacaataagagaaaaactaaaaatttacaaatatgtgaaaattaaacaacacactcctaaacaacaaatgagtcaaagaagacatcaaaagggaaataaaaagattgtaaaacaaataaaagtaaaacataccaaaacttatgggatgcagcataagcagtacaggaagtttacagtaataaacacctatattaagaaaaaagaaacatctcaaataaataacccaactttacaccttaagaaattagaaagaacaatctatacttaaaatcagcagaagaaaagaaataataaagatcagagcagaaataaatagatacttaaaaaacaatgtaaaggatcatggctaggcacactgactcatgcctgtaatcccagcactttgggaggctgaggtgggtggaggtcaggagttcgtgactaacctgactaacatggagaaacccaatttctactaaaaatacaaaattagccaggcgtgtggtgcatgcctgtaatcccagctacttgggaggttgaggtaggagaatcacttgaacctggaaggcagaggttgtgttgagccgagtttgcaccattgcactccagcttgggcaacaagagagaaactctgctcaaaaaaagaaaaaaaagtgtaaaggattaagaaaactaatacatgttttttgaaaaatttaaaaaattaacaaactttcatttaaattaactgagaaagaaagagagaagacccaaataaataaaagtacacattaaagaggaggcctttaaatgatatcacaaagacacaaattactgaaagagactattatgaacaattatataccaacaaatttgataagctagatgaatttgggtaaatttctagaaacacaaaacctaccaaaactgaatcatgaagaaatagaaaacttggacagactaataataactaaggaaatttaaccaataataaaaaatcgctcaccaaagaaaaacccaggacctgataaaatttactatttggtagacctcactgttgaattcaacagtgaattctactgaacatttaaggagaattaatgtaagtcactttcaaattcatccaaaaaattgaaagataaagaaaattttaaactaaggctaatattaaggtattaaggctaatattaccttaataccaaagccagataaagacacgaaaatataaaattacaggccaatatccctgaggaacacagaggcaaaaatccttaacaaaatattagcaacctgaatttaacagcattaaaaggatcacatacctttatcaagtggtatttatctctgagatgcaaggatggttcaacataccaaaatcaataagtgtgatacacattaaccatatgaaaagtagaaatcatatgattatcttatagatgcagaaaaagtatttaacacaattcaacattgtttcatgataaaagctctcaacaaattggatatagaagaaatgtatctcaacataacacagtttatatgtaacaagctccaaaataaccgtatactcaggagtgaaaaggtggaagtttttcctcaatgatcaagaacaaggttgcccactctcaccacttcaacttaacatagtactagaaggcttagttagggcaattaggcaagaaaacagaaaaaaaaaaaggcatctaaattagaaaggaagatgtaaaatagtctcctgttgcaaatgatatgatctatatatagataatcctgaagactccaccaaaaacactgttaggactaagaaacaatttcattaaggtttcaggatacaaaagcaacatacaagaggtagtaatatttctatacactaactgaaactgcttgaaaaataattttttaaattccatttaaaatagcatcaaaaataatatatttggaaataaatttaaacaagaaggtgaaagatctgtacactgaaaactataaaactttgataaaggaaattgaagaagatgcaaataaataaaaagatattccgtgttcatgatttggaaaaattgatgttgttaaaatatctacactatccaaagcaatctatagactcattgcgttccataccagaatttcaatgacatttttcacagaaatagaaaaacgattctaaaatttttatggaaccacaaaagacccctaatagctaaagcaatcttgagcaagaagaacaaacctggaggtattacactttctgatttccaattatgttacaaagatatagtaatcaaaacagtatggtattgggataaaaattagacatatagatcaatggagcagaatagagagcttagaaataaacccacacatatgtggtcaactaattttccacaaaggtgtccagaaaaaacaatgaagaaaatacagtgttttcaataaattatgttaggaaaactggacatccacatgcaaaagaatgaaattagacacttatcctacaccatatagaaaaatcaactcaaaatggagtaaataattaaacttaagacccaaacccttcaacttctaacagaaaatacaagggaaaaactccttgatattggttctggctatatatgtattttttggttacaacccaaaagtttcaggcaacaaaagcaaatataataagtggtactacaaaacactgaaacatgtttacacagcaaagaaaacaatccagaaaatgaaaaggtgacctacagaatgggggaaaatagttacaaaccaattatctaataaggggttcatattcaacatatgcgatagcccctcaacccccatccatagtttcactttccatggtttcagttacccatggttaactgcagtctgaaaatattaaatgggaaattctcaaaataaacagtttataagttttaaattagcatgatgaaatctcactctgacctgctccattctgtctgggatgtgaatcatctttttgtccaacatatccatgctgtatatgatattcatcttttaatcatccacatggcctgctcctgacatccaaccagtaacattatcatggctcaaagatcaggaacacccacagcagatgatcctccttctgacatatgatcagaagatcaatagtagcctaatgctacatcacaatgcctgcattatttacctcacttcatctcattaggtaagcattttatcatctcacatcatcataaaaagggtgaatgcagcgcaataaaatatgggccaggcatggtagctcacacttgtaatcccagtactttgggaggctgagattggtggatcacttgagcccaggagtactagaccagcctggccaacatggcagaaccctgtctctacagaaaatacaaaaattagccaggcatggaggaacatgcctgtaatgctagcgacctaggaggcaaaggtgggaggatcgcttgaacccagaaggcagaggtttcattgagcccagatcatgccactgccctccagcctgagtgacagagtgagactctgtctaaaaaaaaaaaaaaaaaaaaaaaaaaaatttagagaccatattccatattcccataattttaattacagtatattgttataactgttctactttactgttagctattgttcatctcttactgtccctaatttataaatcaaattgtatggtaagtatgtatgtatagagaaaaaagcatagtgtatacagagtttggtactatctgctgtttcatgtatccactataggtactggaagatatacccccagaaaagtagagactactctataaagaacatatataacccaatagcaaataaagcaaatagcccaataaaaatataggcaaaggagctcaatagacatttttccaaagaaagccatgcagatggccaacaggaatataaaaatgtgctcggtgttactaatcctcaggaaaatgcaaattaaaacaacaatgagatatctcatagcattcaataagacagttattatcaaaagtcaaaagatcacaagtgttgttgagggtatggagaaaagggaccccttgtacactgttggtgggaatttaaattgaaaacagtatggaagtttttcaaaaaattaaaaatgcaattaccatatgattcagcaaccccacttctgggtatatacccaaaggaaataaaacgactatctcaaacagatctatgcactctcatagtcatagcagcattattcatggtcgctaagatacagaaacaatctaactgtccatccacaaatgaatgaataaagaaaatgtagcatatatatatatatatatatatatatatatataatgaaatattatttagtcttacaaaagagggaaatctttacaacacaatggatgaaccaggacatcctgctaatttaaataagccaggcatagaaagacaaataaatattgcatgatctcacatgtgaaatataaaaatgaataattaaataaacttatcacctcacttcattcctatttttctgtatgtggtaaaaacatctcagatctatctattcttttagcaaatttcaagtatacaacaccttattattaatttatagtcatcatgccatacactggtatgcaaaacttatttaccttaaagcttgcatcttttgaccaccatctcacaccacacacagaaaaagtaggtatgaggtgaggtgatggatatgatagttttattgtggtaagaatttcacaatacataagtatatcaaagcattatattgtatatttcaaatatacacaattttgtcaattatacctcaataaagctggaaaaaagaaatctaatagctccacttaaatgatgttcagcttcaacgactttgtttgccaaaaaattttgttaaaaggtgttacagtaataatcatcttctttaaaatgagcactaaaactcagaaaattaatatagatgtacataaaataatgtcaatttcttaaatcctagagcatttggtttttaaaacaagagctgtgatttctattttgattggggctctgataaaagtcagccagattcatttgctgcataaattactcacagatcattaacagaagttttttctgcagctgcaataactcatccaggctgttacagaactatgtaactcactgcaggcagaacttcctaaatgtcaacttaggaaccaaagaggtttcatggatctatatgaagctttagtaccatcctgggttttgaacacagacactccacagacctgtgactgtatttacagtagcataatgattcagttgctatctaacatctaatctccagcctctaaatatgccacaaatgccactgttcactgcttatgtgctagacttgcccaccttgtctcatacctacttttaactactcttctttatgcttctccccataattttatgctaggcagtcacctccattggaaatatttagaaagagccaaaaatatatttaaatgtaagaaactcaaggaggaatgcacaatcaaggaggaattatgaggaaatgagtagggatgcaaataattcacagggtactaaatattcttccatcttccaatttccctttatggtacttttccatattcatcctcaacttgagcttccaagataataatgcaatagcaattcatatccctagattatccacagataaaatagactgtagcagctgctgtcctctgcccaggtcccccttcagtcttcaaggatgtagtccctcagctgcgtagagtgctatggctgacagtcctcaatgatcacctctctcttggaattgcctgttggtggagagagctgcctctcttgatgtcacaatcctttcctaagggaaatctgtttccaatgcctgttgaggaagcttggcccctcactcactcaggtgcagctttcaaagacagctatgagggggaattctctcagtgtgcagggcttcacgcactacacttggtcatcaaattcatgttgaaagagatgcagcctcagcctcagtttggaatatacacagacgggtaggtgctgaagggcacagacagatcatcagaggcctagtgggagagaaattaggagatcatagacaaggatatctggagtagtgttgtgtagatgacactatgggagaagacacaatgtgggaagatctttcagttgcaggttaacacctaccagaaatcatctattttggaagaggcactagacagccaagtagatggactgactcagccacttgatgccagccagtttctgtcattggccattccagtgctgctgaaatgaacacatgaaaagagtagctttagtgtcagagatgttaggttatgctcgggcccaacagcatgggctcccattcatcaaagctggtctagctccaggtgctgccgaacagcaaacttgccagtaacaaagatgacatcttcatccccaatattgcatcatttcttcaggagatcatcccatcactaagcggcaagttcaccacagtctacttctttcatcttgccagggtcagtggttcatttttgacagtaacaaattctgaacatgaatttgctttttctgtccccatggtttcaggcaacactgttatctgaatgcttgcagagtgtcagatccaacaacagcaatttcacttataattatgtcaggcagagggacaaaccttaaaaccaagcaggtccatcagtgggtccataatgacaggatctgctggtcatatcacaagccacaccactctattgcatcaacctgatagagtgctgaaacagcctgttgaaacacaacggaggtgtaggcccagacatgcttccctgtgagaatgagacagcactctccaggacatagcatctatcctgaatcaatgagcattcgcgggctctgggttcccgataaacagaatacatagatgagaaaccaaagtctagaagcaagagtggcctctgttaccaacattcccagtgacccactggagaatttgtgcttcttgttcctgcaactctggggtctgtgggtttaaagatcttggttcccaaaggaagaacatttctgccatgaacacatcatcatttcccttgaatctaagctgtggtagcttcctggacacattaaatttctcatggcaaaggacaaaaggacaagaaaagcagtcaccatcctaacagaggtaatggattctggccctcctttatgccccacctcaggaggaggagctgctgctacagggaggaatatgctggcaatctacctttggaaagtccttgaccaattgtttcggtaaatggacaagtgtagcggccccagcctgaggcaggtatagtgcccagggtttcatgccagtagatgacccatccagaagagcagaggtgatgtctgagggtgagtagaatctaggatggacagtagaagagggagactgtgtactaattgtgggtcttgagacaaaatgcagtggtcaggcctgtaattttccttcaggatgctcactggaatccctggagaggctaccccaacatttaagtaaagaagcagaacaagtacagcagggaatgagctatagtagacatagctgagctgcccagattctcccgcaggattgaagggcctgttcctcccctttctcctcctggcactggtagatatcagcccagagatgtgcagtgtactctgagcacctcgagtttggggcttgacttacagtgccatggtgcttaacacacttgaagagagggtgaacgactgtgtgatagaatgactgttttaattacagcgtagcagggtgttgactcttctcttttggctttgagacaatgttcttgttcaagtcatgaagtcacctgtctttagaatcactaagacttggtccaagataacttagttgactcaaacactacattaatcatgttatgtgacctatgaaatagtctgctggaaagcaaattatgtcatttcattaaatcatcttatcagggatgaccacaaaacccatgaaataagccactttttcttaatttctttcatagatttcatattattcataaacaaatttttaagaaagtaatttaatttgggtacaaaaataattatatattaagatacactggattttatgttatgattggaaagtcatattcatctggacgcatttaggtagcagctgtaggatcttatgtaagtttctgaacttttctgtattttaatttctgggccttgtttgttaaatataccttccttttaaggttgatgtgaaaattatatgagtcagtaaggcacttaaaatgtgcttgacacagagtaagccgtcatgttattattatttttgaatgcctatcgtatgtcagagacaataagaaggtttctcttggataattgcttgtacacacatcatctcatttaatccacacaataaccctaatgtatagctgttcttcatgttacttatgaggaaaatgagggccagaaaaatgaagcaatcggctcaaggtcacacagctagatagtggccatgctaaggcagcaaaggtcaaagctagaagaaacaatcctgtaggtaccttagcaattcttcacagtctttcttttcttggctttattatgactctttccatctggccatgtcatctgtttggcctattctccagaagtcaagagattagatctgaatctcagcagtcttgtccttgatgcaatagagagctgaaatcctctctcagaatacatatcaatataggccgggcacggcggctcaagcctgtaatcccagcacgttgggaggccgaggtgggaggatcacaaggtcaggagatcaagaccatcctggctaacacagtgaaaccctgtctctactaaaaatacaaagaattagctgggcgtggtggtgggcgcctgtagtcccagctacttgggaggctgaggcaggagaatggcttgaacccaggaggtggagcttgcagtgagctgagatcgcgccactgcactccagcctgggcgacagagcgaggctccatctcaaaaaaaaagaaaaaagagaaagaatacataacaatataaagcttgattcttccagcaactctgggaaccaactctaagtttgctgatgaaatacctgttccagcttacctctcaaatattgctctctgaatattttttgttgaattcaaagaagtttgcatgcttttatccattcgagaacaaaattttctgcaaatacacctgagacatacaatatatgcatgtggatttttttactgaaagcaagtttactgctctatccttccgtttttcttcaaagtatcaagttgtactgaagtttgttacctcagtgctgaatgccattttcttttttttttttttttttgagatggagcctcactctgtcgcccaggctggagtgcagtggcacgacctcagctcactgcaacctccacctcttgggttcaagcgagtctcctgcctcaccctcccgagtagctgggactacaggcgctcactgtcatagccggctaatttttgtatttttagtagagacagggtttcatcatattggccaggctggtcttgaactcccgacatgaactgatccacctacctcagcctcccaaagtgctgggattacaggcgtaagcccctgtgcctggcccatttttatatcataaaataaagctacatatttatttacctatacttttcaaagtattgtcacatagttattctatctaaagcaagacttaactttcaatgttcaattaaatcattcactgcattgtgtttatttaacattatatcaccattggttcacattgtatgtcctcctttgaactgagtcaaatattaacagtaaaaagttatctttttgataaaagttttaagcacactaaataggaaatttataatgaatctcagttatagatctgttaaaatatgtttttaaaggtatatttcaagttttctatcagagaatatagcaatctgatgagagatatctagtgcctctttattaatagaaaatgactgaagcttagtctcactcttgataaaatcataaataattttttgaaaaccacatacagataataatgaatgtctacatttataagaagtagaataatgttttgttatatcatcatctattagaaacataaaattttttaaactacaataactgtaggtccatggactgagttgaattatttcattagaaaataattttaaaagaaagccgattcacttatcaacataaagtattgtgaaatggagttaatatcttacttgtaatatttctagactttttaaaagggctaatattaaaagagaaagagagagagagagagagagagaagcttgattagccatcagggaaatgcaaatacaaaccaaaattagataccacttcacaccgagcgtgaagtgaatggctacagtagaaaagacagacaatcacaagtactggtgaggatgtggtgagatcggacccctcatgttctgctggtgtgtatataaaatgtgcaacttctttggaaaacagtctggcagttccccacacagttaaacagagttaccacatgatcaagcaatttcactcctaggtgaatacccaagaaaaatgaaaccatgtgtccacataaaagtctgtacacaaatgtatacagcagcattattcatatagccccaaagtggaatcaacccaagtgtccgtctgatgaagggacaaacaaatgccctcattcatactattaaatggaatactattcagcaataaaaaggaattcagtacagatacttgttacaacgtgaatgaatcttgaaatcatgttaagtgaaagaagatagtcaccaaggatggctgtatgattccacttataacaaatgtacagaataggcaatttataaagacagaagctagataggtgattacccaaggctggtgaaatggggagatttaggagccctgactgagtgcagaatttattttagagatcataaagagtgttttaaaattgactgtgatgatggctgtacaactctgtaaatatgctaaaaataattaaattgtattttataagtgggtaaattttgtggtgtgaagattatatcttaacaaagttgttaaaaaaagagaaacagtgaagtgtgtcatacttaaatgaaaaaaatcttcatttccctccaaatttattttaaaatcttgccaaagtgtagtatatgtaataaattgaacgatgaatagtactggattttaatcacactttactaattcttaatcaaaatatatgctagatgaatactgttcaatttgtaattactttgcataggcttttaaatagtactaaattactctaggtatgaaaagtctttgaaatgaatattccacctatagaaatatatcctttggaaataattaaccacatgtataattatttcacttcaagaatgttcactaataatgtttctgataataaaaatttaagataatcaaaatgcccaacattaagtattagtttagataatttcacattatttaaagattcaatattctccccttttaaaaaagctgtgaacgtacctattgaaatgaaaatgcttataatatggagtttaatgactaaaacagttttaaatgagcatgtaccgtgtgatcatttttcttaaagatatgcatggaaagttatctattaatagtaatggttgtctctgggcagtgtgagcatatgattatggtgtgtctccttttattcatctatacttacaagtctttcctataatgagcatctattgatttggtaacatgtaagatatttttaattttaaaaaataaccaaatcgcattttaatgttaacagcaagcagcacaaagtactatgttgctccctgaatatttcaccagaagggttaacttacattaccctggaaggaagacaataagaaatggtgagcctgatggaatagagagagaggctgaggagtagttctacctgcctgtttttccatggtgacagtggaatattaatcacagatggatgagacttaacattgctcagactatcattagctgttttcatcaatcactgtccagttattgctaatcctctaccattctcatcctgtggggggtggaaaatgacagactgcgtgtatcaagcaaggttcccaggtacaagcaacaagaaaaaaaaaatgaagttggctatgttaagataaatgaatcaactggaagtatgtagagggctcagaaaacaaaggtgatgtaggggaacctgcttaaacaaccagtaagaacaaaagaagttctagaagccaagttgcaacaaattcctagatggaatgccaatacccaggaccactcttaggcccaggcaagaagggccattgccccagctctgggttttaaagaaactctggccctgtggccttgtccctaaggcaagagtctatgaagttgaggatgcatgttacccagatcccaagccctgccttgagaccatgttgggacacgtatgaccccaggattgtttgcacaagtagtccttaactcactcaaagcctatgcagtcctcttcacaggctccacccactcgaacagaaactgcatacaggtggacctaggagtagccaacatgcagctttctgttgggggttatggatgaagcttagatctataggtcaggctgtccacttgtgtaggcacaaatttcttacagagcaaaacacagccaagagcaagaatctaggggaaaagggctcgcatactaagaccaaacactggaggccagtattcccaagcttccagaatccagcatgcaagccccagggagctaagaattctaaactcaaacatggccacctgggtttttatgaaggcacatttttccagggagtagaatagatatacatattatgtatatgattaagcagtttttaagattaacctacaacttttaaatatttagttttatggcatgtggacttccatgtatacagttgggtcttgcaaatgtcatcattgccagacaaacctagcaaagtctaagtatatgctggtcactcctttatctttgcatttcttttccctcaagatacaaagacccagaaaacaaatatattcatcccaggtcataagtcacacccttgctgccaggtcttgagagagggggatatggcctttggcagcctctccagtgggaggcagggccctattgacccacaggaacacacataatggcgatgacctgctcttcttctattaataaggagagagaagtgcatgctggacagccaaacaaggcaaaacccaaagaaatatgcattgtattgggaggaagaaggccatccttactcaactagctatatgaggtcaatgacattaagcctctttttctcccttataaaataaccataaaaatccctacttcattggattgttaacaccattaaaaagataatatgtgtgaaaaaatgctctgcaaactgcaaagtgctatacaaattagcatattagtgttatactcttgggagagctctggcagttgctaatcaagaattaagagaaatatgctaattagaggagacacctgacaatgatgaagataggtggcaggtaagaccccacctgcttcaatgcagccctattcaaatctttacattttgtatgctgctactcagccccacattacaataaatatctcccacataatctgcacaatttccctacaataaattgtcaagcttcatctggtcatccctataaactcaatatactctaagcaggttgttaagtacattcaaggatttcacaatgaacagctgagatccagttatcattaaaatgaagtgctgacactggaataaagccacaagaaagtgtttactgctactgctgctctggaattataatcatttctttgcttggcctttagaggactgaatcatctgatgcatatctatcttgtttagtaataagatttgaaacctaatgttgaaatgtccatatctatgtttattagaactagaaaccaggtccacattaagctcacaaaaccatagcttctttattaattgcctacatttattatctatgctggctgcacacaattttatgaagtgataactattttccagtttaacagagtatgagctgcaaagtggagagtttgggaagaagcttgacatttagtaggaagcaaaagataagagtgaagtgttcctctcccctctccccacggtctccctctccctctctttccacggtctccctctgatgccgagccgaagctggactgtactgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatctgccagcctcggcctcccgaggtgccgggattgcagacggagtctcgttcactcagtgctcaatggtgcccaggctggagtgcagtggcgtgatctcggctcgacacaacctccacctcccagccacctgccttggcctcccaaagtgccgagagtgcagcctctgcccggccgccaccccgtctgggaagtgaggagcgtctctgcctggccgcccatcgtccgagatgtggggagcgcctctgcctggctgcccagtctgggaagtgaagagcgcctcttccaggctgccatcccgtctaggaagtgaggagtgtctctgcccggccacccatcgtctgagatgtggggagcacctctgccccgccgccctgtctgagaagtgaggagcgtctccgcccggcagccgccccgtctgggaagtgaggagctcctccgcccggcagccgccccatctgggaagtgaggagcgtctccgcccggcagccaccccgtccgggagggaggtgggggtcagcccccgcccggccagccgccccgtccgggaggtggggggcgcctctgcccagccgccccttctgggaagtgaggagcccctctgcccggccaccaccccgtctgggaggtgtacccaacagctcattgagaacaggccatgatgacaatggcggttttgtggaatagaaaagggggaaaggtggggaaaagattgagaaatcggatggttgctgtgtctgtgtagaaagaagtagacatgggagacttttctttttgttctgtactaagaaaaattcttctgccttgggatcctgttgatctatgaccttacccccaaccccttgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttacctgctgaccttccctccactattgtcctatgaccctgccaaatccccctctgcgagaaacacccaagaatgatcaattaaaaaaaaaaaaaagaatttgacaaagtaaaaaaaaaaaaaaaaaaaaaaaaaaggagatttactaatgtggaagattaatatggaagattcctgctatatgttctttttttttttttgagacagggtatctctatgtcacccaggttggagtgcctgggtgcaatcatagctcactggctcactgcagcctctacctcctgggctcaagtgatccccactgcctcagcctctcaagtatctgggaccataggcatgtgccaccatgccaggctaatttttaaatttttttgtaaagatagaatcttgccatgttgcccaggctggtcctgaacttttgggctcaagcaatcctcccacctcggcctccaaaagtgctagaattacaggcatgagccatcatgcctggccatgttctctattaaataaaagccttccatctctttcttcatttcagccagttaaattgagatctaaaggcttgaatttactatttaatgctacctaatgacatttcagagactggctataaaaaagcaagtgttgaaaattaacaaaaacgtctctacaaaggaaatgaaaatgttccctcttccttgaaccaacagagagagaaatatcctttcactttataaaatgaattccaagactctgatttgatgcagcgttaaattgaaaacatttaggaaaatatcaatcttgttttctccatttccatttgtgcaaaatggagacttgctgactattcataattatcaacttactctgtactgttttctattaatgtgaattcattggaagtatactttgaaaaggaggtcatgtaaaactcttgtcctgggaaaattactttcaaaattaaaaaaaaaaaaaaaagagtgaagtgttttgatttaggagaagatgtacatccaaagagacttctgtcttaggaaacatgagaattttgctgtaaagctcaacctagatgcaaaggagactaaagacaagcatcccagacaattatagaccaagcattgggaaaggaataagttgggactgactcataagacacttagatgaagctaggacaatggacattacgttagctaaccctgaatttgtgctggaaagatttgacaaaacctaaaccttatctatttcttataagtgcagagaacaaatagttcaaaacacagtatctatagataactctgtaaaacaaaacaaatttgttgtttggttaattctcctcaagacataggttgcaactgatattaaatttcttctcatagactatcgatttacagcaatggattggtcaaggaaggataaagaaacttggaaagaactatcatgatacctgccctgagaagccaaaatttggtttaactttgtgttgtttactgtttggttctataaaagctaagtttataaaatattgtatgacaggtgaatttaaatgttactaaccatcttggatgtcctgctcttctgctgtacagcaataaagtctctctaaatgcaatgtttgggacagagttgctctgggaaatatagtggtttgaaaggtggctattgtacccaagatgaatatgttattatctcattggacatagcatcaaatgttatttatgaaaatgcttatcactgccacaggcttctggtctatacccatgaagacatcgctcaagcatagcacctcaacagagtgaaaagtgcaacccaatgctatagtaaaggcatcacctaaaacttccttgcctcagacacctgaatggcagtgtcttcactcaggtccccactcaaatgtcaccccatcagcaatgtcttcaccaatagcactgtataaaatggcaagtccactctccaaacaagtacttcttctcctttctccacattatttatctccaccccactatggccatctaatgaagtctgcatgtatttgattctacattagttttccctctctccctatatttttgcatgtccagctccatggacccaaaagtacagtctgagcaagatgtttgaaaccacctttgcaaaaattatgacattgaaagtaatcggacatagctgaatccatcttgcttctaacctcacatgctgcccttgttcacttctaggcataggccaagctaactatgggaggaatttggtttatagtttaactttaaacaaagacaaccgtcctttcctgaaactaactcccttcccaatggctcctatagatactactattgtaaaacctaacattggtgtttgagctatttttttgaccctacattctgatggatcagctggcaccacctggcctgataacccataccaagaaactggtttatctggtcttgtgaccctcacccaggaactgactcagcataagaagacagcttccaactccaatgatttcatccctgacccaaccaatcagcatccccattccctacgcctctgcccaccaaactacccttgaaaaaacctagcctctgaattcttgggagggcagatttgagaattatctcccatccttctgcttcgttggccctgtgattatcaaactctttctttgctgcaaaacctgctgttctcagtgaattggcttttctgggcagtgggcaagaagaagtagtcaggctgttacaccttcacagcactcagtgatggttcttagatgaaagtaacaacttataagcacgtggatctggatgagtccagcatgtcccgagatgtgtagcatgtttgcgcagtagaacaaaggcttcagggatgtctggttcacatgtggcagtcaaaaaagtcacaatattaaattataaaccttcttccttccccttcctttttttcctttagattctcaataagattctattttgaaataaaatagaacaaaggctgatgtgctactaacaaaaccttttgaaggaaatttcaaaacaagagcaagttaaggcatgccaatttattatcatactcttggattaaattcccactttttgcctgtattttcacatctgtaatttggaggagtaacttcatgggttgttaaaacagcaattaataactgtgtgttttaagtgttagttttaaatattactttctatgtagcaaaaagatttctgatagtgctataattctccaaagagtagggtcctgagtaaaacagaatgtcactgttactacttgacgattgtcttctgaaataacatattcaaacccatgtactttacttactatgaagcattttatggctttgacgaaaccatttcaaccccattctttcccatgttttaagggtttttttaggtagctcaaactcagcacatccacgaaatatctcatcatctttccccccacactctgtgtctatacctgaattctctttgatgaatagcaaaatttccttcaagttactcttaccaataactttggaaatatagatttgtgaaaggaaaagaaaatctcaggaccccaaactctctgtcaaagggaaagcaagtcacacaaaaaaactgccttcctcttgttcccaagcagacaactgtaatttcacatgtgaaatgtagatttgccaagccaggaaaagacatacttgaccttttccaccactcctctcttttcacatgtcaaacaaagatttttgtgagtgctaatcaaagcctcgcaagaatgtaatgaccacactgcctaagttctacctcccccccacttttttttctttcctccttcccctcctgcctgctctttccccctgtagtattgaagttctcaaaaccttctttggaaaaagcacagtccacattccaggcacatcctcaactgtggcaatatacacctctaaatctgtggcagacacttttggtttacagcatgatgcatcctgatggatgcattctgaagtcagattgagctgcatctaaactctgctttaccaacacctgtgcaatctcagccaagagctcgaaactctcagagcctccagttccttcgtcattgaagtgagtacagagtacccactcataggttccttgtgaagagtaaatgagataatgttcacaaaatacttagcatgctactggcttataatatccattcaattaaaattgatgatgatgattcaggctttaatcatttcttgcactgatggctttcttgtcagtttttctttcaggaacatgcaattcttcctactctggttttgtttctccgcatgtctacagagctgccagagggttacatttaaagtacatgactgttcatgccaatctcctactgtccttcaatggctccccaaggctttctttctaaagtaaaaactcctttcattagcacgcaagtcccttcacggattgagtaccctctgttcctctaacctcatctctaacgctctcaagacttgccatttctgcaacagacagatccaactgctttgagcacttccaatgagtcatgcagatcatgtgtctgtacatcccacccagatatacgaggcactagccactgttccaatttatcaagcaaatgcttactcacactttagggaaacttctttaataatttagaatcacctgtatcttttctcccccagcatatacatactcccccagtgtatgtatatttgttgcaaagcttattacattttggtgtggatgtgatttacttgtttatttctttccaagtaatcaaaccaattcatctttccatctcacaatgttagacaccgtgcttggcacatacagatatataatggatatatattaactaagcagatacatatgttaaaatgagatctgagtcatgaagataatgagcttctctttcccagctcactgcagtactcttcttactgtgcctgactctgatgggctccattttagaattttaaggttgtgaggttgtgttaccagaaaggggtcatgatccagaccccacaagagggtccttggatctctcccacgaaagaatcagggtgagtccccagtgcaaagtaaaagcaagtttattaagaaagtagtgaaagtacagctactccatagactgagtagggcgtttccaaaagtaagaggaggaacatgtccaccctaggtacaatgcttgtatacacggggagatgtgctctgccacaagggtttgtgataaaggattaattttcttaattactgtattttgcaagaatcaatattattatctttaaagcaaaattaggagtgcctttgttctccagatatcgggatatctggacacccccaggtcaggtttgtttaatcaacattattaatctgttcccttaactgtaaacatctagaggcgagaaatgtgtgactttctgggaatgcggcccggcaagtcccagcatcattttcctgcccctcactcaagatggagtcattctggtttcaacacctctgacagttgacagggcattataggtaaagtagtagatctctcatcagaaacaagaatccccactacaaccaggccccaactcaccttatttcagaaatgagtgaaaaagaaaacatcttcaaagaggttatctgtgctcctgtcccttacgagcaagataaaatccactgtacttcacttagtactataatgttaagtgtctgcttcaaggtgaaagatttaactgctattttttacacgtggcactgataaaactcaaaatgggacacaaggcagaatagcatgacaatgacatcagatttagggaggcccaagtacgtctgtctttacaggattatttcttagaagttaactgggctcagagagagtatattcaaggtcttttttttccttttctttttaattagtgtgggtcagaggaattttgggagtggatcaatagattgccaacctcccactacatcaatgtaccttccaagggaaaatagacaatttagttaagctctgcatttcctgaacaacttctggatcaagagttcattatctgctatatttgccaatatgtaaagccttcaggatagttgccataattaaacaaacaaaaccttgtatttgcagacatatgatttgagattcaaaaggatttcttcttttatttttggtgttagctttgacccttattctgcttgtcactttttctttagggagtgtgcaattctaaatgcttctcgcttagacagtagctttgacatccagtacaagtggacccctcaccttttacaaaacagttaagctacttatcagatttcctggtttctcaaaccactcttttctatcaggtggaaaggactattctcttgggagatcgagggccatgagatataattaactttccccatcccttccctcttaggaaatggcttttaaacaacttctatgcatcccaccatggtttatgactacactatattaaacatgatgaagcattttcagagaggagggccatcattatgaagtgagtttaaaaacaaattcccatgagatctgataattatctcatggagcagagattatctgcctactgtaagaggctttattttgttcactgctgtgctcataataatagcttgcagtgtgatataaaaaggagagagtgaagcatacaatctcaggagaccagagacaccacttcagttctataaaggaaatcagacataagaagacaaaaacagtgcaaataacaatcatattctgaaaaagaatttgatcaactctcagtcatctttcttggttcacattgacgcagtttagcagaaacatttattgttcgtattattccatgtctctggctttcattcccacatgcagtctacaaatcaggtggagatatttaaaccaaagtacttcattcccttccccaaatgaggaagtagtgatgagaaaaaccgcagagaaagagagagcaagagcgcgagagaaggagagtaaagataagaaggctagcttactctgacacttgtcaccagcaggagatgtggtctagccattcctcacagagcaggaaaccaggggctgttgcattcagctgtgagcagaagacagagagggagcctgaaggtgggacttcattatattatttaaagcaaatttacaaaatctcctattcatgcgtaagttaaagtacagaatcacatttccaggccaagtataaatgcaatattgtacttagtaccaattcaaataaagacgaatggataattgagacctgtgagcaacacactccttggtaccaattcaaataaagacaaatggataattgaaacccgtgagcaacacactcacaggtgtcaggattggagtaccacagaaactgatcatcgctgcagccctacgagagcatttggttccatcctctcactctgcagatgaatataagccagagagatgaatcaccacactgagacccagactgggtggtctttctccaacgagttatgcaaagattatgtttatgttacatacaagtaagttgtgtgtgtgtgtgtgtgtgtgtgtgtgtgtgtctttttggccattttaagagtatagtatttccagggggctgttgtaagtattatgtgtctcaaaacatcaaaagagtgtagaatcctagtggatggaaataatataataatatttattgcacgcctgctaggtatgcaatgaggtatgttacctatattgtcacattaattctcaaacagccctatgagaaacacctcatcttccaggtgaggggtgctgacactctgagcagttaagtgcctcttgctatgttgacaaagaaatggagaatgagtttaaacctggtcactggtgtcccaaatcccagtctttctgcctcattagactgccttcggcacgtccactagcatggtctcaggaaattctgtttgtgaagttcctgcttgtgttttagcaagcgaacgagtcgttggaaataaataactgtcccgtgactcccactcatgacttttcttgacaacctgatggcagcattgcacaagatggaaaatgctgtgcgatgtctaaggagggtggagcaggctcagctgcaacatgaaacatccatcttcctttagcgtctcctctgcacatcattcacacttacagtgcagcccaacttttctcaagaaaagccatcatgtcccgtgaggctttctgggctctgatcctaaaaggacagtacatttggaagctgcctttgaagcctgttcacacatgtctgctgctgaagttaagtttccagtatgtgaggactctcagcataggggttggataaagtagttgatgaggattcacgtgtaaataatgaaagaagcaagtcgatctttgttgctgttattctgagggagaaaatagatgggctggcctgccactcagaggctgcaaggaataatttatcaggtgatgttatgtttgaaacacaaaaataagagttaggaaatttgaaagttggtcagcattaattttctgctagcaaacaactagagatgttgtcaaaaatgccagctaaggcatttaatgagggggtgtaccatgaaaacaagtagcagacacaagctcattcattatctttgttccttacctgtgaatactgaacaatttgtctttctaaatcagttatgtttatattatgatcattcaacacagaaagaattatccaatctaaaatcacctaatttatctagatcagggtttggcaaatattttctgtaaaaacccagatagtatttctggccaaattagacaaatcctggcctatttttttttttttttttcgtaattgttggcagtagcatgtttaatatgagaaagtcttctttgtttatgttcaaggacaaggagaaagagaatttgggagagatgatttgagtaggccagactggaagcggcagtaggagattacagtacggctgcttccttgctgtgggggatttatctttgtactctttgcttgggagagatagttaatgagtcttaacatcggctcacgacacaggtgatttgccagaaaagagtcctcaagggcgaattaaggaacagcccagaacaacaggatcccaagttattctatcatggtaacttctgtctgttcaagaccacacagcctcatctctcaatagcacttttttccccaaaagaaatgctattttcaacatctgacttaatttcacactgagttcctttgtttttaatttttaatttaattattataggatgtgattattttgtattcaacggggcttactttgctttggatattattatactttatcttagcctttcatcaaataacagtatcctacggtgtaatcaggcatcaagagatagagaaagatcatgcatggttttagggtccaggcacttccacatgcaaagcatctaactatagtttctctctgaaccccaggtggctcatgtatgaaatgaggctgggtgcggtggctcatgcctgtaatcccagcactttgggaggctgaggtgggtggatcacctgaattcaggagttggagatcagccagccaacatggtgaaaccctatctttactaaaaatacaaaaaattggctgggcatggtggcaggtgcttgtaaatccagccactagggaagctgaggcaggagaatcacctgaacccgggaagtggaggttgcagtgagccaagatagtgccattgcactccagcctaggtgacaagagtaagactgtatcaaaaaaaaaaaagagagagagaaagaaagaaggaaagaaagagagagagggaaggaaggaaggaagaggaaggaaggaaggaaaggaaaggaaaggaaaggaataatttctcactcctaaggtcattgtgagaactggagatgacacaggcccagtgcttgtcataatgtctagcccatcctagatactcagtgctggctgttcgtagcctaatatagcaaagtgctgctttcaaagccatgtcactttgtttctctcgtttttttaagcagctgaatataatgtctattacgtgtgggagtctcctttttctctgaagtaaattatgtctaaacaatttatattatgaatcattgggatgggtgtttcactgtctagaactcatattttcctatgacttcccttttgactcattatacttagtgaactaagtttctagtaacagtccaggaggcaggggcctgtttcatgactgacagtggttttgtgctgcgaagagatcaaaaggcttgattttacattgtcataccttatttttcctggactttgcttatgctctgttgatggtgatagcacaaggattcctataagtttgtatataataatgtagttgtttgtagaatttggagcttagaataagtattttttttctttaaaacagaaaattgtaatagtttcccttaaagggctgtcctctcacacagttaaaattagctgtcttactaggtaaaactatattattttgtaatgattaaactagtatggccattcacctcatgtctctcaacagtttcttgtcaaatttgggagaaaaaaaaaagcgaccttataagattactgcattccaaatgctagagtgcattatgcctgggaccaaatgggacaggatatatgctcgcctctacttggctgtgtaaaatttgcttggaaaagagacattctgtcttttgaaagagagcatgactttcccttgcattgtgatctatgagctgtagctaagagcaccctcggcagtgcagaccctaaggcaaacctaccacatgtgtctctccttctcccaaggatgttttctacaggcaaaacccgaatagtagagtgagcataaaggctgtcttgagagagagagaggatccagaaatttttaaagaattgcttaattgacttgtttcatgctctttctattccccctccccctcccacacagaatagatagtgcatcatctccttttatctcttatcttgtttctgtggggtttttttttttaacgtcattcatgctgtaaatcacttttttgtttgtttgtactttgcttctttatttttaatttttccataagttattggagcacaggtggtatttggttatatgagcaagttctttagtggtgattggtgagacactggtgcactcatcacccaagcagtatgcactgcaccatatttgtaggcttttatccctcgccccctcccactctgccccccaagtccccaaagtccattgcatcattcttatgactttgtattctcagagcttagctcccacatatcagtgagaaccatacaatggtttggttttccatttctgaattacttcacttagaataatagtctctaatctcatccaggtcactgcaaatgctgttaattcatttctttttatggctgcatagtattccatcgtatacatataccacagtttctttatccacttgttgattgatgggcatttgggttggttccatgattttgcaattatgaattatgctgctgtaagcatgagtgtgcaagtatctttttcaaatagtgacttcttttcctctgagtagatatccagtagtgggattgttggatccaatggtagttctacttttagttctttaaggaatctccacactgttttccacagtggctgtactagtttacattcccatcagcagtgtagaagtgttccctgatcactgcatccacaccaacatctaccgttttttttgttttttgattatggccattcttgcaggagtaaggtggtatggcatggtggttttgatttgcatttccctgatcattagtgttgttgagcattttttcatgtttgctggtcatttgtatgtcttcttttgagaattgtctattcatttccttagcccactttttgatgagattgtttgtttttttttcttactgatttgcttgagtttgttgtagattctgggtattagtcctttgtcagatgtatagattgtgaagattttctcccactctgtgggttgtctgtttactctgctgacagttccttttgccttgtgaaagcgctttagtttaattaagtctcagctatttatctttgtttatattgcatttgcttttgggttcttggtcatgaaatccttgcctaagccaacgtctagaaggatttttccgatgtttgcttctagaattgttatagtttcaggtcttaggtttaagtccttaatccattttgagttgatttttgcataaggggggagatgaggatccagtttcattctcctacatgtggctagccaattatcccagcatcatttgttgaaaagggtgtcctttccccactttatgtttttgtttgctttgtcaaagatcagttgactgtaagtatttgggattatttctgggttctctattctgttccattggtctatgtgccggttccctccctgattagcttaataactaacctcctgaattctttttcaggtaaatcagggatttcttcttggtttggatccagtgctggtgaatcagtgtgattttgggggggtgttgaagagcctcattttgtcatattaccagggttggttttctggttccttctcatttgagtaggctctctgagagaaggtctagggctgaaggctgtcgttcacattctttcgtcccccaggttgttcccttgatgtagtactctcttccttttcctatggatgtggcttcctgagagccaaactgcagtgatcgttgtctctcttctgggtctagccacccagtgggtctacccggctccgggctggtactggggtttgtctgcaacgtcctgtgatgtgacctatgggtctctcagccatggataccagcgcctgttctggtggaggtggcaatgatgggggtgcaatggactccgtgagggttcttagctttggtggtttaatgctctatttttgtgctgtttggcctcctgccgggagggggcgctttccagagagcatcagctgtggtagtgtggcgaggaaccggcggtgggcggggccctagaactccaagatgatatgccctttgtcttctgctaccagggtgggtagggaaggaccctcaggtgagggtggggtaggcacctctgagctcaggctctccttgggcggtccttgctgcggctgctgtgggggctgggggtgagattcccaggtcactggagttatgtacctaggaggattatgtctgcctctgctgagtcatgcaggttgtcagggaagtgggggaaagccggcagtcacagggctcacccagctcccacccaaaccaaagggccggtctcactcccaccgtgcaccccccaacagcccccagtccgtttccaggcggagagggatacaggcctgaaaacctgccccaggctacccgcctcccagctgcgagagaaaaaggcttggttcttcccccgcctgtggagtcagcaccccggattcgtgccctgccctagttctggccaggaggattctcacccagttcaaactgttacaacgctcagctagagatttccttctccctgtggagttttaccccctcctctcccgatggatccctgtggtgccagcaggaatgggctgctcggggacccagcgagctccgcgggcctttccgctgcttcctctacccctgtacctcactgggctccccagacggactcagctccaggtaaagttggaaattctcccgcaagcagaccttcagcttccccagtgggggtgtgtgtttgggagaggagggtctccctctcccacttctgcagttggggcactcacacttttgcgggggtctcccgggtcctgcaggagcagcccacttccttcagagggtctgcgggtcctctcgggactgctggtttcttcctgcagtccatctggagctaaaagtcacaatgcgagccccgcacgctgccctgtcgggagctgcaatgtagtcctgcctcccgtccgccatgatgatctgttctcctgctgtaaattcattccagatccagattctttctcagcggcccttggtgtgtgtcagaagccataatcggtgtgtgctacccacccctactatgcagggcagcttcatttccatgggttgcattgataattattggcttattattatatttttctatgtcactttacatttcttagtgtttcttacatgcttagcatatttctacacatttttttctaattcccaaatgagaagaaagcaaataccaacagtattttctttctttgatcgtatatccctctgttcctgtgtcaggaaaatgtgaagattcaaaagataattgaaagatgattttaaaaagtatttaacatttattttaaaagcactaaagtttgttagcaaaaggcttctgttaaatgttgggagaaaagaaagacttttggaatttcatggaaatattattcatgtgtatttaccaattggttatatgagacatgaagttttttcctaagagataaattctgatcttatacaaacctgagaatctatagggtaagaggtggagaggagagacgaacatcacatacacatctagcaataatataataatataaattagtaaaacattcttgagtacagttagcaatctgtattgaaagccttaaaatacaaatgtaaaggtgggcgatagacaccttctctttagtaatcagaaaaattaaggcaaagttgccatcagttgagatacccagtaattttttacttgcatgttcctcctggctttgtatataattattgcaaatatagcttatagcctaattcctttcctttatgttttaaaactcctagtgtttctttcatgctgcagtgccttccttcagttcaactaatgttcacagaaaatctgtagaatgagcaggtaaatcctggaacctcagaatgtcaggaagtagagcagagaaggaggggtacgggcaggtgcgcagctcggcctctctcagtgctcgggtgtgtggtacaggtgagtgaacacctgggcttgcttgtgcccatagacacattaaataccagacaattaaagtaggacaaaatcaacactttcctggaacaccgggggcaagatcaatcccaggcaaacagctgccttcgtggctgcccttttgatattctactttctcaaattattcttacattctttcatttattcatcaaatatgttttgctccctacaacatgccatgtactttgctaagattagggtatatagataaataagccatgactgcttctagcacaagaatatgtataaagaaagttgtagatctatatagaagaatagaagcaaaggggcagagtggcacagtgaccaagtgcggacttgcaggtgagttagagtttcagaactcctttgtgtcatttatgtgacttgggtaacttatttaacttccatgagcttcagtttcattatcgtaaaaggggataaaatgcctatgttaggaagttatagtggaaatgaagtcaaaggaaagagtgtggtaaaacagcgagcatgtatttgggacacgatagcagccaaaatattgcttaagcattacacatatgtaacgtatctcctgcttacctagttggttttctttttttttttttttgagacggagtcttgctctgtcaccaggctggagtgcggtggtgcgatcttggctcactgcaagctccgcctcccgggttcaagcgacttttctgcctcagcctccgagtagctgtgactacaggcgcgcgccaccacgcctggctaatttttgtatttttagtagagatgggatttcaccatgttggccaggatcatctcaatctcttgaccttgtcatccacccacctcggcctcccaaagtgctgggactacagacatgagccaccgtgccccgccgctgctcaccctgtttgacgaaaagtttcaagtggctcaggtcctgggtggtcggcggggacagatggggagaggtctaccctcattcctgggccactacacaagctgtaaatgttctgtaagctctgccgcctcacctttggacgagtcattctttctccgcagtgtgcagacacacctgcaggttttggggagcagaaaaatctcattccacaagtcttaacacaaatccttttccctgtcacttaggccagcttctcagagtctctgtcttagctttgcagcggctgccatgctcaggaatgtgatctctagagtatcaggtgtgaacagatgtgggaaatataccaagaacacataaatcaaagttgcatgatacaaccacagaggtgatagaacagaggagtccccaaatccacccccatgaggtcaagaaaaatttctcagagaaagcatcctttgaaatgggctattgtaagaaaataaggaattgcatgggtgggacagatatgggagggtattccaggcagatgaaataaattatgaagtactgaatcccaaattatatatttgtgtataccccgtttgttccctgctagtgagtgcaaataagggcattttaatgccccatcaccatggctcttactagccaaactgaagggcattagccagccctgtcttcaaacatgctccatccactgttctctatcccagaacctgtaggaaaatatcagagatgttgagagagaagcccactcatgttctggtgctccactttccccatggaaagctgctcactggtaagtggcgtgacccatgaaggtcagtgtcaatgccagggggagacagtatatcctgctggatggagatgccggggggagacagtatctcctgctggatggagggcgtgcagttcctccatcacagcttgacactcccaaaaaatagcgacaactttgttcaagtgcaaaaagaacaatcggatttgtattggagaaactttactctggctgctggatggggaccggatttagggagaaccatcaggagcctgtcctcattattcaggtacaaaatgatcatggcatgagttggcagtggcagttgtgatgaaaggaagtggataaacttaagagatatttagaaggagaatcaatagcacttcgtgatcacctggagaccccgagcaacaacagggcaaagtcatgagtaatttagcagattctggattggaaatgggatgcagagtgctgctgggccctccgtgaggctgggagagctgagtgtgtgtgtgtgtgtgtgtgtgtgtgtgtgtgtgtgtgtgtgtgtgtagagctgggtaagtatttgggacagggaagctgggacaataacaaggttgaaactcaacttagagttggaggtgcctgtgggatattcaagcagagggtttccaccaaatgtcacaagcttgtcctatttcttttcttttttttttttatacttgaagttttagggtacatgtgctgaacgtgcaggtttgttacatatgtgtacatgtgccacgttggtgtgctgcaaccattaacttgtcatttagcattaggtatatctcctaatcctatccctcccccctgcccccaccccacgacagtccctggtgtgtgatgttccccttcctgtgtccatgtgttctcattgttcaattcccacctgtgagtgagaacatgcggtgtttggatttttgtccttgtgatagtttgctgagaatgacggtttccagcttcatctatgtccctacaaaggacatgaactcatcattttttatggctgcatagtattccatggtgtatatgtgccaccttttcttaatccagtctatcattgtggacatttgggttggttccaagtctttgctattgtgaatagtgccgcagtaaacatacgtgtgcatgtgtctttatagcagcatgatttataatcctttgggtatataccctatttcttctttgtgcatttccatgggactagaatgagcccctgccctccgtgagccaacgccaactctttgtccacatcctccacaccatccttcccagtggccccaggccacactgagcccctagcaccggaatgcctggagtcccactgtctgtgcagttcacgagctgctcagaagatgctgcctcccctagtaaatcacagcctcccctaaccgagaagagggctgcaaacagtgggaagttaaatatatatatatattttgtttaggttgttggaaaaagccaggaaatgcaaaggttctaaatgatgagaaaccagatgagatgagggtgatctttctttctgaaggacaggagaaattgactctgtgttcacaacatgaacagctaaccattagggaatgctggttgtaagttcggcattgctctacacactttacataccttattactatattcatcacaataaccctatgaagtagaaactattgttatcgttatttctacagatgataaaactgaagctcagagagtttaagtcactttccccaaagtcacacagctaggaagtgctaatcaagtcaggaagtctacatttttgagacagagtctggctctgtcacctgggctgagtgcaatggcacgatcttggctcactgcagcctttgcctctcgggttcaagtgattctcctgcctcagcctcccaaggagctgggattagaggcatgcaccaccatgcccagctaatttttgtatttttagtaaagacggtgttttgccatgttggccaggctggtcttgaactcctgacttcaagcaatccgcccgccttggcctcccaaagttctgggattacagacatgagtcactgcacccagccaggaagccccttctaaatcagaattctaacttggtagtttaggctctgaaccattcaaagaatcttaatttttaaaggaataaacacatataaaggaagactcattcttaaagaagggagttgcctttagaggtgtaagtattttgagtctttgtacatatacgctttctgtgtactctgttcccaaaagaagtaaaagttctaccacctaaaatttttttattggaatttacatctttattgctaggtaaacataagttacaactgaacgacttagtctcctttgatcatattttagtgtcagataccattttttttttgtttttcctaagtaaataattgtcttgtttgtttgcctagttttccatgtaactattagtaactcatcttcaagcttcttttttttattttattttatttttgaggcaggatctcactctgtcacctaagctggagtgcagtggtacagtcatggctcacggcagcctacggccttgaccttccccaggctcaagccatcctcctgcctcagcctctccagtagctgggactacagggcatgcaccaccacacccggctaaattttgtatttttggagagatggtgtttcaccatgttggccaggttggtctcgagctcctgagctcaagcaatccaccctccttggcttcccaaagtgctgagattacaggtgcaagtcgccacacctcaccaatatcctcaaattttctgataaaaaatatgatactcttctcagcctgtctaccacctaacatttagcataaatttattttttaaaagtagccccaatttattaaatacatgctctgtactaggcatagtgctaagtagcttccactatttgtaattttcacaggagttctattcgctaattatgagtcccatattccacctagacacattgagttttgaaggagttaagccatttccacttagcaagtggaagggtagaatgggactcgaatctgtgactgaccaatctcagaatccaaactactttctctaccccttcttaaaacaaaccttggcaactcagggcttacgaaattggcaagtccttgagaacacaactagtgaccatggtaaactacggaagctcttcaagctgcgttcaggctgcacactggaatcccatctgagtttcagaggagggggaagcttcctttctccaagagttgtcaggagtaactcactgttctgggcaatggtggccacagtgctaaatacagacggtaaactacactccttctggaaagaataaaatccagcacatacacgtgaaagatgatagctgctgtgtgggagaatggagtgaacacatgagttttaatattctgaatgtgtaaaaaaggcaatttcttattataagggcgttctgtatattctgtcagcatagaagagacaaaagggactaaaacttttaaaattgaatgtcatctacatttttagcttggatggatggtagaaaattgcttcatgaatcatgtggaatagatggaaagggaaagtggaaaaaatggaacaagtcccagctgtgaaacaaaaggattttgagtccatttcctgagttcagtaaaaagctgtgtgatatttggaggagtctcctaacttcttagcacttcaacttacttgaccataaattatagattataatacctactttataagacaaacaaacaaatacatgcgtgcaaggctaatgtggaaatgcattcactccacaattactgttcttaactcctacttttcatagtgctatacctctaaaatggttttatatgcattatttcatctaaccacacaatactataagacgtttaaagatgtggtgctagaatataaaattcccaattttaacatttgaaaacaggaactataattttaaagcatgtattataagaataatatttctttaagactattcttactattttatatttaaacacattcttttactgttaacttcaaattcactgcattgtattgtgaaagaagaattttaatgatctttctgactgtcagaagttctcttgctcattcttcataggaaataggtgctgttacgttcttgtttattttttctacacatagttatcttattgtgaaaggctgttttgcaagaaataggaaatctgcttaccacaaattctgataattagatggtgaaatgagacccacctaagatgattaaagagttagaaaatatggcctaagtagaagcattaacacagttacgctgtataatttttaatcctttttttaaagaatgggttgatttaacaacaaactgtttcaggtagctgccaataatatttctatctatcttaatttttttttttttttaagtcagagtctcagtctgtcacccaggctggagtacagtggcgctattttggcttgcagcaacttctgcctcctgggttcaagcgactctcttgcctcagcctcctgagtagctgggattacaggcgcgtgccaccatgcctggctgatttttatatttttagtaaagacagggtttcaccatgttggtcaggctggtcttgacctcctgacctcgtgatccacccgcctcagcctcctaaagtgctgggattacaggcgtgagccactgtgctcagcccttcatttcttatagatcaagaaaaactgagtttttattgctgcatgagatcaatagtttaggaataaagggtaatttttgataggatttatgtagtggcaacatgactaagctgaaagagctaggaattggaagacctgtatgaatgacctagctcttctgcttaattggtggcttgatcttggccacgttttcagatgagcctcccttgcttgtttgtaatgggaagaagctgtgcgtgcctcccacctcacctgttgtgaaggtccaaataagaaaatgcataaaaagcactttgtaaactgtaagggccaaacagataaagctgtttttgaatgagggaattggagacagaaatctttttttgctaaaagtcttcaaaagtaagtcagaatctcatttttctgggggtagttctagccagtcttttccacaagtagcaagaaagactaggggagcactgtcaacatttgtcatgagggggtcgggggttttgttctgcttgcatatatagctgaaaacttcaagactctttatgaactgacttgacaagatactccatcaccagccgtgattatctggtataaaagccttatggggatgttgctctttgtcctgaactctctctctcttttttccgactcctgtgtctggcgagtacatactcccttctttgtactatgctggaacaccttgctgtgctgcagtcatcattgttgaatccgacgtggcttccctcattcgtgcaataggaaattcactaattaatgactgtatgccagctgtgcctcccagccgctcttcaccctgccctgttgtacttgcacatccccattccttccctcccactgcctatctccacagcggaagctggacaccctggaacacctacattctaaaactgattttaagtctaacaggatgagaatgtcctactaggctacctgagaacttgatctataaactgtaccggtcacatacccccactctttcagaaattgcttgtattttattgtaaaaattattgttacagggttaagtgctgctaggaaagtcatgccgcaaggagagcaaacagccctcgtgtcctgggcatgtcctgatttcttccgcttcaatcggtgccactattctttttatcaagacctgaaattattctataatttccttccagcaccaaagatgctatattttgaaatatttttatctattaaattgcttttcattcagtaatatttttgtctttattaatcagatctatcaatcaaaattcatgatcagggtgagacaactatttgttaccacacatggctgataaactcgcagccagaagcaaacgattttgcggtttttcttagcctgggctgctttaaggagtgtaaatttatgaatctcaatttcactgtttggaagtatctataagagctctgttatggacggcagattttggttcccccatcctgcccctcttccacatgtcaaagacctgaccctccagtgagatggtgtttggagctagggcccttggggggtaattaagtttagatgagatcatgagggtggacctctcgtgatgggattagtggccttctaaaaataggaagagagagagatctctctccaaacacacgcatcaaggaaaagccacgtaagaacatagcagcaagaaggcagcattctgcaaattaggaagagggcccataccacaacccaacagtgctggcagcctgatctcagccctccagactgcagaactgtgagaaataagtatctgttctttaggccacccagtctatggtattttgttatagcagccctggctcattaagaggagcgctctcaatcctcttgctatctccttgcacccttaggattgagaactttttttttttctttgacggagtctcgcgctgtcgcccaggccggagtgcagtggcgcgatcttgcctcactgcaacctctgcctcccaggttcatgccattctcctgcctcagcctcccaattagctgggactacaggcacccgccaccatgctcggctaattgtttgtatttttagtagaggcggggtttcaccatgttagccaggatggtctcgatctcctgacctcgtgatcctcccacctcagccgcccaaagtgctgggattacaggcgtgagccaccgcacccggccaggattgagaacttccaacatgggaaccactacaacagaacaagacccttgaaacaggtttgtgattgtaattccttaatgctgaccatgatgtgtaaattacaatatgtggctttcattaattcaacattagtttgagccattctattcgattatattatcagtcaccatatattagttattctgtgggctcaggaaaatatgctaagtattttatttgtgtgggaaatatgttttttaagaccaagtatttgtaaatgttctcttttctgtaggattttttttcttttggatacaaatatagttaaagctcattgagaacctgcctgatggatgcttctatgccttgtttctaacagttccccaacactttaagaaactgaatattaaagaagatatttgtccagggccactcaactggctggtggtagagctgagatctgccttctaggttttatgcctccaaagctcctgaacttcaaagtagatttcacagtcactttagcaaatggtctgacccacattcttcccaaaattagatttactgctcaagtcaattggagtctttaaaaagttacttattttcatggcctagactcagacaaatgcattcctagtgaaactgaaggcctgggtcactgaggtattggcctttcagtcagcccaccatcgtggccaccacctaaggtggatgagttgtcatgcaaggagaatgaggagggtgggaagggttcttatgcttacccatgaagaactggggagattctgtctggagaggagagaaaagaacccatgcctttcagcaggaagagatatcttgtcatctgatatttaagtaacatttcatggccgggcaccatggctcaagcctttaatcccagcactttggggggccgaggtgggcagatcacgaggtcaagagatcgagaccagcctggccaatgtggtgaaaccccgtctctactaaaaatataaaaattagctgggcgtggtggcgcgcacttgtaatcccagctactcgggaggctgaggcaggagaatcgcttgaacccaggaggcagaggttgcagtgagccaagatcaggccactgcactccagcctggcaacagagcaagaccccatctaaaaaaaaaaaaaaaaagtaacatttcattaaggttcagcagtgattttactaaccataccctttaaccacacacacacacacacacacacacacacacacaccacacacacatgtaaaagagacttctggctctgccactttctagctgtctgacgtctgtttcagttttcccatctgtaaattggggcttaataattgtacctaatttttagagttcttatagagattagatatcttcatacagataagtcccttagaaagattcctgacacaataatgttggatattatgacagtaattattattttcagactgtatgctctgatgcctataaataaatatgccaatagaaatacatcctcctgacttttatttgacttggcccatgctgcaatatataatgtccatttactgctccattccctttgtaatcaccacttcccaaaataatgattccttctcatttgaggcgtcttgcagaaaacactggaatgagatttgaaatcacaatcaacacatccccaaagacataggttaaaaacttattgatccaatccagtgaacaaaatagagactactcaaatcaaagatggtgcaaagataaatgtgaaggtcatattaacacaaggaaatgttgccaaggtaggaaataaatatcaaccaaaaaatgacaacagcctggaaaaatgcaaactagaaaatctggagggaaggaagtgctgaaatataaaccaggaatatgcttcaaaaaagtctggtataaaatacaaaataagcttgaaataaagcaaaaaatgtatgatcttaagaactacagttaaggagacgtgaatgccttatcttataagcttcttaaaggcattgaatttgcttggtctttaacagatatataaatgtcatataatatcatacttgtttttaactatctggttgaggtatgacagtaggaataagtgttagaatcattaatctgtttttaattctgttttcaaatcttgtgcatgagtgtgcaggttagtgagcagctgggtactggtgtactgaccctaccactttttcctacacattttcatccagttaagcaatagtgggggaatctagcagaattcaaatcatcagctttatgacttgtaaattgaattagagcattcgattttggtctgcagactgcccactccccttttaaattagattcactctcctagtcccaggcacaactgtccatgtactgtctttgcagatggcttccatttcttgggctaagactattgctctaatcctggagtataagaaacatagtaaaacatgtcaatataggaaaacatagtaagcagatcatggatcttggaagtcagacagaccagaattcatatctggctttgctacttatcagttttatcatcctgaggaagttatttaaattcttcagacatcctattactcttctctagtatgcttgctccagatggaaatgtcagaatccaaaatccacaatgtaagcatataaattttttatttaactagatcaatttctgatgttaaacttttgtttggagaatgcatcttcactttgaactggaggcaaactattcactggaatagtctctttcctccaaattacttttcagagaacttttgttcttcctctcctccttccttcctttctttccttccttctttttctttctttatcccttccttttttcccttcttactctctttctttctttccttcctccctccctctctctttccttcctccctccctctctccttccttcctttcttcctttggaaaaaaaaaaaaagaaagaaaattcttgttttacaatactggtagaacacaggcttcgtcaggttgagggcttctacccaccatgcagtggtgttacagaccgtttctacatcttaaagttgtcaagggtgtcggggtggagaggagggacgcttgcctgagtcctcagtatccatgttatgggtgagtcaggtgttgactcatctcacacggccccatcctggtccacggctttggcagattctctgctacaatggggacaagatctttttgaaattgcccctacttccctctgccagctgctctttgaatccacactcacctggaggctcacagcctccaggaagcaatgccagaaatctggggctgggtttcccctgatgcaggacctcaaaatatatattcttcttttctgttccccttcaaccattgaagacattttttttttctaatttgtggtggggaaacagctcctttctcctatttgcagctccaagatgatactcctttggtgagctaattctcttgtacatttcttctgcttcgtctgaaaagtctttgatttcttcaaagaacttagacttttcttcctgctccctcctaagacattgtggtatcttcttgactgaaagaaacagacaggttaaaatgtgtgcatgggggtaggggttggaggaggagaacaaaacaaagcaaaacttacacacacaagttaatatctgagtacagcacccagttatagcacctgcgtgctattgattggagataaatgtgccctgtctataggacattagtaacataaggtatattctattagaaataatgcatgtaagtgatggatcatttttgttgaataatgtgaaaatcattacagtgaaaagagaagacttcagacctacaactgtgtttgtgtatgtgtatccctcgtgtctgtatatatatttagaatacttaaaacacattcaatttactaatggtttactgcttcccatgccctgtttgctgtacagctagtattgtgctaaatataatggtagatatgaagtaagcttcacacatgtaaaattctttcggagttatatggaacgactaggaaattatttgtcagagcagctttgacttcactctttaaaaaagtctctctgaaaagttgacacttttgtcaaaaagattcccacataatatgacaacataagagtaaacttgcactgatacagagtcaaaaataagaagtccttctacatgacttcaagctcccagtcagatttccttgtagatgactgactactccagaagaactttaaagaattctggcatgcccagtaatgaaggggacccgtccagcactgaaggaacaagaggatttctaaaaagggacacttttctaatgcgattcactgatctatttagaaaccatggcacaaatgaaaacatcaagtgtttgtgttagaaaactgatgaaccctgatgaacacaaataagtgatgttttcatgttttttttttttgctaagaaaaaagattatagaaaaatagcaggcaacccttatttgccaattagacacaaaatgaaatcaaaacccaacatttatagaaagaacaattaagaaacttttggccaactacaagttcaaagaaaataacaatagtaggcgacaaagtagaaataagtcgttttgctctgaaaggttatagttgaaagaaggtgactatctagcctagagatttcgtagaaattgtggcatagtaaactcacctaaaaagtgttacagtatttcaaattagctgctcacaaaagcgaaagccaagtctcatttttataaactccagtccttctgtccaagttcttttgtgttaactggattctacagtctttttttaaaagaaaacaacaacaacaacaaaacaaaaaaaacacttaatggattaaggttgcatcttgggatttagtcattttaatatgtggaacttctctcataattcttgatgaatgttctttcaaattttacctgcgtcatatttcacaaatattgattgcagacagcaaatgttgctcacttcttcaccaattgttttctcagactcaatcctcgttttagttgccactgacagactttgtactcacccaagaacattttagaggagacctagagcttttagttggacattttcttggaagcatctatctcttatgtaattcaagccttgcttgaaactaaatgtggagaaaacaaattacaaaaattcagaaagcattataattacaatgctgggggcattttattcccattaggaggaccatggatctctccttcctaactataacacctgcagatcatttctctgtgtggacttaccagagtccagtttctaacccgtagggtggagaataaggtacttcattacaaacctcaaatgcagtgtcaacatgctgagaccatttccctgagcacttgttccctacagcatgagagaaaatgaccctttaatgtgtattcagtcaaaaaaaatatatttgtattaggaatatttctctgagacttctgtgctgggaattaaagctatatctatatacgtaaaataaacaaactgccccgtggctggtctgctcatttcagctgtcttcatgatcaatgtggattgttgcacaatcgattcaaccacagcaatcagtattattcatgcactctaggaaacttggtgcaagtaaaatggctgggatgttggaaagtgtactcacttgttagatatttgatttaaggaattttgaaaaaatcgcattttatttttttaaactctcaatttaatcttttctgagtcaaaatgttggatccctagaataaaacctgaagtttgagataatcttttcaacatctcattaatgataatttctgtaaaatcttaataatttatcgtgagtcttctagtgctaaatatacacttaaaactcagagaaaaattgccatcataatttccaggacagtaaagcttgaatgtctagaaaaacagtgtgtggttcacagaaacttagattaaagtccagttggttaaaaaaaatactctttgcaaaattttctctagcatgtatcatacgcaaaaatgcccaatttggcagcttttctaggtagctttccaatcatcagtccggcagcaacctacaaggatttaataattcttatatctaggcttttcaaagactctttgtaagaaattttgattttttctatattgtaaatatcaaagagattaacttcccaagaagtcactttgtttagtaaaagccaactacaaacaagaggccgcaaatcaaagtatgttgtacagacatcattattggccacatagtgaaattctacaatatcaaatgccccaaagtaaattggattccaggtgaatttctgtgataatattgaatgcatctgccattgaaaagagacatctgtaggtcttcaggtgaaattgtttactaacttaggtcaatataatttgactaccaattgacaaaattgttctattggatatataaaggctatcctccaggaaagttaaatatctgctaaaattgcgaagattctgatatccaaaaataccatgaataccatgtgagaagcagagtctactatgaagaccacagaatatctgtgttgtcagttcatttcgactagaaatcagttgtattcctcgtggaatataaggaatatattccttcaaggcagcagatgttaaacttcttggtctcaggataccttttcactttaaaaaatattgagggcttcaggagtttatatatatgttgactatctctgtcaatatatagcatattaaaatttaaactgagaaattttttaaacacaagaatacacaggcacacgttccattggctgtcagagtgatcgcatagtcactcttcgtgaaacctctggagaacactgcgtgcccacgggagaatgagagcaacaatggcaaacaacgtctccttattaaaatgctttgacctcaccaaggccttgaaacagtattggggacccctaaacacgtctcagggacctgtttcacacatcatgagaaatgctgttccaaagactttttctcacttgtagaagctggataataataatcacaaagatttgtttgttacatatatgttgtgtaaatataaatgatcattactgagcaaacttcctaacctctccaagcatgagttccatcagctgttaaatggatataacaataccagtcttgagggatagcattaggagatatacttaatgttaaatgacgagttaatgggtgcagcacaccaacatggcacatgtatatatatgtaacaaacctgcacattgtgcacatgtaccctaaaacttaaagtataataaaaaaataataataatagtacctccaaaaaaaaaaaaaaaaaccagtcttgcacggtggttgtgaaaattagcattgatgtgtgtctaacccaaagtaggcacttacacattacaaaatttatctaatttgtttaacttctttctaactattaattaattatgaagcaaagctatgaaaaatgtataatctaggaaaggtttttcttcttatgcaataatgaccaaatgaagggaacacgtcaagaactatcctctggctattgttattctgatgcaaaatgtgctgctgaatgtttcttactagatacttacagaagcatgaagaacatttgtcaaacttagtcctgaaaaggtatggaatttgtggggcataattaaacatgaatataacatttcacacaaagtgataacactggaatgaaaaaagaactggggcttcatggagcatggagcatttgtggtgtatttgaagggagaggaggtatttgacgataagacactggtaggagttgagtgaagcacatttttttattattattattattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgtggtgtttggttttttgtccttgcgatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtatttgctattgtgaatagtgccgcaataaacatacatgtgcatgtgtctttatggcagcatgatttatagtcctttggaagcacattttaagagaaagaaatcttcaaagcttgactgttggtcacaagtcaaggttggaggcacctccaagccctccaaatactagataaggatgagctgacagcaataggattgcatagaagttgtgttaggctcccaagtactctccctgattccatgcagtcatgggaaattgcttctcctcatcctggcagaagcaaggtttgctttctgcagacactcattcagagaagctgtgtgtaggtgtaaggcactgccccaggggagtgtcaggtgctgctgaacacagagggatgaaactggtgtctccatcctgaagagtgacagccctgtcccttgcacttgaaccctgaacactggcaccctagataatatcattcagggaaaagaataactcaaaaggaatgaaatttggatattgattttgggaatctaccaagaaaatgactggctccttaatcagtgtatagtgaggcccatcagtcaacaagctcacccaggtacagggagtttctgagaagttgtctgcatcttgttcttaaattttactagtgacctaagaaataaggattactatacatttgagaatagcttgtcatatgtaagatagggagcaaacctccccatactctgatagccagctgggtagctagctagaagactgatgataggtaggtaggtaggtaggtaggtagatagacagatacatacatacatacagatagatacatacataagtagatacatagattagatgataggtagatacatacatacagatagatatatacatacataaaaagatacatagattagatgatagaagatagatagatagatagatagatagatagatagatagatagatagacagatagaccgaccaatagataaaagagctctgaagtcagactgcttgggttgaaacattgtccctgccccctttgctaatcgaatgaccttgaataagtcacttaaatcctgaagcctcaattttccttatctgtgacatgaggataataatagttcctacctaataaaggtgaagattacatgaaataaagtatgacgtgcagactaagcatctaatacatattttcaacataattggcaaaaagtgcagggtatgcttgaaaaactccgtttttcggcttagttgaattactctgaacataaagtagaaagcgaagatagagccagatggtattttattttgactattacatactaatataacttaggctatgtgagagaattatttacagggaaaagtttactaaccttttcttcacctaagaaagttcccacgaggcactgcctcacaccttctgcccccaacaagaaacagtgcgtgactcttgagtacacagggtgtgaaaagctcataataccctaatatgtctctctaagtacaattggttgttcatgttaaattggaaacacttaataactgcaaagttaatatgtgattaaataacaacagcaaaaaacctcttctccctcttgcccaaataggggctcatagctctttcagtgtacccggggcccctttctcagcttcagaaggctggatattgtggcaattaattgtttaaacacactacgaaggattatgatgagaggaaaacataaaacataataaacacttggtaaccagtttatttcaatagcagctcctctgccaagccagcagatttttctaggacagagctcccttccataggcagctaatctaggacagagctcccttccataggcagctaatctaggacagagctcccttccataggcagctaatctaggaagagctcccttccataggcagctaatctaggacagagctcccttccataggcagctaatctaggaagagctcccttccatacacagctaagaaagatcaggggaatggccttcaatggaccccgctcatcattccctacacagtcgcaaaaggctcaccacctccttcccatggcccggctaaaagaaaaggtgttatgtttctttaactctttggagcataaaggagctgttttttttttttagtaagaataacattataatcaggtgttgtttaaaaatagcaacaaggcacaaagaaaacaggcattgacaccaagaaaaattagctgacaccacgtaataggagagatttattcatgaatgacggaaagttatagaacttcttttctttccttagcagcatgtcatcattgcaacaaagtcatggcaagagcacgtgcaacattaggttcaattgatctcagatccttcctcaccagtgtcgcagcaaattcattcttcaccaatagcttaagtctttctaggttcctagactcctatgtctcaggtggggttttttaatttatttttgtttttgttttaccccccaacattaatgttcctgagaggtgtgtttgttttgttttgttttgttttgttttgtttgagatagagtctcgctctgttgcccaggctggagtgcggtggcgcgatctcggctcactgcaagctctgcctcccgggttcacgccattctcctgcctcagcctcccgagtagctgggactacaggctcccgccaccacgcccggctaattttttgtatttttagtagagacagggtttcaccatgttagccaggatggtctcgatctcctgaccttgtgatccacccgcctcggccttccaaagtgctgggattacaggcgtgagccaccgcgcccggccgagaggtggttttttaattggtgagagggctggggggatcaggcaggggaggttgcagtggcattggagaagacaatgcctaggggttgattagttaccactactaagggcctacagattcatttgggaaaaattctatggaaaatcaactggaggaaggtttcttccttggggagggtaatgcagggtgcccatgtggacatgcatgtgagcatgtgcgtgctgtgtgtaggctccaattacccttcaaatgctaatcttctatgattttacacattgataccatgaccaaaacatgttaattacacatgtgcacagatcactggaaaatgtatatcgctgaagacttagtttcttccatgtctagagctcagtttattaatatgttgttccatataacaagttcattaatgttgctgatttttaacatttagaatattaatagttctgagcatgatattttgatctttcctcagagtgatttttgaaaatatgaaaaatgagaagagaagtagttacctattaacttgctgaagtctgacaggaacagttgaccagagtcccctgcaagggctcttgggagcactgggtaccgagcagagccttcatccttgttaattaaccgtccaacattgagacaggacttctgcttagaataaatggcttgttagaaaacagagctacacacatacacagaatcttttcattcacggataactgagtgttttagaaaatccagacttttctaagactttccaagttttaatttcaaatatattttccatgtttacattataactgaccatgtgtctaaatatagctagtctatactatatgtattctaattgcttgatatggagcctgcagctgagtacttgaatccagcattcacagagtgatacagtgtatgaaaaccttttacaatattttcaaacaaatgtaatgaataataatgatttaaaggtcataactcttagctattcttatattttatgacattcctctgcaaggcaatatgcattaaacaatggctaaacattaaaaatatgttttagaagattttaaaaataagaggcatttcagatctgcagaaaatcctcatgtgtcatattattttaaagaaatgctggaatgcaaatatgaattgacctatacttgattatctgttttgatttcattattcaatgtcttcacatggaagatcttgacagtccaacaattcgttttctgttctcttttcagatttttttttaatttggaaaaagaaaatggcattttatttcctgcttttatggactccaaagtcataaaattgtaaagaggagaaaaactgtcaattttttaaaggttaaatgcaagaaaattagagtgcctagaagagcagactctggattcagtgctgaaaggtagatagcgctggaaggcaaactcaaggctgagtattgaacaaaaagattgagcaagggtaaatatgcagaagcagccccggtgaaccattccagtgatttcctttgcccatgtagttgcattgagttgcactgaatgtgtgcagcctttttactgcatagtagaagaatggcaattgtgtttttaagctgaccattaactttagagggaaagctgccgaaaggcaaaattttccttcccttctgccctcaatttttcctctcaaggtgtaggatggaagctttgtagttaagaaaaatctcagtaggcctgtcagaaaaactagattctaattgctgagtgtagcagagctagcacagtttttaatgtttgcacagtagaattagttaaagcaagctctgcagatacaggtttccatgtggggaacacatgatgttctgaccgacaagttgggtgtttttagttccagacattgcttgaaacaatagacaccatgggtgaaagaaagaaagggggacttatcactgcagaacctggcacgcatgaagaggatttcccccggcccagtgaaaacatgggcctatgaatattttcaagaaaagattttcacttaactctctctgtaaaacacagttgttggggtgtggtatggtttggctgtgtccccacccaaatctcatcttgaattgtagctcccataattcccatgtgtcctgggagggacccagtgggaggtaatcgaatcatgggggtgggcctttcctgtgctgttctcatgatggtggataagtctcatgagacctgatggttttataaagggcagttcccttgcacaagctctcttgcctgctgccagtaagacatgccttcgcgtctcctttgccttctgccatgtgtgaggcctccccagccatgtggagctgtgagtccattaaacctgtttcctttataaattacccagactcaggtatgtctttattagcagtgtgagaatggactaatacagaaaattcatactgggtagtggggtgctgctgtaaagatacccaaaaatgtggaagcaactttggaactgggtaacaggcagaggttggaacagtttggagggatcagaagacaggaagatgtgggaaagtttggaacttcctagagacttgttgaatggctttgaccaaaatgctgatagtgatatggacaataaagtcctgaggtggtctcatatggagatgaggaacttgttgggaactggagcaaaggcaactcttgttatgttttagcaaagagactggcagcattttctccctgccctatagatctgtggaactttgaacttagagatgattcacagaatctggcagaagaatttaagcagcaaagcattcaacaggtgatttggtgctggtaaaagcattcaattttatgtattcacgaagatatggtttagaattggaacttatgtttaaaagggaagcagagcataaaagtttgaaaaatttgcagcttaacaatgtgatagaaaagaaaaacccaggctgggcacagtggctcatgcctgtaatctcaacactttgggaggctgaggcaggcagatcacgaggtcaggagttcgagaccagcctggccaacatggtgaaacccagtctctacgaaaagtacaaaaaaactagctgggtgaggtggtgcacgcctgtagtcccagctactcgggaggctgaggcaggagaattgtttgaacccaggaggcagaggttgcagtgagctgagattgagccactgcactccagcctgggcaatagagggagactccatctcaaaaaacaacaaaaaagaaaaacccattttctgaggagaaactcaagcctgctgcataaatttgcataagtaatgagaagccaaatatttatcaccaggacaacggagaaaatgtctccaagacatgttagaggtcttcatggcagcccctcccatcacaggcctggaggcctaggaggagaaaaaatggtttaacaggctgagctcagggcctggctgctttgtgcagtctcaggacttggtggctggcatcccagccatggccaaaaggggccaacgtacaactcagaccattgcttcagagggtgcaagccctaagccttggcatcctacctgcagtgttgggccttcaggggcacagaagtcaagaactgagctttgggaacctcagcctagatttcaaaggatgtacggaaattcctcaatgtccaggcagaggtgcactgcaggagcagagccctcatggagaaccactgctagggcagcacagaaggaaaatgtagtgtgggaggtcccacacagagtccccactggggcactgcctggtggagctgtgagaaaagggccaccatcctccagaccccagaatggtagatccaccaacagcttgcacggtgcacatggaaaagccacagacacgcaatgccagcctgggaaagcagccaggagtggggctgtaccctgtaaagccacaggggcagagatgttcaaggctgtgggagcccaccaggtcatcagcatgacctggatgtgagacatagagtcaaaggagatcattttagagctttaagatttgactgccctgctggatttcagacttgcatggtacctgtattccctttgttttggccaatttctcccatttggaatggctgtatttacccaatggctatacccccattgtatctaggaagtaaccaacgtatttacccaatggctgtacccccattgtatctaggaagtaaccaacttgcttttgattttacaggctgataggtggcaaggactagccttgtttcagatgagaccttggactgtggacttttgagttaatgctgaaatgagttaagacttcaggggactgttgggaaggcatgattggttttgaaatgtaaggacatgagaattgggagggctcagggacagaattatatagtttggctgtgttcccacccatatctcatcttgaattgtagctctcacaatgcccacatatgtagtgggaaacacccggtgagaggtaatggaatcacgggggcgggtctttcccacgccgttctcatgatagtgcatgagtctcacaagatctgatggttttttaaagggcagctgccctgcacatgctctcttgcttgctgccgtgtaagacatgactttgcttctcctttgccttccaccatgattgtgaggcttctccagccatgtggaactgtgtgtgcattaaacctctttcctttataaattactcagtttggggtatatctttattagcagcatgagaatagacaaatacaggctgtttcagagcttagtgtgtcctgctgatgcttgcacagtcctttggaaccatctgtgccctgcagtgagtcctgttccttttttcatattagctctgaaaccaccctttacaagtattttcaaactatctgaaaaacagcacttgattttcctcagtgttacagatgcaggaagccatcaaagtattatttgtttcaaagctctatgaatttttaggcaaatgtcactctatgaatttttaggcaaattcaggcaaaaaacaagtaaattctcatttaatatgccatatgtttctggtgcctaaactcctcttggagaataaaaggaacctttagaacactgtgtggcctcccacactcttcaaggcacttaccttactctcgaggaataacagagacatctaggtaatcttaattaattactactgacaggatgggagagaagtgtgtctaaggcacttatcagtatcatcaacagaattacatttagaaaatctgctctgtataggaaattgtgctccatagtgccctggggaaaataacaataacatatgacacactgcctgccttcaaggaaattattatctgggtgaaaataagatagacacctgtgaaggtaaatagcaaaacgggtggtatcagttacctgcaaaatgagaggtacgaggaagtaatccagaaaatcagagtagtatatcaccccagcattggaaaagacattaaaagtcttctagttcagtaatttactgatgcttgagttcacttgcaacataagagttcacatttattgagtattattattgcagacattgttcaaagtattatgaaaatacatattgaaaatatatgttcattgtttcacataacattttcatgagctgggattgtttacaaaggagagaattaaaaatcagaaaacgtgaataatttgtccaaagtcccatagtcactaaatgatagggcagtggttcaaactcaggtcttccctacctagagccagtgcccttcatcagtgtaagatagtcatgctggcctctccagtcatggaggcccagacaattcccagtggctcattccatcacagggagatggggagaatagtaagggtttcatagacttgaatgttccagaaagaaggaagtcaaaaagttaaaattaaagaaatactaattaatattttaaaaggcaaattccaaaccacacatgtaatctgtagaatgcagatttgtacacctttgagggaactcaactttcaactatcagaatcagtcctgggtagctaggatgatggtttgagaatagtgttatttttcaagatctttgcttctgtgaaattttaaaaggtaattgaaatattgagaagcctatgaagaggtgaatttaatataatccacagaatgacaaatgtacatttagaggatttaaatttaggaatgatgggcaactgatgcaatggttactattggccgtttgataaaagttctttggttttggaatttatttagtatccaacaacatcttttgctaaatctatagctctcccttgagttttatcttttctcttgttcattggtttatttaatttcaaagacaattacacacgccaaagtaatgatcctacagatgtataagtgtatcctgagatgaataaattatggacattttggtaattagcaaatggaaggggagcagctggatgcttaacacagatgggtttattggttaaaataaacttcagtttgcctttttttcaaattaagcaatattagccccttttgttgctttgtgaacaatcaaccaaacagcataattctagatggattgctctttgattgccattgctaaatctaattctaatgatttaattgtttttaatttctctgtggcctatatgtgtgggctgtgtccctgtctgtgaggcttaaaatctgaggaaaaacatgcttcatattctcatgagcaaagtattcatatgtgatctggattgtagctttgtgccaagcttcttctacaaatgagaatgaaaggaaaatttgtcgaatacaattttaccctcttaggtttttctttataagaaataacagttcagtgtgattatgtaaaatcattgggaatggggtgatccagtgttttaagaatacgtgtgtaaatataaaagatagaattattgattaaaatatccttacaaaataatcatgtcacttcactgcaccaaatggcgatggatcacccccttctataaaagaaaaaacaaaacttccttgacagcgcattaaatgtcttgcataatccgaccacagtcacactgacttggactagatattggggaccccaagtgatacaatgcatgcaaagattgttgaaggagccctttggatctgggttaaactgtgacccagcacatgctagttgagcagcctcaaacacgtgaattaaactgtctaaatgtggttttcctcactgaggggggataataatgctacctttcctacaaggtcgtaagactagatgaaatgataaaaagggcttagcacagtgcttggctttatgctccatgcgtgatctacttacctttcgtttctgtattgttgctgctgttgtaacttttattatctgacctctcatgcgtatttgcacctgaagatctgtctagagtgctcttttgtcatctgaatgatcaaattccataaatctttcaggactcagctcatcggccatctcttccactacattttgccagtcttccctagctaaaagctaattcttcttctataaaagcattgcaattcttattgtcagtgacagtcatttgtacttaatccttacaggcttctttaggtatttatctcttcatgtacttctcagtgagatagcagactccttaaaagcaggaactgaggcaatttctacatatcttttgcagtttctggcagaattgcaagcaatgaatatttgttgttttattattttttatccttcatggttgggaattatatgttgttttaatcaacactcaacaaatccagaatgcctcatcattagatgaaatggccagagttaaatggcaacctaatctgatagctcacatttattaaacattactgctaatgttttttatgtcccagacactggttctaagcacttcataagttttattttctttaatcctcttgcagacactatgaggtctgtattattttaattattttagatcagaagataataaagcacagaaggttcaaaaaaatttttccaaggttatatagtcagcttgagattgagccagggtttaaatccaggcagactaagtccagacagagaccatgctcttaacctctattcaattctatctatccattaatatattcagtcatcttcttaggttcttttcaactgggcaaaacccataaagctgagaaataactatggcagatgtcatttttcatccttttagggggcatattatgtaaatatgcctatttacataataaaaaatcaagtctatagataatgagacaaaatattttaaattaagactgccttggcaaaaatctgggtacaagatgaaaataaaaataggtaacacattttgaggtatcaggtattaggctgataaagtgaattttcatattttggttattactgctgagaaagagaaaaacagcctctggcagctgggagctagcttggcattatgagctgggccttgatgttctcctgtgcacataaactatttcacagagcatcagcgttagcatcagctaggaccactctctgaccaggatggatccaggcaaaaacatcaccactccagaggcatgtctgaacccagacagaaacaagaacattttccaaaccacaaaattcaccaaacatcctcttatcctggctaaagtgagaggctgctgctgctttaccagtgatagctttagccttctctgttcctcctgtcttctggatgagaattattaagatactgagtcacaaaaatgccactgctcctgaaaagcatcccatccagaacaaagctttccttctttgagccttttcctaaatcacttaggataaaccccaattctgccagttctttctaatattctcttactgatgtggcccccagatccccatgatgtgagttgccccgcactggaacatttcaataaaccagttctccaactacaagtttcctggtgctgtgaatctggagagcattaacactattattatccttatctcagcaatgaaggaacactgagtaaggtcaaaactactgtttgattctatatttaaacccagtttgtctctattgctgtcattatttttgtttttgtttgtttttattacgtaggctccggaaactgctctcttaaccactacgttatacagctcccttatggttactgcaaacacagataaataataagatgagaggaagtgaccgtctactgcattactatcacgtgctacctaaattgatatgtttttctaatttaaatctcacaaccctttcaagcaacaatccttcttttacagaagctcatttcagctattaaagaagtccatatttaaaaatatgaagtaatttccctttataacagaagtctcatgactagcaagttttgaattttaattccactgtctcaggtaatatactcacatgcttacaccacattggaatagttattatctggaaaggagctgaagcaagcactgtcttagagcatcgtctggtctggtattgctccttatttcttggtaaggtccagcaagaaacacatgatcagaatgcaccttctttatatttccaactgctgtttgttctttatcacaaatattagaattggggatgccttatctccttctttattatctattgagattgactcgattttgagagtaggtcaattatcacgatagaacttttaatcttatacatataatggctctgactttaaagtttctaaaagaaaattgagaaaatataattaaatgtatgtttcagggaatggggcctgtctaacttatgatatcaataaatgctataataaattatccttattctaaacaattgctgccagtcctctgaactatggcatgacgataactggagtatcttgggatcctggggtgcttctatcccaagagtatgtgaagtcctgtttcatttattttatatttttctataccaaaatcattttccgaaagactacaagaagaagaaaggaaaacaggaagacctaccatctcagactcctcatttttatgtgataccaactttcaaaataagttctatttaggtgatagattgtttggtgaaaaactacttaaaactgtatttgagcaggaattctttgtgataccaaggaggactagatagatatcaagtaaactcctgatttagagatgagaactagatagatattattaagtcaactcctgatttcagagatgagaactccatagatattattaagtcaactcctggtttcagagatgagaactccatagatatcattaagtcaactcctgatttcagagatgagaactcaatagatagcgttaagtcaactcctgatttcagagatgagaactcgatagatagcgttaagtcaactcctgatttcagagatgagaactcgatagatagcgttaagtgaactcctgatttcttacagtctctgctaatctgctcactagcatggctaaaggaaatgttgaaattttaactagaaagaaagtatttgactatttgaattttcatactcttgtttaaaatgaaatagtagtaaaacatttgggaaatgtaattaaaattctggttctaaacatcttcatgaagatgacatcattagttatgccagaattcctggactgatttttcagattaagtgttgtcattaatgggcatcaatctgtattgaggaggttttttttcctgaaaatataaacattacatacattatgagtgacaacaaatcttcatgtcatatagagaaccatttacacttcatatctgtgaacattcatgtatatattgaacaatgtaattcttaatgaaatattgatttctaagtgccatttacttataaaacttgagtcatgatttcagtttaagttggacaacaaactccaaaagaaaccctgcagccagtgtgtctcatgttttaggaagtgcccaggcagctatgtggtattttttccaacacagagcactcaagatccaggtcctgcagatgaaatttgtagccttaataaacatatagggttgttgaacagtaaaggggtttatttgtacttttatgagtacatttttctcttttgtttactaatgaactaaaatttttctgcatgaaaaagctcaatatagatgtagaaatcttttagagacatgacaaaatgtactacgtcagagccaccagtactcacgttaagtagacagatcacacagacagcgatcagatttcacgttcaagagttcatcttgagttaccgttctatagactcagaatgaagatcacctcgcttattaaaggcaataaaagataaagaaaataggaaataagaaagacttgattaaatggccatttcactgaattcagcatgagtcctgcacaaattagacatttagattaacagcttctttgattattagaaagcctggaaaatggggtctgacaggattatagcataagctcatttataatgattcattttttggaatgtagctttttcataagccaaatagaaattacacatacaaattcatatttggaattttgttcttatttttgaattttgcctatcttttcaggtgtctgtgaactcaagagaagcctttcattctagacatagtagttattttctaaatcatctttaaacttatttgctggaatattgtgggggtaaagtgcaaacttccccttcaccatctgaaggtttgctaaaaatcaacaggcagaaggcgaattaacaggagaaatggcatgccaatttgtttgatcacagttttacatgaagaatgaagacccaaagacacatgagaaattgtccatttttatgcaacaccagaccaggcgatgctctaagacaggtacaacaaagtatggacatgcgtgtagaaatacgagtcaactaaagggtgtgatctactgctaataggctgagtggggacacccagactcttcctggcccctgtgagcagcttcctttccttctggtgtggggcaggaacttctctggaatggggatcttctgacccacagtcaaacaaggtaggtcacagtttctttatggccagttcttacacagaatggtgggggaaagttagaataatattcttaggttttatggctgtctttgggagaaggggttttggtttctctgacgcaccttagggaaagaaaatttctagtttctctgtctagcctcaagagagaatgaggctcagagacataagggcagaagaaagtcagggagggttttttgccactgagcttgcttctgaggccatctctgaggccttcactttggggtgtcattttatgagccccagcaatatctttctaaaaaatatggaaaaggcttaaaagactcaggccattttagagctatataaacttgtataactaagaatggagaattgttactgaaagatactaggtctctttttatactaaatttataatacagtgtagctccctcagaaagaaaaagtgaggttcattcattcatttattcacttactcattcacaaatgtttgttaatcacactagtctcctctcaagtaagtgaaagataacatataatatacataacaggccgggcgcggtggctcacgcctgtaatcccaccactttgggaggccaaggcgggcggattacctgaggtcaggagtctgagaccagcctgcccaacaaggcgaaaccccgtctggacaaaaaatacaaaaaattagccgggcgtggttgtggcgggtgcctgtagtcccagctactcggaaagctgaggcaggagaattgcttgaacccgaaagattgcagtgagccgagatcgcgccactgcactccagcctgggagacaagagtgaaactccgtctcaaaataacaacaacaacagcaataataataatatacacaacaaacatattttgaaggtgataagtgcaacaagagaaaagagtcgaacaaggggaatggagactgcagggagtaggggagggatagtatgagtagaagttcattggtgtagacaggataagcctccttgagaaggcaacactaaaacactttttttttttttaaaaaaaaaagagaaatttctgtggggacatgaaaggtattaaacttgtacatagaggcagcagccagtgcaaaaactctgtaggaggaatgtgatcactccaggaataagaggggtccatgctctgtgacaggacaagaagagggcaggaagaaattaactggagtgatagagcaaggctgaccgtgcaggatcttgcaaaccactgtgatgcgaagtcttgagcttttaattgaagagaaataggaacccactggaagtttaagctgagaagtgacgtgatcgctgctgaatttttggaggattattctggttttgtgttgaaacttcagtagatcaaggctggaagtactggagaactgttgagaggccactgaaataatccaggtgagatacaagggtggctgcaccaaggttgtaactgtggagggactgatatgtaccaggtcttggatacatttaaaaggtaaaagcatataggttttcctaaaaaactggatatagaagaggtaagaaagatggaggagtccatcatttggcttcaggaacaagaagaatggatttgccattaactgcgatgggtaaaactgtgaaggaaagcaaaatatttcacccaaaatatatttctttggcatgcttcaagatggctattcagagaagctgcaaaccacaggaacagatttggaaagttgtcttttttatggaacgtttgcacatgtagagaaaaatctacagcaaagtaaatagcagatacaaaaagtctttttctaagcccacccttgtccaaatgtaggaaaaatacacaggagagaccaaaagtctaatatttttaagagtctgatgacaggcccccatctattctttttttttttttctttttttttaaagattgcattttgctatgttgcccaggcttgtctcaaactcttgggcctccagtgatcctcccaccccagcctcctgagtatctgagactatagccttgcatctgttctttttgagagctagtgcttcatttgcataacaagatcagctctgattgacaacatttcctcccctcattctcccatagcctgtgaggctacctccctggagctcacagaaactttgtcctaggccgttgttctttgggctcattcatttcccctgaaaattatttacttctgcattccccatctctgtcctccccagtgaagagggcatttaagccagacaaggacaaaataaaaaaataataatggccagtcacagtggctcacacctgtaatcccagcactttgggaggccaaggtgggcagatcacgaggtcaggagtttgagaccatactggccaacatggtgaaaccccgtctctactaaaaatacaaaaaattagccaggcatagtggcaggtatctgtagtctcagctactcaggaggttgaggcaggagaattgtttgaaaccagaagctggaggttgcagtgagctgagattgcaccactgcactccagcctgggccacagagtgagactctgtctcaaaaaaataaaataaaaaataaaaaaaatcacaagccaatatcattgatgaacttagatgcaaaaaccctcaactagttagctgaagtcaacaacacattaaaaagatcattcaccatgattaagtgggattcagcctaggaatgcaaggatggttcaacatatgcaaatcaataaacaggatacatcatattaacagaaccagaagcaaaaactgtatgattatttcaatagatgctgaaaaaatattcagtaaaattcaacaattctttattataaaaaccctcaataatctggatagaaggaacacatcccgaaatgataaagactatatctgacaaacccacagctaacatcatactgaatgggaaaaatttgaaggcctttccccagagatctggaacaagacaagaaggtccactttcatcatttttattcaatgtaatactgcaagtctgagccagggcaattaagcaagaaaaagaaatgaagggcatccaaattggaaaggaagaagtcaaattagacttgtttgcagatggcacaatgttatacttagaaaaacctaaagactccagcaaaatcagttagaactgataaatgtattcagtaaagttgcagaataaaaaatcagcatacaaatatcagtaacttttttatttttctgaggcagggttttacaaatgtcacccaggctggagtgcaatgatgtgatctcagctcactgcaaccttcacctactgggatcaggcaattctcctgcctcagcctcctgagtacctgggactacaggcacacgccactgcatccagctaatttttgtatttttttgtagagacagggttttgccatgttgtccaggctggtttcaaactcctgagctcaggtgatttactgcctcgcaaagtgctgggactacaggagtgagccactgcatctggtcaaatatcagtaacagttttatatgccaatagcaagcaatctgaaaaagaaatcaagaacacaatctcatttacaacagcttcaaagaatataaaacacctaagaattaatttaagtaaaaaagtgaaagatccacacaaggaaaactatgaaatactgatgaaaaaaattgaagaggacacgaaaatatggaaggatatacagtgctcttggattgaaagaagtagtattgctaaaatgaacatactcaaagtaatttacagattcagtgcaatctctatcaaaatatcaataacagtctttacagaaacaggaaaaaaaatcctaaaatgtatatggaactacaaacacaccaagtagccatggcaatactgagcaaaggaacaaaactggaggcatcacattccctgactccaaaatatactacaatgctatagtaaccaaatcaacatggtactggcataaaaactcatgcatgcactgatggaacagaatagagaacccagatatcaacccacacatttacaaccaactcattttttacaaagtcaccaaaaatatacaatgggtaaaacagagtcttttcaaaaatgatggtaggaaaactggataaccatgtacagaatcatgaaactagacccctgtctctcactatatacaaaaaccaaatcaaaatggattaaatacttaaatctaagacttgaaactataaaactaccggaagaaaacaatggagaaatgctccaggacattggtcagggcaaatattttttgtgtaagatctcaaaagcacaggcaacccaagcacagttagagatacagaattacatcaaactaaaaagcttctgcacagcaaaggaaacaatcaacaaagtgaagagacaatctaaaaaataattaaaaaaaaaaaatttgaggccaggcacggtggctcacgcctataatcccagcactttgggaggccgcggcgggcggatcaagaggtcaggagatcgagaccatcctggctaacatggtgaaaccctgtctttactaaaaatacaaaaaaaaaattagccaggtgtggtgatgggcacctgtagtcccagctactcaggaggctgaggcaggagaatggtgtgaacctgggaggcagagcttgcagtgagctgagataatgccactgcattccagcctgggcgacagagagagactctgtctaaaaaactaaaaaaaaaaaaaatttgcaaactacccatgtgacaatattaataactagaatatataagtaactcaaacaactcaacagcaaaaaaaaaaaaaccacaataatccagtttaaaaatgggcaaaacatcttatcagttagttcttaagagaaaacagataaatggccaacaggtatatgaaaaaaatgttcagcatcactaatcatcagagaaatgtgatctaaaactgagacatactctcatcccagttaaaatggcttttatcaaaaagacaggcaataatgcatagtggtaacgatttagagaaaagggaaaccttcgtacattgttggtgggaatatcaactagtaccgccactacagacaacagtatggaggttcctcattaaaaacctaaaaactgagctaccatatgatccagctccattgtactgctgggtatttatccaaaagaaaggaaattagtatattgatgacatctgcatgcccatcttgattacaacactattcacaaagccaatcaacctatgtgtctatcaatagatgaatggataacaaaaatgtagtacatatacataattaaataccattcagtcataaaaaagaattctgtcatttgcagcaacatggatgaaactggaggtcattatatcaaatgaaataagccaggcatagaaagacaaatatctcatgttctcatgcatctgtgggggttcaaaaggtaaatctcatgaagacaaagagtgtattggtggttaccagggcccaggaaaggtagtggggagggaagtatgaagagaggttgataaatgggtacaaatatacattctgacagaagaagtaagacccagtatttgacagagcagtagggtgactatagtttacaataatctaatgtatacttcaaaatagaagaaaataatttgaatatttctaaaataaagacaaatatttaaggtgatggatagttcaattatattgagttgatctttacaaattttatcaatgtattaaattatcacgtgtcctgaaaatatgtacatctattatgtatcaatacaaaaatttttaaaaaactattctgtacaggacaatggtctaaacacttggaatacaggattgacaaagccttctgaaatttacttcagaggaggaaatatatagtaaacaaataaacagcaaaatgaaaacctagagaccatgtgataaacagtatgaggaaaataaaactgagtcttatgatagcttctaatggagcgtcattgagtggggtgttattttaggttgagtgatgagcaaaggccctcaaaagatcacattgaactgaaacaatattgtcctaaaaaagagtaagccatggcaaattctagagaaaaagatttccaagcagagaaaatagctagtgcaatggtctggaggaagcaagaagctcagtatatttgagaaaaggggaggccaactgagctctggcacagagaatggaggagggtgataggagatgaatttagggaggcaagaaagcacccaactctgcagtggcctgtgggctgtacaagcattttagatgccagtccttggaggagtttccaggctgtgataagaccttatttgtgtttttgacagaattggacagaagtcacatcagggagaccagagactagagtattgcatcatagaggaaagacactgatgacaagacctcaggggagcagtggaactggaggcctgggagcttgggacgtgttctccgggtgaagttggctggccagctgatgacctacaccagtgccattcactcctcatgtgtcccccgggaattcatagtgtgtgtcatcaggtaaaagcaacactactttcagatgttttctgatctctttgagatctggacaacactactgtgtacatatggccagcaacaaattacactcaatgaatattttagagagcagcaaagtaatcaattaaaatgtgggtaaacaaaaatcactgtgatcacagctctgtctacatggttctttggtaaaaaattagaatcctggggattagtctgaggataaatattatttaaaaagcattttggttaaatagtaattagtaaattttgctctgccgaaaaatcatatatattgacaataaattttgtcaaatttattaataaccagtctgaaactctataaagatgaatcctcaaaatatggatataaaagaagggtttagttttgttttattttcagacagctatttttaaaaaaatagtaaaaatgtcaaaacaatctggttttattttattataaattacaaagaaaaaaatacttccctttttgttgttgagcttatctattcacaaacacagaaagtagcaaaagaggtttttgatagcacgccatcccccatttaaaatacatttaaagacatccaataatcatcatcatttagaaggaatccatcaaaacgtttcctattaatactcattttattagttcagctgaatggaaacagtagcatgcttacatttaagaaagttcattatgggttcgttttctttttaacaagaaaggggaaacaaaataatgcccaaacacacagtgttgctggagtcaaaacaaagaaaattcatcaaagcatctatgagagctatcctgggataatctattctagagaagacaatacaaattggctgcaattgacaggtcgtaagttcctgggggaaagtcattataagcacatcatagcacatttggccgattgctcagtgttccacacactgacatcaagaacacatttccaatccatattctgattggttaaatgtggtttaggcagcctttcagctttcagagaaatggtcaaattctttcttttcaaaattcccaggccaagtcataataatgtactgatctcatggaagtattcctgcagtaatcacttcgagttccttcgttgtgcctccactgctctttcattcagcaattgccgttttgtgtgttatcatagaagaataacaaagaattagactcatgactctgaacagaggcttgctttttacatgagtattattatttcatccttggaaatcctggaaaacttcttactattttggatactaggtccagagtctgtttgtttacagcatggatgctgactggttgcagtcagagggtgatatgccagtgcgtgaaggaaatagggcaaaatgtaaacattgtacgtttagtagtgctctttctgcaggcaaggagagattgattgatttctcaagtgcaacttgtctgggggaacatgggattttattctattttatttcatttcatttcatttcatttatgtttgagacagactcttgctgtgttccccaggctggagtacaatggcgtgatgtcggcccactgcaacctccgcctcctgggttcaagcaattctcctgcctcagcctcctgggtagctgggattataggcgcacaccatcatgcctagctaatttttgtattttcgtagagacgaggtttctccatgttggtcaggctggtcttgaactcctgacctcaggtgatctgcccgcctcggcctcccaaagtgctgggattacagatataagcctctgtgcccggccaagcatgggattttacaatagcatcgtaagaaattctatctttttccctgagtattcaatttacacccatgtttcgaatgagcagtgagcaccagcacggagatcggagccccgtgttacttgtacgtgaaggtgtcagtgcctgagtgtgctagtgctgctgatactcacaccaaatagcaaacaagagccggcaatctaacctgttaaaaataataggcaaatgggaagagaggactgaggaatctccttgaagtttcccttcactgatgggtgctaaagatgtatgccttggggttttttagatgacatcgatgtaatccccttcaaaaatagtgacggaagaacagacttcttcaccttattaatttcctgcggcatcaaagtccctttgagagtctttctgttccaatttttcctcaagttcacaaaatgttggctgtcagcgttattgtgggttaagacagaaggtcctcctttcctgaccccagagatcccagatcatcccagtgtttgtttattttctaaaatgtccattttgcttagaaataaacacaaattggtgacatttattccttgcactatcttctaacaatttattctaggtttactaattctcatgatgttctgctagagaaatatgaagaggcaatttacttgtgtagaaatgtgagtcaaatcaagtgaatattatcattgtcagattcagcatttatcagtcttccctcacaagattcagagagttctttttctgttcagtttggtaataagagaagttataatcaatttggtcataaaaattgtgcaaaattagatttttttattccactttctgctatgaaatattcttttgtttgttagtttgcttgagaccgtgtctaattctgtcacccaggctggagtgcagtaatgtgttctcagctcactgcaacctccgcctcccgggctcaagtgattctcccaccttggcctcccgagtagctggggctacaggtgtgcaccatacgcctggctaatttttgtatttttttttttttagagacagactttaaccatgttgcagaggctggtctcaatttcctgggctcaagtgatcctcctgccttggcctcccaaagtgctgggattataggcgtgagccaccacgcctggcctaaatattctttaaatatgtgtgactttggaggaaagggaatcggatgggttaaaatatgtgaagttcattgtcaactgttatccttgagaaatatttaagcttcccttaatgttgtgtcttaaatgacacataataatccaggaagggatttttatgaccataatgggtttttagcttaattttaggtagcaaagagaaacatctgctatggaaaaagcttaattgatttttatctgatgtcacgaagctgctacgaggcaccatcaccagcaggtgggtgctgattacgccctgtgccgaggactccgttttatgaaaaacatcaatcctgccatctaagaggagaagacatgctcaataagtttatctctgcctccctacccatgttcaacaaggtatcccagaagaacttaaaagctatttactctggattataatagatcctcttgacattctgtaactggtgaagccatgggagagtcctggcttaattataaacaaccacaaagttatcatcagtgctacctggctacaaattgtttcttgcagagaaaatttttagctatttaagtcccacgaaagtaaatttgggggctgaaaatttttaataagtatttaaacagcagaccttcaatttctctagacccagtgaaaacagaaaacaggatggagtatttgcttgccatgaacctttcctcccacaacaactgtgcattttaggaagtcagtagtaactagcttataaaatacagagctctggaaatcatatgcctcatcagactgtagctaatggggaagacacactacttcctgtatttcaaacaataaaaaccatgatgtaataaagagcaagtttatcctgaggatagaaagtagcccttacataaatgagtaaatcagtaaaataaaacaaaaagtacccctcaacaaataaaatacttttctttaaacttataatttgggaaattatcttaatgttaatcactgcttaataatttttaattagcatctgcaaaaatgtaatttaattttaagttagagatttcttggtactttaaaactaattaaatatttaattatgttgtttgatacccacatattacataagaaatgtcagtttatttgttaaatgtctcacactgaaaatctcggttagcacattcttttgagttttatgtttttaaagcaatatttgcaaaagaatttctcaaaagaagtcagtactgtttctggacagttcatgaatcatctaatggaagatcttagagctgatatttgtaccagaaaagatgttacacctaaaggtgctcattactttattcaatggacaagagaaataaatattatcttacaggtattatagaaatctttatctatttcactttctctccctgtcctagataaacccacacacacacacactagcaatgtaaaatccaaatatatttttattcaaacacgttaaatcaagcaacagaattctagtacagttttgctgtattggtcatgtctggcatacaaaaaatgtttaagtcttcaaaattattctggtatcatatctgtgatcccaatactcaactgggtttctataaatataccagtaaatattcgttggctactaactaggtgtctttttttgtgctaagatttgtgaaggatgagaaagtattctggagaggcatactaaacattataaacacttcctgataataatttctaaagcacgatcagagctgtccgtcatcatataaagatggttaaaaaaaaaaatccgccaggcacggtggcttactcctgtaatcccagcactttgggaggccgaggcgggtggatcacgaggtcagaagatcaagaccatcctggctaacatggtgaaaccccgtctctactaaaatataaaaaattagccgggcgtggtggcgggcgcctttagtcccagctactcgggaggctgaggcgggagaatggtgggaacccgggaggcggagcttgcagtgagccgagatcgcgccactgcactccagcctgggcgacagagcgagactccgtcttggaaaaaaaaaaacaaaaacaaacaacagcaacaacaacaacaacaaaaatcaccccataacaatatgctacaccatatccaggtgagaaaaatcaacaatgaaactgattttgcaaaattccactgtgccttctatagtcatcttcaaggtctggggttattgacatgctgggagaatgaacctgatattctgtttaatgactcagatattgtagacatatttcagacacagaaaaactactataccaatacatttaaaaaaaaataaactgtattcaggatttgtgatttttttaggcccatcaagagcaaattataaatttatttcaataaggattgcatgaactttgtggttttaaaattaagcttttatagacctgcttattaagataagcatattcatccaagattaaacataatatttccagtagaatctttgctccatctgaataatgagttaaactcagaattatagcaactttctgtagcatttctgatcttaacgcatgcaagtagatatctctaaaatatatttgaaatgggttagggacctttcattatggaatggctaggcagaaaaggactatttttgttacataccatttcctccctaacataatggtgaaatacaaactttaccaggtcgatttttgttatgcgggaaaccagtgtttctgcaagataaaaatgaggaactaattgtttatattagagccttaagactgatgctattttatatgcaaatttactagagcaatttgttttacatgtgtattacgtcaaatgaatcaaattgtctgaatgggtgaaactacgaatatagaccatttcattctatttgaaaataatttgcaattccgcattttatacaaatctaattgaaatataatcatgcctccgtaaaacagtgataaacttaatatatgagaacagttgttatgtgccaataaaatatcaaaaccaagcaaattatagaatagttatcaggatgactgtaaaataacataactagctctaaagctgagtcaaaaataattatttccgctgtaagaagggccatctagtagaacaaactacattttctgactgcagattgtttctttataaaatgacaatagcagattgtatcgagttggaccgtgcatttagagttcagaaggctcatgattacctgagccagtgccagcctcaattctcaggcccacgtgcaggactaaatggtttatggcctgcaacaaaaaggcctatggccatttaggaagtgaggtgttcggttatcgttgcagtaaaagaggtaaaataatcttttttgaatgataaagtcacaagtcattgaaaactgtgtgcctagttattatcagctgtttttctttcctcctttgactctttgtggtcagtgctaatgtaagtctttgcttgaacaagcctgcagtgcaaaaatggtttccagcagtgactggcagaaccaggaccctagacagttgcattgcaggaggaatgagaaggcatcacaaaatagaaagttctaacaccctagatggcattttgtgtcatcgttttctgtaagtgcctcttaatactcttggttttgttttgtgttttttttttttttcactataatctgttctttttcctttttttttcaattgaatctaacctaaatatctctatgagaaacttttgactcattaacaagataattaaatgatggagcagagtgaatacttttcactgggtgtcctatagtttgtaaatgcttgccctttcagtgagctttgaaatatttttaagtgtaacagtccttggtaatagctttacaatggggtgcaaatacagaagtcagtttacaagaaatttctgttctctttatattcacgcatctgagtccagaattctaaaagactgctcatcatcctacctataatacaaacaaggtgccctccatgttaactgcagaatcctgcagttacagtctagacacacgaaccttgcagaagggtgcatcggttactttacatactttgcataaacgaggtactaaaatcctcataattatccacctttcagaacatgtccgactcaaaatattggaagaacatttgagaagaatctacaggctagaatctttttgaatcttttcttttgcttgtttgttgtttgtttgtttgtttgttttcagttatttgggactttaatgttcctgagacaagaaaaggaaacatggaagcacgcacacttagaaatgagtctcagaaacggaaaatccaaccagctaaatcatcacagcactcctggcaaaattctctaatgataaaagttgtttgttttgttttgtttttctgatttttcttttcagacacattaataatctcttgactaggaaaggggaacccacaaaataagtccttcttcattcttgtgtgcagttaattttgtttctacatgtgtctgcaaaaggcaaagatgacctccaaagcagattctagctctatttggatgagtctgtgagttttggtcaatgaaaatgggcagaaatcctgtcacaggagagagctaagtagacaacctcattggaagttaaaaatgtatattgtcatgtcaacgcaaggaagcaattataggcctcatgccaactgcacatcgtctgtgtgagtccacgtctccaggattccgagtctgtgtgagtaagtgctgttcccacttcaggaggagcagtggagacaattagtaggaatgaagtctccttggtgtcagtaatatgaaaaaatataccatgatcaaataagcatgtaggaaaacacctacattttcaaattcaaaaactattggaaaacattaaactgagctttatgtctttacaatttcttttcatagcaatgcccagttaatgcgccattccacactttctgatttatcttcagataaatgagcttcttcagccgtttgcctcatgtgtcctccttgcccttagtagagagcagcacataggatgttttgatagactttgtttgtggacaaatacaagcaaagcagcaagctgaggaaagccatcattgcttttaatattttgtaaacaataggacttgcttttatagtcatattaataaaagcaaactattcttacagttcagttaggctaggattagaccaaaacaccaaacaaaacagctgaccttgcaatgaaaatgtaggcgaaaatcacgaatttgagaagagatgtttaagaaatatttttaaaataaaattgaaaaaatggaagagtaacttgtagcaagtgctctagtaaaaacttcctctgtatacacgtttgaagtatacagatgaacccagtagaaagagagcttggaggtgacgggagaaacctgattattacgataataataaggtcctaatgagacaggaagggaaagatcgaggggctgattgagcaggctgttggtttaattcttgcttctgcagccattcccatcttctggaaggaggcaaagaggttggttgtacatattacagtccataaaccagaatctatctgagagctgtcagccaatagcccattggaaccctaaagacccctaagtcctagagctagatataaatcctttagaactatatcagaaaaaaaaaactttcttatacattttctccatgtgagaaaaacattattatgtttgtgttttagcattggtttcacatctcaaaactttttgctaacatatggagtttgctttagttaataaaattaagtgttttttttacattaccagatgatataaaattcagcaaatacttttttatatagaaatggaaattatgctgtgttactatgtgaaatattaactgctcctttagctattcatctactggctcgggatgactcttattttaaatgctaatttttcagaatctttttgaagggtgttatatatgttattttatcacatggtcctgtgagatttgtatagtgtccataaaattgtgaagtgggcataggtttttttaagtatgacatataattaggattaaatattcacatgattatagggctattcttgcagatataaagccaggcaaattcccaatggataatacttcaagaaatatttgcatccttaacattaaatctgtcttactaagttaactttaaaattgctctcatgaccaattttgcatcctaaaggtaaataaataaataaatcaaaacatgacctaaaacataactaattgaacaagagaaaaaagtgtagaacacaaattattgatttcattttcatattttaactagttgttctttcattaataagtataatgtatatacaattttcccactgtttaattattcaaagattttaaaactgaattgaatacttcatgaactaaaaattataaaatctttattcctgaatagctggaaaacaaaacaaggaactttgtcttttttaatggcatagttctgtattaccttggtgactctaaactctatgctttattcaatttttttaattgttggagacaaggagaatcataatctcaacctgcatttacatagtgctggaagaaaagaccgaccgggaatgtgtgatctgtcacttggctttggaaacacttgaagaagttgcactaatgtaaaaaagaaacagaaagatttaaatctatagaatatactcattgcataaagatgaattcagcaaatatattgttgtgagcatcttctatggtgcagcgccaggtcctttatttatttatttattttatttatttatttttttgagatggagtctcactctgtcgcccaggctggagtgcagtggcgtgatctcggctcactgcaagctccacctcccgggttcatgccattctcctgcctcagcctcccgagtagctgggactacaggtgcccaccaccatgcccagctaatttttttgtatttttagtaaagacagggattcaccgggattcaccgtgttagccaggatggtctcgatctcctgacctcatgatccgccctcctcggcttcccaaagtgctgggattacaggcgtgagccactgcgcccggcctatttatttattttcaagacaaagtctccctttgttgcccaggccggagtgcagtggctcgatcttggctcactgcaacctttgcctcctgggttccaagaattcttgcgcctcagcctctcgagtagctgggattacaagtgtgcaccaccatgtctggctaattttttgtatttttagtggagacagcatttcgccatgttggtcaggctggtctcaaactcctggcctcaagtgacccacctgcctcagcctcccaaagtgctgggattacaggcgtgagccaccatcccaggcctagcaccatctccttcggaagatggaactccagtggagctcttactagccaggagcttagagcatgcatgcactttagaaaggaggtgtctatgtttctttcaaaattgttttccctcagacaattttatatcagagtgcttaagattttatgtaaactccatgagtgtaatgtcttttctttttaagaatagtaggaataacaaagatatagaatcaacccaaatgcccatcaatgatagactggataaagaaaatatgctacatatacaccatggtatatatacaccatggaatactacgcagggacatggatgaagctggaagccatcatcctcagcaaactaacatacgaacagaaaaacaagcatcacatgttctcgcttataaatgagagctgaacaatgaaaacacacggacacagggaagggaatgacacacacttggggctgttcctcatctagcacatccagtacaaagtatggaacacattttcaatatacgttttttggttttttggttttatttttatttttctgagatggagtcttgctctgtagcccaggctggagtgcagtggtgtgatctcagctcactgcaacctccgcctcctggattccagtacaaagtacgtaacacattttcaatacatgttttttggttttttgttttcatttttatttttctgagatggagtcttgctctgtcgcccacgctggagtgcagtggtgtgatctcagctcaccgcaacctccgcctcctggattccagtacaaagtatgtaacacattttcaatacatgttttttggttttttggttttatttttatttttctgagatggagtcttgctctgtcgcccaggctggagtgcagtggtgtgatctcagctcactgcaacctccgcctcctggattccagtacaaagtatggaacacattttcaatatatgctttttggttttttgtttttatttttatttttctgagatggagtcttgctctgtcgcccaggctggagtacagtggcatgatctcagctcactgcaacctccacctcctggattcaagcaattctcctgcctcagcctcccgagtagctgggattacaggtgcacaccaccacacctggctaattttttgtatttttagtagagacgaggtttcaccgtgttacccaggatggtctcgatctcctgacctcatgatccacctacctcagcctcccaaagtgccaggattacaggtgtgagccaccacacccagcctaataaatattttttgtaatgaaaacatagataagtaaatgagaagtgagataaaaataaaatgaaatgaggcataaatgcgtatggagtggagagggaaaaaggtcaggtagcagagggccagagatgagaggcttaggaacaccagaattgtatatggatacaactggggttcagccagctcctgggtcaggtgactgtgcagggagctgcttataaaagaggaggcaatagttctgttgcttttcttcatctcagaagaacagtcttgatacttaggtatgtttttggtagaattgttgtgttaataactcttctttaagggaaaagtatctttaaattattgccacattgccacgtgattgtgattaggagttttagcaatttcctaaaaaggtctactttcaaatgaaacatttggagaagtttttgttttcttttgtttctattgaaggaaataaagcgttgactagttattttcaagtttggggaaccataagtgcatatatttcctaaatgacataagagctcatttactgaaagaattaaccaaataaaattaataatccaaagaattgtcacttaatatctataatatcctgatacaactacattgcaaaattcaaaggctattttttacaactactttagtgagattctactttctgaataagttaaattaatgaatataatcttataatttagaaaacaaaacaaaaatgttctcttttcccaagaaatatacctgatttaatattttgcctctattgtacaaaaagtacaagtgtacttttgtaccatctttactcttaagggatatctggaaaaatattttaacaatcccaagagaaggctgattgcaaaaacagaacttatttctgcaaattctaaggtcctctctgtttgaattagaagtcctgcagccagccaaagcaattccttatagtctacattttctgttcacagatttcatttcccacgtttcctgtcttcaaatgaagcaatatagaacggggtaattgaacaggctttaggatcttccagtttgagttcagaccctgtctcattgcttaccgggatatgggaacttggcacctcactggacttcaggaagcctcagctttcctatctggtgtgtggcaaatgtccaaccacgaaggcagcacttcactcagcatccagtacagaggaaggatgtcagcagtgctgtagattgtcattacatgtttgctcaaccaagaatgtttccactgagtgaggctgattgggaaaaaatattatagggcggttcactcaacataacttctcaaatctttctgcttattgaattatattaaaaattcattttcactagtaatttgagtctcaaaatctgaagggctgggtgcagtggctcatgcctgtaatcccagcactttgggaagctgaggcgggcagatcatggggtcaggagtttgagaacagcctggccaatatgataaaaccccgtctctactaaaaatacaaaaactagccaggcgtggtgacgtgcacctgtagtcccagctactcgggaggctgaggcagaagaatcgcttgaacccaggaggcggaggttgcagtgagctgagatcacgccactgcactccagcctgggcgacagagcgatattccatcaaacaaaacaaaacaaaacaaaacaaaatctgagtcttctatgcctctcaaagaaatagcattcaagcttaacatagaaaacaaactcattgagggtgcataagcagacctgtatactcaggtctgaaaaagtcatctttctcttaagatgcttgcactttcttgcctgatttaagttatgttgaataatctcaaataatataagaaaaataactatttaaaaagtagagttatgagcagcggggtacaggagcaggaatcggcttggtgcttaaagaaatatataatctaattccttaactcctgtaaaataaaaccaaaatgtaggtactaagttcagttatatttcggaggctaacattagcctaacgtactgtgctgtaagacctggttcctaccaccacagaacaacgtgcagttagaatccagcctcgttttccctctctctctgccccatgagctccacctgactttttgaaaggccccctccctttgagcagaacttggttcctcattcaatccaattcccatttctttatccttcctcctgagctccgttttcgaaatccgtttttccaccctcccttgtaggtctaatgcctgttcctgtctctctacactgcttccattatggtaacctgcacagtcttaacttgaatttctttcagaaatataataattctgccaccgcatcacttctgtttgtttgccctaatcaaggttaggcatttggggacacctagattcaagggatgctgggaaatacgcataactgaaagacgcccagcaccgtcttgagaggatttgttcttaaaggaaaaggcacacatgtaacctgttagataaagagctgcctccaacaaagcagggaagaagagaagacaccgtgaggccatcttgctgtggcctaggatcggggtccccaggctgggtgtgagtcttccaggcctgaggactcaccttggttctcagggccagcctctgcggaggcacaagtcctgatagatctccttttgcttctggcacggatttctctgcaggccccttgcctgcgtccctggtccctcctttccagtctccttccttgctccctcccatcctatgggaagtcggtatcttagcagatgccacatacttgcctcctaacacatctgtgataccaaatgccaactttctggagcgcctatcttaaaaaaaaaatttcaatttttattaatttgtaggtttttttcatacagtaaagttaacttctcttctgtgtgcagttctatgagctacagaacagctcctgggcaatccctcatactgtccctcatgctctccctgacatcacctcctggtgacattgatgttctccacccctatcggtttgccttttctagaatctcatatgaatgggatcgtccagcgtgtacctttctctgtgcatcaatacagcaggagttggctcctctccctgagtgcacgtcagtttcacttctgctgttgcacctgtcaattgttcgtcctactcatgccactgcggggctccaccatggcttatttattcattcaccagctaaagggcatttgggtttccagtgtttggtaattacaaataaagctattacaaacattcatggatagttttttgtgggaatgtaggttatttcactggggtcaatgcctaggagtaggacttctaggttttttggtacatacgtatttaactttgcagtaaactgccaagttgtttttcaaagtaactgtaccattttgcatgtccaccattagtgtatgacatgcaaaatgctgtggctggagaacctttgcatctacattttctcctctctcaatggtccatcttgccctatcagcctgtctgttaacactacactcacatctctggtttgaaacttcatatctattatttaagttagcaaacattattcaggaccagctatgtgttaggttactcttcctggtgttataattcagtgatgaatttgagatttaaattccataaactttatagattgacattctggtaacacatgcatgcataattaaatggatagacagatctataaatttaaaaataaatttattttagaatctgcagcatccaacatagtagccctcagccacatgtggccattgctccgtgaactgtggccaatatggacgcaatgagctgtaagtgtaaaatgctcacgaactgctgaagacttaatataaaatgacttatgatttttacattgattacatgttgaaatgacaatagtttaggcatacagagttaaataacagtaaaattaattttactgtttcttttttaaaaatataactatgaaaacatttaaaataacatatatggtttgtattttatccatatttctatcgctatgcaccatttttcatagtgaggtgtaataccaaaaactcaaaaaagcatgctattacagagcggctgatgttacagccagataatacttttaatacaagagtcaggaaaagttttccgagaccctggcatgtgcagtccaatctggatgatgggaaagaggcaggcatgtgacggtccgagggaaatgtgtccagctgaagaaacaggacaagcttggtcctgaaagagcaatgaactctgggtgtttgaagagtcaaagaagccagtggggttgaagtggagtggtgaagagaagaccggtgggagggagcgcagagtggtctgcagaattcagagcctcagaaaacgtggtaggaaacatggattggtaccgagccaccactcttcccagggaactcttgcaatgtctcctaatccaacaacactccctttattcattgccgccctcaaatatgaagcatgactaccatttactaagctcctactaagtgccaggtgctgaccacactcggcactctgtggcttgctccagttggaattcaggcttcctttgccattggcagaggttctctcctgttagcatcgtttcttcacttgccctctgggatctgcattctcctggccctgtgtcatccattatctccctgtctagcaagttagggccaggtcaagaaaacctgtatctctcaccttcatagatttttgccttcacctttaccctggttgatatacgagatggatgcactttagatttttaatctaatctattgatgttggagctgtcaaaagacccaagtttcatgtttttagatacacatatttttcccagtagaacctctttgtaatcaagatgcttcttaaaatcagcagctgtcaagagagagttgtgaaactgttgcctttgtcagcacttgagcaagtgtgatcacaggttcattttctcagtacgtgagcaagtgtgatcccaggggttcatttctcagcacgtgagcaagtgtgatcacaggttcatttctcagcatgtgagcaagtgtgatcacgggttcatttctcagcacgtgagcaagtgtgatcccaggggttcatttgtcatgacttcaagtgagttgtgcatgttgcgtgttgtgatccatatgtggagttttgatacttaacatatctgcaaatagattgcactataatttgtctttgaaataagttattgtgtttacagaaagacagggacataaaactataatccataaagcacacagcaattttatattatataaaatataacagttgatattagtaaaaaagacactagccattagagaaataaccataatttgatattttcttataaatcatcaacagagagttttatataagacatctacaagtaaatgaagatatgctgcatttgactactgctatgcaggtaaaactactacctatagtgtgccaaaaaaaatagaactggaggcagggaatattgctcagtcccaagagagcaccctcttgatggcatatactaagcaaaagacacagccaccaagtcacaatgttttcttataaaattcacaatcaatatgaagatttaggcatacatttccagtgtttttggcttatagcattgtttatattccacaaaaataccatatgattttaaaaatccttatctaagtttagaggagctctttcataagtataaaattttaaaactggaagtgattaaaaaaagcatgtataaatgaattagcagcattatctctgctagtagtacagaaataagggtgtacctttcactatacagttgatccttgaacaacacaggtttcaactgcatggttccacttataggcagatttttaaaaataaatgtattggaaatatctttagatatttgtgacaattttcaaaaaacttgaagatgagctatgtatcttagaattatcaaaaaatgtaagaaatgatatgtcatgaatgcctaaaatatatgtagatactagtctattttataatttgccaccataaaatatatatgaatctattattaaaaagttaacacttagagaccatacacgaagccattcacatttgagagaaatgtaaacaaataggaagatgcagcattagattataacttactatattcgttactgaattcgtctgttttcattgctataaggaagtacctgagattgggtaattaactaaaagaggtttattttggctcacaagcgtcagcatctgctcctgatgaggccccaggaagcttccaatcatggtggaaggtgcaggggcagcaggcgtgtcacacagcgagagagggagcaagagagagagtggggaggtgccaggctcccttcaaaataaccagagctcacatgaactcacagagtgagagaataactcatcaacatgagggcagcaccaagccattcacgagatcatccccaccacctcccactgagggctcacctccagtatttgggcatccggaacctctggtgaggcccgcaggaagtttccaatcatggtggaaggtgaagggggagcaggcatgtcacatgcagaaagagggagcaagagagagaaggagaggtgatacaggttgcatgtttgttctctccaaatctcatggtgacatgtgattctcagtatagaaggtgaggcctggagggtggagactagatcacgagagaagatgcctcataaacagtttagttccatcccctcggtggtaagagagttctcgctcagttaattcatgtgatatttggctgtttaaaagggtctggggcctcccccttctccgtgtcactcgttctcttgccatacctcatgcctgcccctgcttcaccttctgccatgattggaagcctcctgaggcctcaccagaagccaagcagaagccagcatcatgcttcctgtacagcctgcagaaccatgagccaattcaacctcttttctttataaattacccagcctcaggtatttctttatagcaacacaagaacagcctaacacaggaggcgctaggctcctttttaaaacaaccagattacacatgaactcagagagagagaaattccctatttacggtgaggacagcaccaagccaggcatgagggatctgtccccgtcacccaaacacctcccacgaggcccgcctccaacatcggaggtcacatttcaacatgagatttggaaggggcaagccattcaaaccatatcagatacctactgtactgctgcaataatattattgtcgtctcccattgctactataatgagctcaaatatccacctacaacactgcgtgatgctaatcatctctgcttgaggaatttgtctttccagtaaattctgtggtgtagtgaaaagtgatttctcaaggttcttgtgtatttttcatcatgtttagtgcaatatcataaaccttgaataacaccatgtggcccttatgaagtgccacttgtaacgctggaagtggtcccaagaagcagagaaaactcatgacattacaataaaaagttgaattgcttgatatgcaccatcaattgcgctctgcagctgcggcgacaccattttaagatgaatgaatctggtgttagggctcctgtaaataaagaaaaggaaatttgtgaagctgtcactgcagctaaccaggaggtgtgaaaatcttgcacaaaaggtattttgtaaaatacctttttaatctcactttgaaatatagcatttatgagggtgcagaatggctatacaaaaggcatgtctatagattctaatatgatttgagaaaaagcaaagtcattgtgtgacaacttaaagcaaaaagaaggtgaaggatctaaaactggagattttaacgctagcaaaggatggtttgataattctagaaaaaaaggttggctttcaaaaatgtccagataacaagagaagcagtttctgccaaccaagagccagcagataagttcccagatgccattaagaaaatcattgaggagaaaggacatctgcctgaacaggcttttaatgcagacgaaagtgccctattctgggagagaatgccgcaaaggaaatttattagtaaggacgagatgagtgctgctgagccagtgccagacgatgaggaaggagatgtaggaaaagcagtcctggaaaacaaattggcatcagacagtctggcagagggttctgatgattcgaaagagcttttgtcttctttcactctatgggcactcctatgggctctgaaactacaaaaatcagtggaagaaggattgatacaataaagacacttttttagagaaatgaagaagaaaagagtcaggcagaaattacaacatagctccataaagttacatggagtgtgcctgcctctcctgtctcccctcccacctcctccacttcttccacctctgccaccccgagacagaaagaccagcccctccccgtcctcctcctccccctcagcctactcaatgtgaaggtgaggatgaaggtgattatgatgatccacttccacttaataaatattaaatgtattttctcttccttatgattaataatattttctttctctagcttacttcattgtaagaatacagtataacatacataaaacataaaaaatacggttaatcgactgttcatgttattggtaaggcttcctagcaacagcaggctaacagtagttaagttttggggagtcaaaagttatacatggatttttgactacatgggcgttggcacccttcaccctcacgttgttcaagtattagactccttgatgccaagatgtcaaatgagtctagagccatatggaaattttctatgatcaagagtgaacacttgtgtctctcaccttaaacattctctggccagcaggccagtaaggcagtggaaagatcaaaaggaggatttcccattggcacccgctcaccttacgctctcatcctaaggtcaaaaatcatccagtgattttcaacagcagtaatcatgccctcatgcccaggagccacggaaacaggggaaggaaggaagttggggtcacaaggacttgggcagcagaagatatttgttgataaagctgataaatgttttgaaatcccaaggacagttctgcataatgaagaattgtcccagccaaaatgtgagtaatgtcctgttgagaaacctggatattatgtgtggcttgagcttactttatagatgcagtcctcttacttatcaggaaatgctcaagatgcctgtgctaggcctgacctagctgagctgttgacttgaatgtgcagaaggaagtcctaatggtacatgagcacctctcacaccattcagagatttcctcagattggatcactctgtctagtttctgtcatttctaaatacttcaaaaagttacaagtaccaaaggcaggggagcatcggcagagatggggtcacagtgggtattctttataaaaattttgtctaatctgtaccacagacttggaagaaaggctttgttggacattaaggtgagcagggctcatgcccatacaggtggctagctaaggaaaacgatgcttcacagtgtcctgcctgtgagtcagcagggctggactctacacagcaatgtacactcggatccctgactttgttagcacattgaaaataatttagtctctcaggagtggatcacacaaatcatgatcactgacactcattgcacttcactttcagattgtccttgccaacagagaactgcattcccttcatggaggcaacctaagtgtaaagtcaccttattagaattaacttgacatccttcaccccactttgaacattcaaagatcaatataatttcgtaggataatcccactcctaggaatgcatttctctttattttgcctcatgaaaatcccatgcaatacttccttcaaagcaaaatgcaaaggctattcttttgaagctcattttattacttgatttgcttcaccctgaacacctaatgctcgtcaatagttccattcctgtgtcacttagcatggactatattccattctagtcatttaagaatatctcattttctctactcaattgtaatctttttgaaggcaacagccataatcataaattaatttttacaaagaacctagggtagcaggtatcaaaaaatggctatcaaattatgagaatctttgccttagaagatgaaaaatacttgggagatgaaataataagtttgagtcaaattaggtggactattaaatggtaacattaaaagtgaagtctgacttggactctcagtcttaactctagattagtggttctccaccagggctgttttgcttctcaggggacatttggtaatgtctggagatattttcgtttgtggtagagagatcaagagtacttctaaatagcttataatgcagaggacagcccattacacacacacacacacacacacacacacacacacacacacacacatacacacacttctgacccaaaatgttaatagcatcaagatggaaaatatctgttctagatctaccaaattaatttcttttttcttgttttcatgggctagctaagtttaaggacctatggagtccactgaggatattctttttaggtaatctcaatgttgcagaaagcgtcattattatctttaccatcattatcatcataaccatcgtcagcttcaacagcagcaacacttcatcaaaattaaatattgtgatagtttgagaaattttagggaaactagagcataatcttcacaattctgaaactcagggatgaaaactgtgtgtgcagtaatcttagaactattgaatactagattagggggaaactgagagggcagctgtcattatttctgtcatttcaaacattggcatcactagtacatctagcaccttccattcaaagatgagattagaggaaaaactattttagagtcaaagatttttccttgtaggtacatattttgtagagaacaaagttctctatctttcctgtatcatgatctatgcatcttaaaaagtgtcaagaaatttctttctatttaattcagtttttttctggttggatcccaaagcattttttttttggtttgctcctctatgaagcttttctctgcctattctgtataacaactgtttacaggtttagaaatgcatgagcaaatgtttttgcaaccttctcttcctgaggaaaaataatcaagtgaccttatcacagcctcctggtatccatccttattttgtccctgtcagtttattcatctgtcccctctcttaatttcttggttcctttaacctatgtatctgtagtctgcaacacacacagatacacacacacacacacacacacacacacacacatccctctacaggacagttatacaaaaatgcaaaatgaaagaagtggagaatagagtatttacgcaatgaaaaaaagctgaatcctagaataatgaataaagagaattgtgggttcagattttcaaagtatacttagcttagtgacagtgaatggaaacaactgctatgttgaatgacagaatgattcaatgaacttgagttctttcactctgggccgcctcaatttctgcctctgtttctgtctcttgagcaagaatggtgtaggtttcataataagcatggattactgaatagatgtcaggaagagaatatttgtcctctaaatcaagtattcaattgactttctatagatctggcatgaactatgatgtagtccaagaattaaaaacttttaaagtagttgtagaaaatggtttctcagtcgtccagtttttcaggtttgccagtcccaagtgtattagcaaaattctgtaaatgcgaattatagagttaaaaacactagaagaggaggaaaaaataggtagtggtggatgaaaattttgtgcaattgataagaaaaatttttatctaggctctccaggaaccagctaactgacttgggctgctcactagccctgtctgggtcttaatgtctttgtccttaaaagggaatatatggtgttcatctgctgccagtagtatcatatgtcattaatcttttgggttcccatatggctctagatatgatgcattttgatgtcctataaaatgggacatgttaaaagttatatatgaaagcacaaattactaacatcaacaacgaaagagggaccattactacaaaccccatggacactaaaaggatagtaaagggatattgtaaaaaattctatgcccacaaatttgataacttagatgaaatggaccaattctttgaaaaatacaatctaccaaaactcacacaagaagaaataaacaagctgaataagttcagaaattgaattaaattacaaaagaaattgaatcaataattaatcatctaaaacagaaaacaccaggtccagatggatttactggacaattctgctaaacatttaagaaataaattttaccaattctctacaatctcttctagatgccaaaagcagatggaatactttctcgcttactctataaaggcagcattactctaataccataccagacagacctttggaaatgtaagaaaagaaaatgtaagaaagtgccaatatctgtcatgagcacagctgctaaggtcctcagtaaaatactagaaaatttcatccagcaatgtataaaaagaatcatacaccacagaaaatggatttatcccaggtactcaaggcttgcttaacatttgcaaaccaatcagtgtattccatcacaatcaacaggccaaagaaataaaaatcacatgaacatatcaatagatacagaaaacacatttgacaaggtccaacacaaatttataatgaaaatctctcagtaaactagaatagataaagaatttcttcaactttataaagaatatctacaaaaaaaaactacagctaacaacacttaatggtgagaaacccaaagcttttccgaaaatattgaaaataaggaaacaaggcaaggatgtatgctcttactactgcttttcaatattttactagaagtctttgctcatgtaataaggcaaaaaaaaagaaaaaaagaaaaaaagaaaatgtgtacagattgggaaagaagaaataaaactgcctttgcagataatatgattgtctatgtagaaaatccaaaaaaaatggacaaaaaaaattcctggaactaataagcaattacaacaatattgcagaatacatggttaatatgcaaaagtcaatgaacaagtggaatataaactttaaaacaataacatttacattagcatcctcaagaaagaaatacttaggcgtaagtctaacaatttatatacaagatcaatatgaggaaaactacaaaactttgataaatgaagttaaagaataaataaatacatacatcaataaataattagggaaatattccattttcataaatagccccaatattgtcaagatgccagcttatctcaacttgacctatagatttaatataatcccaatctaaatcccaagtagtttggatatatctataaactgattctaaaggttatatggagagagaaaagagccagaatagttaacagattattgaaggagaagaacaaggttggacaggcactagtcgactacaacctactataaatctgcagtaatcaatacagtgtgatattggtgaaggagtagtcaactagatcagtggaacagaacagagagaccagaaataggttcacataaatatagtcaagtaatctttgacaaaggaaacaggcaatacgatgaagaaaatatagtcttttcaataaatggtgctggaacaactgatcatccatgtgcaaacaaataaataaataaatcatgacacaggccatacacacttcacaaaaattaactcagtgtggattatagacatgaatgtaaactgcaaaattataaaactcctacatataacatagaaaacaatctagatgatcctgggtttggtaatgactttttaggtgtaacactaagggtgcaatacatgaaaaaaagaattgatgaagtgtccctttgagaaagatgttgttttttagtgtgcttcagccatttgaaaatagcaagatagtgcatacagatcaactctgtgagctttagttaaagaagaaaaatgagaatccactggaataatgaaagacacttcagatcccagggagaagaacgttggcaaacagcccccttgatgttgtccagctgataaaaatgagtgaaaccccagtatatgagagaggtagagagcctccccctggctcacctttccactggggagctgagcaacccaggccaagggaggccacattatttctctgaagccctggagctaacttgaggagaggcttagagatgctgtgagggaaagacactgaggaaagcttcagacattttcccaaacccaggactgagaacaagataccatttttaatccaggagcatacatggtcagctattcttaggtgatctggcagcatggtcatgcaggcatttaagtttccggccagatactggaacatttgctctggagtagggtagggacttccacaaccagaactgtggaaagtttgtcagcagtaggcactggaattatgctttctctcgtctcaaccttggggtaggaaaagagctgccacagctgcaatatctcttgggcagcaagacttacagccagggccagcttggtgaccagaaactggtctctgtgtgtgtcatttctggatgccccagactgctctcctgagatcatggtgtagtgaagccctcactgctccatgcccaggcagattgccaggcattcggagcacccactcacctggttcagcaacctgagccccccacccatagtgtgcacctttcctctgctacatgcccaaacacatctccaggtatctggagcatccacttttctggattaggagtttaagctgactctcacccctgtgcagagaacttgaggccaaggagttttatcagctccacacctaggcacacctctgggtacttggtggccgcccactggattctccctcagtgttggtgcttttgtgtgccgtttgggaatgtgcaggtagggcctgcctggtctggcaccacccatctggccactagcccccagggatgagcagggagctcaaaccactgtgcattccatgaatcagttcattgtctgaggtgccagagagcttctgcaagtaaaaaaggatcaagtatatgcccagcctcattggccacagcctgctcttacctacgagtaccatctactggcttgtaggttgagctacacggtgcaacataaaacctaattaaagaactgcacggggctagagaagcaaaagccaaaagcattctttagcatcatacctctaggaaggctgggaaaaagaaagagaataaaataataaattattgttatatagaaaaaaataaaaagtaaaaattctacccacacaaaaataattacaaaaaattgtaagtgccggtgtcttcaaataagaagaaggagaacaaaaattgtgacgccataaaaaatctgaatgtagtgataccaccaaaggattgcattagctcttcagcaatgctccctaactaaaatagaaactcagaaatgacagaaaaagaattcaaagcatggattgcaaaggatctcaacaagatccaagacaaggttgaaaattaacacaaagaaacttcttaaacaatccaggaaataaaaaagataaatatctttaaaaaaaaaacagagctgctggaattgaaaaaaaaatcacttaaatttcaaaatataattgaaagctttatcaataagttggaccaagcagcagaaaaaagttcagagcttaagaccagtctttctaactaacccagtcagacaaaaataaagaaaaagtaatttttaataaagtctttgagaaatatgggattatgtaatgcaacaaaacctatgaattattggcatgtctgagagggaaggagaaaaagcaaataacctggaaaacatatttgagggaataatccaagaaaatacctctaatcttgctagagaggtcgatatcctgatatgagaaatccaaggaacacctgcaagatactacatgaaacaaacatcaccaaggcatatagtcaccagactatccaaagtcaatgcaaaagaaaaaatcttaaagacagttacagaaaaaactctgatcacatacaaagacaatgtcttaaggctaagaggggacttcttagcggaaaccttacaagtcaggagagattacaggcctattttcagcatccttgaagaaaataaattccaaccaagaatttcatatgctgccaaaccaagctttacaagcaaaggaagaataaaatactttccagacaagcaagcactaagggaatttgttaccactggaccagccttacaagagattcttaagggagttctaaacatgggaacaaaataataatacttgctaccacaaaacacacagcacatagctcacagaccctataagtcaaccacacaatataaactacaaagcaaccaattaacaacttcacaataaaatcaaaacttcacatatcactcttaacctcaaatatggatggcctaaatgccctacctaaaaagcacagagcagcaagttggattttaaataagacccataagccttctgttttcaacagacccacatcacatgtaatgacaccaatagtttcaaagtaaagggctgaagaaagaccaaataagcaaatggaaaacaaacaaacaaaaaagatcagggagcgctattcttatatcagataaaacagactttaaaccaacaacagtaaaatagggaaaacaagggcattacatcatgataaaggattcaattcaacaagaggagtttaacaatcctgcccccagtattgcagcacccagaattatgaaacaggtacttctagacacataaaaggacttagaaagccacacaattgtagtaggggacctcaacaccccactgtcagcattagacatatcatcaaggcagaaaactaacaaagaaattctgaacttaaactaaacacttgatcaattggacctaataaacatctacagaagattctactcaccaatcacagaatatatgatacattcttttcacttgcacatgaaacatacccttttttcaccactgagtatgatgttagctattggcttgtcatataaggcctttattatgttgagatacattccatctatacttaatttgttaagagtttttattataaaaggatgttgagttttgtcaaatgtcttgtctgcatccattgagataatcatatgatttttatcctccatctgtttatatgttgtatctacctttttgatttgcatattttgaatcatacttgcatcccagggaaaaattacacttgatcatggtgtatgatccttttaacacactattaaatttgttttgctagtattttgttaaggatttttcacccacatttatcagagatattggcttgtaatttttttttcttgtagtatcctcttctggctttggtgtcagaccaatgctcattgtaaaatgggtttgaaattattttttactcttcaattttttaaaaagagtttgagaagaattgttattaattttacttaagtgtttgatagagttaccagcaaagccattggatcctgagatttttgtgtcattttggggagtttttctattactgattcaatctccttacctgttattgggctatttaggttttctatttctatgtgtttatccttttctttacagtcatcaattttttggtgtataaatgctcatagaggccagttttgattctttgtatttatctggaatcaatcgtaaagtctcctctttcattttgaatcaaaattcacaaatatgtaaaaattaaacaataaactttggaacaaccactaggtcaaagaagaagtaaaagaaaattaggaaatatattaagacaaaccaaaataaaaaccgcataccccaaacttatgggatgtggcaaaaggcatacaaagcagggcattcatagcattaaacatctacattaaaaaaaaaaaaagatccccaaaaaactctaaatttccaccttaaggaactagaaagacaagaataatttaatccgaaatttagccaaaggaaggaaataacaaaggctagatgagccaaatatatagaaaaattttttaaatagaaaaaaagtaataaaatgaagcattgtttttgaaaagataaagaatatttaaaaactcttagttaaactaagaaaaaagtgagagagatctaaaataaataaagccagaaatagagaagaaggcaatatatcagctgttgatgataaaaaaattataagggactattatgaataattgtacacaaataaattagatatcagaataaatggataacttgaaagacacaacgtgctaagactgaatcacgaaaaattggaaactctgaatatatcaataacaaataaggagacttaatgaataataaaaaatcttacatcaaagaaaggcctaggaccaattagcttcactggtgaattctaccaaacacttaataatgaacacctgtacttctcaaatgaaatacttccaaactgactttatgaggccagcatcaccccaataccaaagctacacaaagctaccacaaggaaagagaactataggccaatatctttgatgaacttaggtgccaaatcctcaataaaatactagcaatttgaattcatcagtatattaaaaggatcatacaccctgacaaagtgtgaattctccctgagattcagggatggttcaacagatgcaaatcaatcaacatttacaccacattaacagaataaaagataaaatttgcatgatcatcttcaaagatacagaaaatgacatctgacaaaattcaagagtatttcctgataaaaagtctcaacataataaaagtcatgtatgataagctcacagttaacattcttggtgatagcaaattgaaacttttttctctaagatcaggaacaaggcaaggaggtccaccgtcatcactactattcaacatagtactggaagtcctagccagagcaataagataaaaagaaatgaaggccattcaaactggaaagcaaaaagtcaaattaacgctttttcttcagaagacataactatatgatctacagatatatgtgaaaaatcctaacaatcccacgaaagtgttaaaactaagaagtgaatttctcaccgactcaaggggactaagcacaatttctgaacaaatataagttatttaaaagcaacgctgaatatgtagaaagagatggaaattatatcaaacaaccaaatggaaatttctgaagtgaaaagtataattatcaaaatgaaacatttcacagagaggataataaaaagatttgaactggcagaagaaagaataagcaaatttaaggcagattattaagaaagatagaatctgaagaagagaaagaaagaaaagaaaaattaaaggtgcctctgggaaatacgtgacccactctgaaccagttgttaaatctttccttccttttaaagcaattgacaacaaacagctcggactattcctgctattcaagtgtcatttattttctccaggactcccatattagggatgttagacttcttatactgttcagacacctcatccctaagttttaagtttgtcttctgtgtgcttcagtgtaggaatcttgcccttgacctattttccagttaagcaattctgtaatctgaactgtccaatctactgttaaatgcatctactgaattcttaaatcatatttagttctgaaatatccgtttgaaaatttccagcttacgcaggatattttacattgtttgatatactgtgtgcatttttccttctaatttaaagcatggtaattatagtcattttaaaaatattctcccctatgtatgtgctcccctgtctggatcatcttgacactacttagagtgtctccttctgcttctttcttttccttttttcattctctgataagaggtcatacttgttttactcataacctacatagaaatgagttactttgtcaggtaactgattacaaagcaagcacagatgctccgggtacctccattgaagatgttcccctcttttttctgttagactggggagccaattaattccctgagtcagtcatgaattgagctaggtctgaagtaagtgagttttccatgtatcttggactaattctctctctctcatgttgctgaggtctgggcctgctagactttcacttgggtatctgtgtggctctatttcctcagctctgaaacaatataaggattcatctctattacacaaaggttcacagcccagctctccagtctcttgctacaagcaagccccaaattaggtaagtgtcttaacagacagacaatccctgtttaactatgcttcgtgtccaaaatatcacatcagtttaggaaactgtatcctttgataacattgaggctagcttatcaacatcccacaaagccttaacattcatcatatgtgacctggggagaaatgattcagaattgaaggctccagaacatctgatctgtgaatctagtcctgagtagcaatgaagagggttggtggtttccctttctctcagcacacggtctctaactaggtcaaacgtaatcctcaattcacatccagcatctgtaagtgctcccaaaaaaatgaatgactgcaatattcaactcatttcagaactgttttccatgcctaaagttttagttcattaagtacttcttgcttgcacaacttctgatgcccttaaaatatggtttttggccgggcgcggtggctcacgcctgtaatcccagcacgttgggaggccgaggccggcggatcacgaggtcaggagatcgagaccatcccggctaaaacggtgaaaccccatctctactaaaaatacaaaaaattagccgggcgtggtggcgggcgcctgtagtcccagctactcgggaggctgaggcaggagaatggcgtgaacccgggaggcggagcttgccgtgagccgagatcgcgcccctgcagtccagcctgggcgacagagcgagactccgtctcaagaaaaaaaaaaaaaaatatggtttttgaagtttaattgggatttctggtgttttcccagagaaaacatggctttctaagacttattctatcctacatagaattcgttcttctttatcctattttattaccaaaattacagaggggttgattggcaagtgctattctctttatcagattttgaaaacagtgtttctaagtttcagtcttttccccaagatgggaaaaggcaatgaggagaaaattccaacgcttccgatgtctgcttccttcccgtgttttccaccgtagcaaggtaaggactgcgtcacttagacttcaatcacaaaatgagaaaccacaccctgggctaaccatgagtcactaacaggaagatgtagcgatcactactaggactggagatcaaagggaaaggagtggggttaatggaacccgcaagcttggaatagatcccctggttccaggacttcaacctcttaggagagggtagagccaacctaccgctgaaacctctggaattcgtagaggatccaaagaccctctgaggcgactaagacctctgaaggtaagatggatgtttgatggctgtgctggtatccctggggctgacaatgctattggacctgggagttatggaatatatgtaggcaaaacgtgcaggcacaaagctactgctgctgccaaggcggaagctgtgtgttactcaggtaacattgacataaacagctatcagacacttctgtcaggtttccggtctctctagttcccccaacggcaaatactaacagagaggatgggcaaagaggaaatggagtgtgtaggttcccgttctccctgtgacaaagcgcaaggataaagagtaaaaaggggaaggaggcttggaattgaaagacagcgaattaaaacacacagaacccattcgtgagctgtgtctttgctcaagaaacccaagtctaattttataacaaataaaacactaaaattgctttaaaataatgaaaaagcaggaataagctggcattaccttattcaatagccaacatttatgattctaaactataaaagaccttggggatttctgtcagtggtctcaggcatatgcaataaaatttctcctgacagcacacacaaaattaatacgtgagaaatttcatgaatgattaagcttcttttctgaagttttaatttgttttcaagttttttgtaggtgaagtttgaacattttgcttttctttcttaggtgacatttgaacatgttgctttactttttcaggtaaagtttgagcatttggctcttctttgtttttctgtgcgtgatcaacaacaacataaacagaaagcaaagcaaaagcaaaaagggaatccataaatatggtgttacaccccttgcttgcacacctcattttctccctttttcctgggggtggtggtgccactatcaacactaccctcagtgccttctctcaggcagtcaggaggcttccactctcggcagcaatggcagtgatgtttattgttgcagacaggtctcatattacaggtcacgggcaaacaggtactgttcaaaagtgacatagtgacacatttcctgtgcatacagacgtgttctgaaccacactcggtagcatctttcacgtcaccaatatcaggagtgcttatccccattcgatagccggtatcccagcaggtgacaccaatgaagtgagtccggtgcagagtagaatgatctctcaaaagggggatttcttgcatgttctcacactcaactctcccacacaagatatctgtgacctcacatcttacctatttggtgccattgaaaccacagtgaccaaaatgatcacctcggatgttcatattactgcagcaactctgatttgcactgttggctacctggccaaaaatttgtctacactgttcatcacagttattacatctcttttcgtagcagtggccactgcccttgcaggggatcccgtcctgcaaacacacatcttctgcacactcatgcgaagtcccgttgaaccactctggaagatcccattcgctggactcttgtctgcacacttcgaccgatggcatgatctggcagtttttgcagcaaagccccaaaacacaagcagccccaggtttgaaagtgcaatttgcaaagcaacatggctcttttcacacgatggtaagtttccgcggtcatactcttcttctaccgcaccattcccacagcacctctgtgtcatgattctatctcgatttggtgaagcatgcatgcagatcgttgttacagtggtttgaaaaaatctagcattaactacagttgctgaatctttttgtggaagttgccgttggaaacattatacacttttttgcccacaggaacatgtttttgtatcatgagtcatacccaaattatgaccaagctcaggtgctgctacgagtgcaaaagatcccactctgttatgtccaaaactgttaattgcataattactttctctataacatactgttccaacattggctaagccaagagtaataccataggagcgttttacaataagatgtgcaacatcatgaggaatgcaagaattaaagctagtttgtttccatttgcaaatttctttcaggccaacacctgcagtgtccattgtaatgaagttttcttgagtccagatctcaagtcccactacagtgacaattggcacccagtggaatataaaatgcatcagctttttgatacagcatgagtacttcctcctgcacatttgaggtatgactttccagataaaggaatcattcatcatctaccactactgccagttcaacaaacaatttatgggtccaccagccctcaaagccactttgcattagagtagaaggatcttgaaacttcaattgtcttgctatttcttcctctatcaacccacatctcatgggtgggaattgtgtctcctcattgtccatcttatatatcagatgttcaaatgtggctgaaacccttttgggcttgatttcctaagcagtgtcatttatctgtggtattccttgaaagccccccaaacagctgctaagagcaaccagggattctgggtccccttccacataactgtgatagtagcagtcatcctggacaaaagttggtcctcaaaaatagcaccctggtctgagtaggtgaacacagagaaggatttggatatcaaaaatatcaaaagcttattgaccttcatgtggacaatgtacctttggctgccaacttgcaggccataggacagccagccttgagtgtccgtgcctctgtcagcaccagttatcctcaggggtatcaccacttctgggaggctttggtgttgacagagcccaatctggagccatccagaaaagaacagaaacactcccagccagagcagcagatggatgaacctcacatggaccagggcctcgctcactgccctcatggagccactgtgatggagctatgggtgagagcaaaggaggggaggcaggaggcacagctggtctgtctcctcctctgagttgcttttgtttgatgttgagcttaatggtctttctgctggcagagtcagtctatcagagcagcacagctaaaagataaagtgaaaagaatggcagagatggggtggtgtgagcagaacagagtggaaaagagagagctgggtgtgggtaaaatggagtcatatttggctcaggacgtaactcattatactgcattggatttgcttctgcatattggcaaggcagagtgagactgtgggtgtaaaaaagaatgacagttggctgcaggttgataattactgaacctagatgaaggacacatgggttcattacactgttgtctaaatacacgtatgtgtgtgaacatttctgcaacaaatacctaaaacagaagagtcttaatggaaaggggaacgtatatctcattttgatgagagaaccttgatttatgcatatagacttggaataagtgtagatatttcttatcaatttcaaatgataaattattcagtcaccttactcagaagagagacataaaaatattcacacatcttactttcttatcatggtcctcaatatatacttctctgcaaaatattacttgtcctatcttcatctaatactgtcaaactgcgtagtgtcaaaatatcaattatccttcaaaaacgttagcgtctattttaatggatcccaaattcaatataataataaaccattgtggaattaaaagaggatataccttgggttgacagacgttcccgaaagatgatcatatttgcttatactcttatgaaaagtaacatttgtcaaagcctctaacaaaataaaatggaaaggaaatcaaactagctggaaaagcaacagttggaagtgggaagacatggaagggaaagcaaagtaccttcagaaataaatagaaaatcaatgagctccaaaaccaggaaggaaagctttggaggaaggtaggatttttgtccttgagcaaagatatcaaaatccatggcatttttagggttataaggtgaccactcctgagatccacccttgaaggtatttatgggataaataaaaatacctattccatcaaaaaaataaaatacaaaaaaggtctcaataatacaaatgtatcatcagatatttatgaaaatgagagatctggtactagcacggtgcctggctgccaatactgatttattgctgttcttgaataaaatattaataaaaccacctgatatacagacattatgctgcaaattttagaatataaatgaatgatactggcctaaataatttagtagtctggagcaaacatttagggagaatgtttggggcaaaaacacactttaggaatctgcataattacattcaatattttacatgtaaaatgcctaatgttgtttagctagtgagagtaaccacagtctttatcagacaagtaaagtaatgagattaagaattattagtcaagttgagaaaaaaaaagacctgaggaaattgaaatctgctttgagtgacctaaaacagagtgatcaaattccacttttcatagtaggtattataaaaacaaaagacgccagattcagcacctaacatctcttggacttggacccatttttctttaaaatttccttaatttttcttttatcttgattctaagtgtttgatctctctgcaatcattttcttgtcactcatggaatcttcctttcatgaaaagcaacaagaatcttttctctattcacaaggttttatggtgagcttcttattcatactaggttttacaaaaatgtatatctcaacaatgtgaatcccagcagaaaggaggctttgtcatatgccctgcagaacatatgtagagatatggttttgccatgttggccaggctggtctcaaactcctgagctgaagtgttctgcccaccccagcctcccagagtactgggattacaggaatgagccactgagcctggcccaataatagttttgagtaaaaatattgcattaatgtttaagctatagttatctagaaaatattaagttttatattgcttataattagtaagtttcccattaatccttttgcttcttactttaccatctagaaaccaaggctactaatactatgaggaacttgttgggaattggagaaaaggtgactttcattatgctttagcaaagagactggcagcattttgccttttctcttcagatctatggaacattgaacttgagagaaatgatttagagtatctggtggaagaaatttctaagcagcaaagcattcaagatatgatgtgggtgctgttaaagacattcggttttatgtattcacaaagatatggtttggaattggaacttatgtttaaaagagaagcagagcatgaaagtttgaaaaatttgcagtctgacaatgcaatagaaaagaaaaactcattttctgaggagaaattcaagctggctgtagaaatttgcataagtaatgaggacccaaatgttaattgccaagacaatggggaaaatgtctccaggacatgtcagaggtcttcatggcagcccctcccatcacaggcctagaggcctaggagggaaaaatggtttcatgggccaagcccagggccttgctgctttgtgcagtctcgggacatggcaccctgtatcccagccatggctaaaagggcccaatgtacagctcaagccattgcttcagagggttcaagctccaagccttggcagcttatatgtgtgttgggcatgcaggtgtacagaagtcaagaattaagatttggaaacctctgcctagatttcagaggatgcatggaaatgcctggatgtccaagcagagttgtgcttcaggggaggagccctcatgaagaacctctgatagggaaatgcagaagggaaatgtggggtcagagcccccacacagagtccccaggagggcactgcctagtagagctgtgaaaagagggccaccatcctccagaccacagaatgatagatccactgacagcttgcaccatgtgcctggaaaagctgcagacactcaataccagcctgtgaaagcagctgggtgggggtggggatgggggtgctgtaccctacaaacccacaggggcagagctgcccaagaccataggaactgacctctagcatcaatgtgacctggatgtgagacataaagtaaaaggagatcattttatgtcttgactgtcctgacagatttcggacttgcatggggcctacagcccccttcattttggccagtttctcccatttggaatgagtgtatttaccctgtgcctgtacccccattgtatctaggaagtaactagctctttcttactagacataaaattaactgagacagttttaatttcattttgatttttttctttagcaaagggaaggttcaaggcccccccaaatcagtatcaagcagaagcattttttcaacaaaacgcttttcataatcagatacaatccacattgattccctcagagatatactacagaggttctctttcttgaaatgtttatatgttaaagtagaactggagactcccttgtctctggatgggtaaacaaaaagaagatgaccacgggcaaagttactgagcacaggttacttactgttatgtaacaaattaatctagtggcttaaaaattcattttataatttattattatttattatattatttatgtgtagggcaggaattcaggcagggtatggctggacaattttcgctccacgtgatgtcaatcagtgttcatctggtggcagacagctggtggtttgactggtcttgagggtctgaggtacatttactcattgtctattccttgacagagatggcccagaaggctgagcttggtacagtctgttccttagagagcctacataatacctctgctgcatgaatttcttcttacactacagtgctccaagaacaatcattccaggaggtacaggcagaaactaacaaggcttcttaggatttagcttcagaagtctcagtacataacttgccacattacattagtcaagcaaaaagtaaggctaggtgagattcaagtgaatttggaaggttttaaaaggaggaagagattccatttcacatttaaaaaaatggcatgtgtcttcagcaaaggaatatatagctgaaacacatcacaggcacaaggtacttcagtttatactctagctccacaatttaatttgggtgattatttttaatagactattttttagagcaattttaggttccaagcaaaactgagtggaaggtacagagatatctcaaatggctcctacccctatgtaagcatggcttccctcattattatcaaccctctccaaagtggtacatttgttacaactgatgaacttatattgacacatcattgtcacctgaaatccatagttaacattaggttttacttttagtgttatactctctatgggtttgacaaatggataatgacatgtattccacatagtatcatacagagcactttcactgccctcataatcttggcacttagacttttcatccctcctttcccctaagccctaagaaaaaccatatcttttaacactcttcatagttttgccattttcagatgtcatattgttgcaataacatggtatgtagtcttttcaaattgggtttcttcacttagcaataggcgtttaagtttcctccatgtcttttcatggctcgctagtgcatttctttaagtgctgaataatattttattgcctggctatatcccaacttatttatccattcatgtacttaagggcattttggttgcttccaagttttgacaattatgaagaaaatgatataaacatccacatgcaggttttgtttgaacataagttttaaattcttttgtgtaaattcctaaggactgcaattgttgaccatatggaggggtgtgtttattttatttatttatttatttatttgagatggcgtcttgctgtcacccagactggagtgcagtggtgcgatctcagctcactgcaagctctgcctcccgggttcacgccattttcctgcctcagcctcctcagtagctgggaccacaggcacctgccaccactcgcggctaatttttttgtttttagtagagacggggtttcagtgtgttagccaggatggtctcaatctcctgacctcatgatccacccgcctcgtcctcccaaagtgctgggattacaggcgtgagccactgcgcctggccggggtgtgtttatttttaagaatacaaggtatattacaaagtagctgaactattatgaattcccacaagcaatgaatgagagttcttgtggctcatcatcctcgccagcatttgatgtcattagtattttggattttggctcttccaatgtgtgtatagtggtattttgttgttttaatttgtacggtcctgatgatggattatgtggagcatcttttcatatgcttatttgccatctgcataacttcttcagatgtctgttagtctttgatccaattttttaaatcagttgtttccttactgctcatttttaagagctctttctctattttgaataattatttatcagaaaagtattttaaaaatgtttttctcccagtctgtatctttacttttcattcccttgacagtgtcttttttctttctttctttcttttatttttcaacttttattttagattcaggggatacatgtgtaggtttgttatatgggtatattgcatgatgctgaggtttggagtataaatgatcccatcacccaggtagtgagcacagtaccaaatagatttttaacccatgcccttttctcccttccctctccaatagtcctcagtttctgctgttgccatctttatgtccatgagtacctaatgtttagctctcacttatgagtatgaacatatggtattggtgttctgtttctgtgctaattcacttagggtaatggcctacagctgcatccatgttgctgcacgtagacatgtttctattctttcttatggctgtgtagtattccatggtgtatatgtaccacatttgctttatcccatctgtcaccgatgggctcctaggttgattccatgtctttgctattgtgaatcgtgctgtgatgaacaggcaagtgcatgtgtctttttggtgaaatgatttgttttcttttggatgtatatctagtaatgggactactgagtcaaatggtagttctgttttaagttctttgaaaaatcttcaaactgctttccacagtggctgaactcatttgcattcccaccaacagcgtataagtgttcccttttctctgcagcctcaccagcatctgttgttttctttgactttttaataatagccattctgactggtgtgaaatggtatctcattgtggtttggatttgcatatttctgacaattagtaatgttcagcattttttcatatgtttgttgccttaccgtgtgtctttagaagtgtctgtttatgtcctttgcccactttttaatggggttgttttttgcttgttgatgtaagtttcctatagattctggatattagacctttgttggatacatagtttgtgaacattttctcccattttgtagggtgtctgtttactctgatgatttattttgctgcacagaagctctttagtttaattaggtcccacctgtcaatttttgtttttattgtgattgcttttggagtcttagccataaattatttgccaaggccggtgtctagagtggtaattcctaggtttccttctaggattcttatagttttgagttttgcatttaaatctttaattcatcttgggttaatttttctatatggtaaaatggagtgatccagttttaatcttctgcatatggctagtcacctatctcagtgttatttattgaatagggagtcctttccccattgcttatttttgttgacttttgttgaagaccagatggctgtaggtgtgcagctttatttctgagttctctattctggtccattggtctatgcatctatttatgtaccagtaccatgctgttttggctactacagccttatagtacagtttgaggtcagttaatgtgatgcttctggctttgttctttttgcttaggattgcagtgtctattcaggctgctgcttttttggttatacataaattttagaatggtttttcctacttctgtgaaaaatggcattggtgattttataggaatagtgttgaatctgtagattgctttgggcagtatggccattttaacaatgttgattcttcctatatatgagcatggaaagtttttttatttgtttgtgtcatctatgatatttttcaacaatgtttggtagttctccttatagagatctttcaccttcttggtttggtgtgttcttaggtattttatttttgtgtggctattgtaaatgggattgttttcttgtattgtaaatggaaatgttattggtttatagaaatgctactgatttttgtacattaatttgtatcctaaaactttactgaagtcatttatcagttccaggagccttttggcagagtctaggattttctagatatagaagtatataatcagcaaagagagatcatttgactcttttttctatttggattccttttatttatttttcttttataattgctctggctagcacttccaatactatgttgagtaggagtggttagcatgagcatccttgtcttgttacagctctcaaaggtggggatggttccagttttgtccattcagtataatgtgggctgtggttttgccattgatggttcttattattttgagatatgtttcttcactgcctagtttcttgagcatttttttataaagggatgttggattttatggaaagatttttctgcatctattgaaatatcatatggtttttgtttttaattttgcttatgtggtgaatcacatttattcatttatgtatgttgaaccaaccttgcatttcaggaatgaaactatctgtattgcagtgaattaactttttggtgtgctattggatttagtttgcaagtattttgttgaggatttttgcatatctatgttcatcaggaattttggcctgtagttttcttttttcattgtatctttgccaggaatttgtatcagggtgatgctggctttgtaaaatgaatcagggaggagtctcttctcaatttatttgaatagtttcaaataaatagcttttttttttttgtatatctggtagacttcaaatgttaatccttctagtccatggatttttttttttggttggtaggttttttattattggttcaatattataactcaatattggtctgttcagtgttcaatttcttcctgattcaatcttgggaaattgagtatttctaggaatttaacaattttgtctagattgtctagtttatgtgcatagagctgttcacaatactgcctgagtatcttttgtatttctgtgaaaacggtgggaaagtcatctttgttgtttctgcttctgcttatgtgaatcttcctttctttcattctttctttctttctttctttctttgttaatctagctagtagtctattgatcttgtttatcctttcaaataaccaacttttggttttgttgatactttgtatgggttttttgtacctcaattttgttcagttctgctctgatttacttcttttcttctgctagctttgaggttagtttgtttttgtttttctagttcctctaagtgttatgttcgatcatgaattttagacctttctgtgtttttgaggtaggtgagtagtgctataaattttcctcctaacactgcttttgctgcatcccagatattttagcacagtgtgtctctattttcatttatttcaaataatatttttaatttctgctttaattttgttgtttccccaaaagtcattctgaagcaaattgtttaatttccgtgtaattgtgtggttttgagagatcttgctcatattgatttctttttttattccactgcagtctgtgagtatggttggtataattttaacatccttgaatccattgagacttgctttagggttgagcatctgttcaatcttggagtatgttcccaagatgaattattcgtagagctataatatatagcataggtaatatcgttaataataatgtattgcatactaggaatttgctatgggaatagaagttatgttctcactacatcagaaaaaggagtatgtcaggtgatgaatatattaatttgcttaattgtaagaatcattacataaagtatatttatatcaaaataccatgttatacttcttaaatatatacaatttctacatgtcaattatatctcaataagactgggaaaataaaagtaaaagtataatattctaaatgtagccataaatctctcaattaccaaaaatgaacttgaaagctctatctacctcaataggcggagagtttctgctttaagactcatttttcaaaatcttgtgctaaaagaggccatttatttactcctgtacattttccatagtcttctattcttccccattttcttctttcttgagtgtataatgtacttccgactactgggaaaactgtctcaaatactactgattgaactataattggctttttaaaagccacatggagaaaaaactactaagatagtcatcaattttgcagaaaatacaaccacctcttattttccaagctgtgtctacacattggcagagacaggctacgagaactttttcttcaaatttgcattgtgggttcatcattactggcaaaaataatttttcacagattctttataagttaaacataagcttaaataatgctcttcaaaccttggccctaatgcacatccttttattttataaaatataactagccccatttagagttagaaggaaaaaggcagagcagtaattgagattatttcaatttgctataataagttgagattatttgtaataattgagattatttcaatttgctatatatcttccaagtcttcaggttccaaaactgtattgctacagaagcatcagaaaactctcagctttaactcaactcccatttaacttataaaacatatctgaaaaagtaattctttttccatttgatgcatgtcttttatgatttttttggttagaaacataaaatttagaaactcatttttgcttcaaggcaaaagtatatgcccactgaaaacatcctaggaacaagttgtttttcactgaagccactcgaatgaaaacatcacaaaccaaaatgtttgtcagggatccattgagtgttagaaacagtagagaagagacataccaaacctgggagcaggttcctggaagcttatcatgtagttaagatgagaagttatgtaacaataacaacaaaacaacttttatataatatcacgcttcaatataatataacataatatagtatataaatgaattatatgatgacaaccatgtgtcaggcacctgcctaagcactttacctatattaactcatttaatacttacagtggccttacaggatgcttataattactatgattattcacattttacagataagaaaaaagacaaagagcaaagcaattttagagttagatcattaacccagcccatgtatctcccatgtccgttttcttatttgctagatgctgctgcttctcttattatatcatgtcttacaagggcagaggcaccaaatgggtgcaacagaactgcagagaatggaaggaagtcattgtggcttgaagaatttgaagaataaaagaggcatggggctaggtcttatgtgaacaggaaaaagctactttaagctcataagtgcaggcaaaaaacctagagatcatctttgtccttccctttcattaccacttcccacacattccatcacacaattatctccttctttcttctaactggctttctcattattctacttctcttcattgctactgtcattatagctttctgtcatggattttgcttgaactaatgctatagtctcctgactcacccccctgcccttgatattttttcaattcattctccacattgtagttagagtaatgtttctacaaaacaaatctgattgtattattctcttgctcaaaattattcattagctcccaattttccttaggaaaaaatatgagttccttagcatggcttagaatgcccttcatggactaaccattgcataattctgtaatctcagcctcagagcaaaccctctcaccatcaccactaccaccaccacagctcgtggcagcatacctttttccactaatgaatttctttgaattcgtcaaatatctttcttgtttccttgagtttttcaaataatatctttcctgagtatctccttcttccctattacatattatttaccattcaagtcctggcatcaacatttcttcatttggaaagtcatccataacccccaaaatgatgctaattgtttgaatgtgatccctattcttatattcttatttttatgggcagtcctcagcatactttaagataattaccggttatttgttcagttatctctaagactagaagtctgcgaggttagagacccctcttttattattcatgattttatctccggtactcagggtaccaaatccctgtctcctaagcatgcatacaaagagatgccatgcacttcaaaagtaaacacggcagggtgtggtggctcatgcctataatcccagaaccttgagaggccaaggcaggtggattgcttgagctcaggagtttgagaccagcctgagcaacatggtaaaaccccgtctctaccaaaaatacaaaaaaactagccagacatggtggtgtgtgcctgtagtcccagctactgaggaggctgatgtgggaggatcactagagcccaggaggtggaggatgcagtgagccaagactgggtgacacccagcctaggcgacagggtgagaccccatctcaaaaaagaaaaaaaaaaggtaaagatagggaaacttgaaattattgcagtgtaaattacccaagctaaagcacagaggaagaaaagactaaataaatacatccataacagagccttgggcagtgagtacaacatctagtggattaacatatctaaaactagaataattgaagacagacggcttaaaataatggcttaaaatgtttacatttggtgaaaattataaatccactatttcaggaaatttaacaactccctggtgagttttattttgctttaaccaaataaaaaccacagcaaggcatatcataatataaatcattggtaaaaatttgtattcgctggatctttataaacatccagagaataataagtacatttatatttcagggaacaacaatagcaatcatctccgacttcacatcaaaagtaatgagacaaaagacaatggaaagatagcttagaagtcttgacagaaagaaatactgtgaagctagaattatataactagacagtttttaagaaatgaattcaaataaaatatcttccaggcaaacaaaagcagagagaatttattgtcagcaaatatgcactatgagaaatgttaaagaaaattcttcagagggaagggaaataatgtcagatgaaacttatatctgtaaaatgaaggatttcagaaatagagaatgtgtaggtaaataccaagtgtatatttcgattaattttgttacaagataaatggtcgcttaaagcaaaaataataatgaactgagggattagtaacatatatgaaagtaaaatagttgtattagggtcctccagagaaacagaactaatagagaaagaaacatagaaagagagagagaaagactgactgtaagaaggctgggcgtggtggctcatgcttgtaatcccagcactttgggaggctgaggtgggtggatcacgaggtcaggagttcgagaccagcctgaccaacaggtgaaaactaccaaaattagctgggtgtggtggtgcgtgcctgtaatcccagctactcaggaggctgaggcaggagaatcgcttgaacctgggaggcggagattgcagtgagccgagattgcactgctgcactccagtctgagcgacagagggagactctgtctcaaaaaaaaaataataaaaaaaaataataaattgattgtaagaaattggcttatgcaattgctagcagtcttcataaccaggaagagcagatgttcccgttcaaaggcagtcaggcagaagaatttttttttcatctggggagaggtcagcctttcgttctagtcacaccttcaactgattggatgaggctcacccagtattggtaagggcagtgtgctttacctagtctaccaatgtaaatgttaatctcatccagaaacacccttgcagatacacccaaaagaatgtttgacaaaatatctgggcaccacctgccctagtcaagttgacacataaaactagacatcacaagtttaccccttgtcaacttggcatctataacatctccttaaattgtacttaaactccaagtaaagacaataacaaggccataatttcacctagtctgatataactaccctgtgtgaaaccaaaaatgcactaattccttccccagaaaaggaggtaaagtccttgcatgatatttacttttctttttgaactcccatagcttaattactataatgtaaagttaacaatacttaagtactacgatataaagtcaacatatcttatgttacacaataaggatataatagaggaaaaataagatattattatatgcacataaacaaatatattgattaaaaataaaggggaaatactcagataattacagttctcatttctgtaatgggtcgcatggtcatagctggtatttataactaagttcttgcactttgcctttagcaggtacctcagctctggttgtgattctttattaacaggtatgggagcaagcatatgacaggttaatatctgcatcctatgtaccaggggatatattaactttctcaagcaatgaagccacatctggtacaaaagctgcagttggattcatcatctggataaacataggataatccactttaattctccaagatccatcagtcttctgcacaggccacataaactcattgaatggggatgtgttgggaatcaccacctctgcatctttcacgtccttgatagtgcccctaattctctgcagtccctccgggaatgtggtattgcttttgatttactaggtagaggcaattcgagtggctttcacttggccattctcactataacatccctcacttcacaggtcagggaaccaatatgaggattctcctagatgctgaatatgtttattctaatgatgcactctagaactggggaaatatccaagttcatggacccagtgggccaactgtaaaaaagacctgaactaaaactccattgaccacctgagctcgataagcccctactctgactggtggatcacagtcacttggggtttcctggaattagcgtcacttcagagccattgtccagtagcctccaaaggtttgattacttctgtttctcttagtgtgcagctaccctggtaacagccataagtcctttgggggaaggttaggagacagattaacagcataaatgttggcaatgtaccaggggtcttctttaaggggccagtcccttattcaaggggttctgggtctataagccagctcaaatctaagaactgattgaggggctgtgactctctgtttttatgattcaagttagactttaattcacttgacctagaaggtctctgcttatgtagatcgagtatgaacttagtagggcttcctatctatttcactctgggaacattatcatcaaatagccaatgtcaccaggcgtgtgtgtcagactattctgagtgctgctgtgcctctgctgtttattatggtaaccactcccacctcgctttgggcaggttagtgctgccacttggccctgacaccctgggattcaattactccactgcattctgttatccaggtcagtgactgcagttcccaccgtaaggtctggcctacagagaaaagttatcacaggctctgcaaggatgctggggctctcctcacaagtttatttctcagaggattagtgaaaggtctgtcttctgaaccctctgaggataggtgagtaggttttaaccaacaaatggtctctaaccttccaatctccctaacatttcaatctttcctttgaatcccttctcctacatacaaccaagacaggtccagaatttccaacttgcttattgtgggccatcttttggtccatatttaagtcaacaaactggtagagccctttttatctcccagagctacagcattaactgcaggatctctgcttagtcaaccaaggtcaatgaatttgacctgatccaattttatgttccttctaccattattccacacccttaatatccattttcccacacgttccccagatttctttctgtgcaagttaaaaaacctcaagtaggtcttctgaagtgtagtaaactcttataagtcacactttgcacctcaccttgagaagcctgctgggaccggagtgaagtggcaggtctagaagcaaagaggggtggtagggtggggtcctgataagaacagcattgtgttgcacgcctcgggggaggccatgacagtttccttgagcaatacagggttaatctcctcagacacaggtgaaaaggcaactttccctggcagtgggaaggctgcttgcactggagctaggcctcttccactggccaaaaagagctaccagaatttaggggctcaatagctccagtttcatcagtttctcccacatgtccctgtttcatacttcagaattctatttcttcccaatcgcttcctcactttaacagtagacgccctgcaagtctggcagtttacctcacgttgtaactcagctggtcacaggacaagattcaggcttgattttcagcagtctcagccctgtggctagagggatgaggcctcctgagctggtcacaggacaagattcaggcttcattttcagcaatctcagccctgtggctagagggatgaggcctcctgagctggtcacaggacaagattcaggcttgattttcagcaatctcagccctgtggctagagagatgaggcaagattcaggcttgattttcagcagtctcagccctgtggctagagagatgaggcctcctgagctggtcacaggacaagattcaggcttgattttcagcaatctcagccctgtggctagagggatgagtcctcctgagctggtcacaggacaagattcaggcttgattttcagcaatctcagccctgtggctagagagatgaggcaagattcaggcttgattttcagcagtctcagccctgtggctagagagatgaggcctcctgagctggtcacaggacaagattcaggcttgattttcagcaatctcagccctatggctagagatgaggcctcctagagggcacacattgaagttttcaggtcatctattgaacccttgagctgggagcttatttctttcttttcccacattgtccagtgacattaggagcaaacagccaatatcattatactcattattttgacaaaaatattgaagaatattgtatacacactcaccctgcttcttataagcggttgattaggggaatctaatggtaatattttgcaaatttctactgccagatcatgctatgaactgtcaatgctctccatactactggaaatagtcattggtacctctaaatgtaagtgaggggaaaataggatctggaggtgagagacaggactagctggatttcctaggccaactaggaatccctaagcctagctgggaaggtgaccacatccacctttaaacacggggcttgcaacttagctcacacctgaccaatcagagagctcactaaaatgcgaattaggcaaaaacaggaggtaaagaaatagccaatcatctattgcctgagagcgcagcgggagggacaaggattgggatataaagccaggcattcgagctggcaaccgcaaccccctttgggtcccctccctttgtatgggagctctgttttcactctattaaatcttgcaactgcactctcttctggtccgtgtttgctatcgctcaagctgagctttcgctcgccatccaccactactgttagctgccgtcgcagacccgctgctgactcccatccctccggatccagcagggagtcagctgtgctcctgatctggcgaggcacccattgcagctcctgatcagggtaaaggcttgccattgttcctgcacggctaagtgcccgggttcgtcctaattgagctgaacactagtcactaggttccacggttctcttccgtgacccacggcttctaatagagctataacactcactgcatggcccaagattccattccttggaatccgtgaggccaagaaccccaggtcagagaacacaaggcttgccaccatcttggaagcggccagttaccatcttgggagctttgtgagcaaggaccccccacccgggtaactgaggcagggaacatgagatcgattcacacttcagctatgagagaaaatatcctctccatttacatagggcatatgctcagtaaatgactttgtaactttacttcatcctctacatttatgtagagtgtacaccaagtaaccaatggaaatctctcaagggtatttaaactccccaacattctgtaacagggcccttgagctcctatgctcgggtccattcccacactgtggtgtctacttttattttcaataaatctcttaattcctccctcgctttgcttgtgtgttttgtccagtactttgttcaagacgccaagaacctggacaccctccgccagtaacataagcgtatcagagagcagattttagaaagcctgaaatcaacccagacaactcattctcaaaattctttctccagggcaacttttggtatcaaaagctatatgagttagggttctccagagaaacagaatagatgacagacagggagatagatagatagatagatagatagatagatagatagatagatatagattacatagatagatacagattacatagatagatacattgagcaagttcattggtgccatttttcaaacattatgtgttcacttcatgtccgcatgtcagcatattttagccataaatatttttaattaaggcatatatgttgttttttagacataatgctttgcacactgaatagatgatagtatagtgaaaacataacttccgtatgcactggcatccatgcacacaatacatatgcatatttcccaatctatacatagatattagtgagcataatggagaaaagaatcatcaaagcaagaattattgacttcagatgggattgtgctaactttctctcacttctcaaaaccaagtgagaattctgagaaattcaataagggacaccttgtggagcaacaatgattaccttttgtgatgagattgtaaagataatgacacatgtataataggaaaaaaataagcattgctttctataatatcttactgctgcccaagaggcccattgttggattggcaccaatggtagctatggagaggcaaatgtagatgtggaaactgggacagggactaaactactccacataataaggattagaggaatttgaggtgtgaagggtgagaataaagggaggaatgtatgaagaagaagctaaaaatgataatttaaagctttgtaggggcaagaacagagtaaaaaacctatgctgatggttctgaaggaaagaaaatgtaatttttacttcagctctcataagttcatagttgtgacagactcctacaacaaaggacaaggtaacgagaaaaacaagcaagttctttaacacatgcagggcatcacatggaagaaaagtaactcaaagcagtagtctaggagtctggcttatacagcatgtcaacaaggagcagtaggtttcacaagtgaaaagacaaagaaaagcagttacaggcttccattggtgggaaacggtaggaaggtaaatatatggaaatacactaataaagtcaagtcggcttgagattgctctgggccatttctgggctgataagagttggaatggagaatttacatactgtctttaggggagaaaagaaggagagagtaggaaagtgttttcttctgtaaatctctatcctgcttttaggcaaacagagggaaggcagagactcccctgaatcttcattgtcttcagctcaacaatatttatgtcaaagaagcacattttgagatgacaccttctggtttccttcagtctcccctttgaaactttcctttcagaaagttttacatagaagagccaagttggtagctttggagcaatttggctaggggttgtgagataagggattggcaaaggcagagaaaaacatagattgaaacaaacagaaaagaacaaatttgagtaagttatcccatatcttattgaatcagtctctgagtcctgggaatacatatggtatttaaacaggtgtgtttcatttcaggatgtggccttgcacatgtgttcccatcaaaggcctccatatggtgcaggcaaatatatttatgaagaagcatttctatggaaataaaagaaaaacaaaagattaataattggagccatctacaaactactatctgagtctggagggcagccagctgagaagatttctagatgttcaactcaagcatctttttttttttttttttttttttccagacgaagtctcactctgctgcctacactggagtgccgtggtgcaatctcggctcactgcaacctccgcctactgggttcaagtgattctcctgcctcagcctcccgagaagctgggaccacgggcatctgccaccacgcccagctaatttttgtattttctgtagagacagagtttcgccgtgttggccaggctggtctggaactcttgacttcaggtgatccttccacctcagcctcctaaagtgctgggattacaggcatgagccaccacgcccggcctagactcaagcatctttagttgaagcaggagcaggcagtggcaagctgacaaatatttctggtttgccatttaaatgtcgtaaagcttgtctataaataagctgttgtgatttcttggaagtttgtatcaagttgtctggcttctgcttggaaaagcacagtgttagttttcataatttcaaggcagaaataatggaagaaaattttcaaatactagtttggaaagtcacagccagacatttgagaaaactaaaagaattcagaatccagtccagtttacaggtaaataataaaatctcaaaaacaatgaatatggttagaatctaattatcaggtgcataacagtttcctatttcttttttatgaaatataaattttttctctgtagtccccctatttttaccaaagataataatggtaagtccaatttatttgcaaagtaagtttggtccctcattaaatttagcttgatcacttacatagtacagcaagaatggtgattgatcatataggctttttataaatttgctttgctggatctttttataaggaatctcacattagacttttgaaaacctcttacaactaggaagctaagctaaggactcacgatcaaacgttgccagtaatgcctgtcaatgagcacgaatacatgtgttctggaggttcctcaaagtatcatgagtttcctgggcccatcatgaaccaacattgtttactcactgtaagtacagaaacgttgtaaggaaaccatgtattcaaggtaccaggccagttttttcaaggggcttttattggctccataaaatcagccttaatttcttaaaactctgtggtcatgtctgaaaatatgacattcctggcagctttggtaatgtaatcagtgtttccaattgttgcctgctgcaagaagaatatatttttattaaacttatacaaataactatattgtcatagaagtaagaatacttctaaatagttttcaaatttttaggtagggagaaaaggtaattgttttaattctgctcacaaaaatatactttaccaaatgccacaagctatagatagcttaagagaaaagttttccttaagtctggaaaataaaatataaaatgaatcagcaatgtttcaaagaaaaatctatttaaaaattataatccttcatcagttctgtgttgtgcaatcaattcttttgcttgatgttaacaattttattaactcacttttcccattagttttcaaaattcttatccactcaacggagtgttcttaaagttatcagaaacttgcttttaacagtacttatcagaatcttcacaattttctctgaaaaagaagtaattttggactgtagctgattggaaaaaaaaattagataagaatcaaagctgttggctgggtgcgggggctcaggcctgtaatcctagcactttgggaggctgtggcgggcggattgcctgagctcaggagtttcagaccagcttgggcaacatgatgaaaccctgtctctactaaaatacaaaaaaagccgggcacagtggctcacacctataatcccagcactttgggaggccaaggtgggcagatcaagaggtcagcagatcgagaccatcctggctaacatcgtgaaaccctgtctctactaaaaatacaaaaaattatctgggcggggtggcggggcctgtagtcccagctactggggaggctggggcgggagaatggggtgaacccgggaggcggagcttgcagtgaaccaagatagcgccactgcactccagcctgggcgacagagcgaaactccgtctcaaaaaaaaaaaaaaaaaaaaaaaaaaatcaaagctgctatctatggatgacaaagacttagaatgacgtctgaactctcatcaggttgttagcaatcttgtgaacccagaaaatctgagacaggtctcagttaatttagaaggtttattttgccaaggttgatgatgcgtctgtgacacagcctcaggaaatcctgaccacatgtgcccaaggtggtcggggcacagcttggtttatacattttagggagacacagcaatcaatatacggaagaagtacattggttcggagacacatcaatcaacatatggacgaagtacatgggttcggtctggaaaggcgggacaacttgaagcaaaggcaggaagactccaagcagggagggagcttcccggtttcaggtaggtgatatacaaatggttgcattcttttgagtttctgattaggctttccaaaggaggaaatcagctatgccactatctcagtgagcagaggggtgactttgaatagaatgggaggcgggtttgccctaagccatttccagcttgagttttccttattgattttgggggcccaagatactttcctttcacattccccctcttttcttttaaaaaaccttttggaaaaagcattttacaagaagatgaatctccggtctcaggtttcatctgatctctcatgactagaacggtttattcctagatggggaggtcccaaaagctcatttttagcaggttgtgaagtctcatgtcctgtgaagagaaaatagtgggaaggaagggagaaaaagcaacaacaaacaaaagaacaatcctggaaaaatcgatataggccacgttacgctgaagtccatacattagtaggcaggtgtgaaagtggcttttggatgtgaataagtttctattattttcttctgaaatttaagttgtgtggcttcagtttggagggtttaaagaaagcacagcttagttttcagtgactctgaattaggaaaaatgaaaaagaagacggaaaaaattgaaaatgttattttgaatacttgtagccaagaaaaattataattcagtccaaactgtagaaaataataaaaattaaaaaaaaaattaggcaagactagaatctaataatagatgtactatagttttgaaacatatttttttctctccagtttcccatttttaactaaaattatggtaggactggttgcctttattatacttggcctaattatttgtatatagtgcagcaagaataattatttttttacataggcctttacattggctttgatggaactttgttccataggaggaatctcagacaagacttttaaagccaagcccagccatggatttgtaccatcaaatacctatgggttgggtgaatttcctctcctctggaggttccaagataaacctggggcttctgcacctgtcagaaagtgacattctttacttcccacagatcacaagccctgtacagagactgtgtacacaaaatatgaggctagtttccaatggctttattggcttcataagtcaagtttgattccttaaaggaaagcacaccattccagtcaaagccatggtaaaataaccagtttcttcaattgtgtcccactgcaaatgaaaacagtttcttttttttgacagagtcttgctctgtcaccaggctggagtgcagtggcacaatctcagctcactgcaacctctgcctcctgggttcaagcaattcccctgcctcagcctcccaagtagctggaattacaggcacacgccgccacacccagctaatttttttgtattttagcagagatggggtttctccatgttggccaggaaggtctcgatctcctgacctcgtgatccacccacttcggcctcccaaagtactgggattacaggcgtgagccactgcgcctgccctgaaaacagattcttattgcacttatgcaaataactgtattgccacaccttaagaatactcacaaagtttccaaattctggagaaatcacataaagagaaacaaatgtgctccaaattttgttcataggagtataccaaattgttaaaagctgccaatagctcaaaagaaaagttttgagactctgaaaatgaaacaaaggatcagcaaacatattaagcaaaaagtcaaaaagattggtttagttcatgcagcgaaatcctgttctgcttgatactcttgaaaattttagctctccatgagtcctgaaactttttcctctattctgatgtcacaatctcccaagttatcagaaacctgcatttaagagcacctgttggagttttatagctgattataaaagcaccttgtaaaggggaccaaaacaagacaacaattgtccacaggtgaaaaaaagttttaaggcagtcatagtcaaaagacacaattgacaaggaaacttgttacctctggcacacaataatttttacataacaattatgattattactcacaatatacgctgttatatcagaattacatgagtttcccataattttggaacacataccaataatcaacttatacaaatacagcccaaagaaaaccaaaaatatttcatatttgacaatgctttctatataatttttataccaaataagccaaattatgtcatttttggactttaggaaactaatatcttaaaggattaattaggttagaaagagacataatttataacttgattttggaaagtttgtcaaatataaaaggtttaaaacatttgatattacaaaataagattacaggtcattgtaaaatcatttatttaaccaaaatgataattcaaggatttcaaaaaaaagcaaaaaccttcattcattgcaagagaagacttaattctctaaacaagaagccctaataaagacagagtgaagccaattacatttgtttttcaaaattttgtaaacaatctataaaatttaatcttgattataaaacttccataagccttttctaacctttataacctttattaaggggttggttcatgcttcaagaaaaccttgctaatctgacacaggggtccatatactggttttgcatcagcgtgcctttgacattaataattaatttgtagagaaactgaacttactttatctttcaaaattgacccttacaatcttatgctcccacctcttttgcaattgtccctgggtcttgaggagttgcatagctttaatttctggccctgtgtctcaggaatgtagtttgttttgattggcatcctctatggggcctgaagatgaggctttaattgttgccagtgtttaagatttaacaggacttgttgtcctttttagaccaaggaattaaagccctctaactcaatgttacaaggactttaaaagcatatacaggaagatacgtggatataataacctcaatttttaaaaaaaattatctccatttttttttcctaagcaaaccaaaacttaataataatatgacagcttgattatataaaagtttttgggttttttaaatatataaaccctcttattgtgactcacactgactgctcatcagactttctgatttgttttgaatatcccttctttttaaacaaccagttatttcattttagaatgaaactatacaagattctttcatatataatattatttctctttaagctttttttaacctcaaaaacaatctctttattttgataactttctttacatcttttttatttcctgattccttttaccttgttttatacataacctttaaataagctttgagttagacaaaacttgttcacctttaaagaaaaaaataaaagagacacacttgttttttgtttgtttagcaagaatgttttcctacaatatatatttattggaaaatacccaaataatgaaatatcccttatttggtttaatgtaactttataatctaaattatggccagtttgtctacaagtatttatcccattatatttacctaattattttattttgtttacatagattctttatgaaaattgtgatagtcatgatttaaagttatgaaaccaccattgcaaaattataactgagacagtggaaaaagatttaacgtaactgattccatattgctcttaacctccaggctgtccttgttcattcctgggctcaggctgaactacctttgggaggaacttagtttatagtttagctttgaaacaaagatgataacagtcgttttgcaaaacaaacctccttattgtctgtggactaaattgcctaaagccacaggattagaagttatggtaaccttactaaattcaagatggaactattttcattaaagtcatattgatgtcttatttattaaaaattacacaagcaaagatcattctgttttggaccaggtttatagttttgtaacccctatgccaaatttttaacaccttatagtgtttggcagggataagtatgaaatagtttaataaatgcaaacaaaaatgtatgctggcaattcttttttttttttttttttttttgtgacggagtctcactccgtgtcccaggctggagtgcagtggcacgatctcggctcactacaagctccgccttccaggttcacaccattctcctgcctcagcctcctgagtagctgggactacaggcgcccgccaccacgcctggctaatttttttgtacttttagtagagatggggtttcaccgtgttagccaggatggtgtcgatctcctgacctcgtgatccacctgcctcagcctcccaaagtgctgggcttacaggcgtgagccaccacgcctggtctatgctggcaattcttaagacatttctaatatgactttaccaagttagctcatgctggtcccaagcaccgatagatttgtcaaaggtcaggggcatctccactcagaatccccgcaatggttaccgaaatgtgaacccagaaaatctgagacaagtcttagttaatttagaaagtttattttgccagggttaaggatgagcctgtggcacagcctcaggaagtcctgacaacatgtgcccaaggtggtggagcacagcttggttttatacattttagggagacgtgagacatcaatcaatatgtgtaagaagtacattggtttggtctggagcaaaggcaggaagacttaaagtgaggaaggagcttccaggtcacagataggtgacacacaaatggttgcattcttttgagtttctgattagccttttcaaaggcggcaatcacatatgcatctatctcatgaagcagaggggtaactttgaatagaatgggaggtgggtttgccctaggccgttcccagtttgagttttccttagtgattttgggggcccaagatactttcctttcacaatttgctaagagtttattataataatgatacaattgaccaaaaaaagtggttatttctgtggcatacaatattttaacataaaaatcgtaattatgacagataacattttaatacatacatattatgtataagaaatcttacagaattttggaacacatgttaatatactcatacaaagataactcaaaactgttgaacattatttcttatttgacaattcctcccatgtaatttaatataaaaaataagcctaataagtatatcttttatatttcctttgggaagttccagggtcctttgggacatctcaaagttacactaaggtcaaaaagacttaatttagaatttgatctttgggaaattcatcttacagcaaaggtataaaacacttgattaaaatataatcacaggttactatgaaatattagtcatttacttaactggagtgatatttacagatttcaaaagcaaataaaagaatttatagacttgtagaaaaaccttaactctttcaatattcacttttcttaagtaatcagagacctaatgaagacagcatgaagcataggaaattatcttgatgaaacacagaatttttctctcttctttctctcctctcactttttttagtttacttaaaagagaaacaaaaatattttactgtctcttatcaattccacatgaaaattttgtttttaaaaggtcatgttctacttttgcatcagtgcacttttgatatgaagatttaatttttagaaaaacttataaatatcatctaagtttagccagcttgatatacacaaaatttctttcacaagatttatcttcaacaaacctttcacaactttctaatccattcattttatctatatcactccttttgttattcattcattctgcaaaaacatctaaataacctccaaactaagcaaaactctccttcctcaataaaagcatatcataatatctcatgacactgtaattttcttgtatactttgtgtacagaattatttccttatctctagtagtttaagttacatattagaattttaggccttataacttaatttccagtaaaaatccaggaagtaagatattttgaagtcttatttaccagtattttataagtacatattttataatttctagagacataagctttctcttagaacaattttttcatgtggaacaggacatgtttactaacatctcagatatatttgtctttatgtaaaatttaagaaaccaaaagtaaataaacttatgttcagcaattaatgtttcagtattttatcttatttggaactgatctagatcttcaatgagcatctgtcatttaacttagcaaaactgtaagggtataggtagagacttgagaaactaagtaagcaccttataaaatatagctttttaagagtatttttataaacttttacctaacttacatcttatttaattcattcttttttaacaattatgcctggaaaatttatgagacattagacaaagctagtcatcaaagaagataatctgtttgatttaaaagtcacttataggccaggtgcagtggctcatgcctgtaatcccagcactttgggaggccaaggcaggtggatcacctgcggttgggagtttgagaccagcctgaccaacatggagaaaacccatctctactaaaatacaaaattagccaggtgtggtggtgcatgcctgtaatcccagctactcgagaggctgaggcaggagaatcacttgaacctaggaggcagaggttgtggtgagccgagatcataccattgcactccagcctgagcaacaagagcgaaactccatctcaaaaaaaaaaaggtcacttattagataaaagtctaaaggtcctctaagttcttgttgtcttgaaatcactctacctaccacgttattaatttggaagcctatttttccctgttttggccagaaaaaatttaaaacttacagcaagcttttgaaatcagtaacagttcttttttcttgtgtctataggtctgtttaattgtctagttagtgtaggtgagaaatggctttcaaaggttattttcagggttggtgttttgttgttattgttgttatttttcttatccatgcactgcagacaaagcatttttaattgtcagataagcataccttttcttgttgttttcagttcaagattttggccaaagcaaaatagtggtttaaaaagtagacttggttaatctgtgttgcagctcttcactcttgttgtttggcaagtgggagggagtgttacagctcttttattcccaccatgggcaagcgccaggctcttgtcccatgacaaggaagaataaggcacatggacaccagagagagtgaggcagagtcagatttactaaatgatagaaaagcacttagcagagagaggacccgaaagccacccatgagtctgagtttgggggtttttatggactgcaatgtgagaggagtgtgctgactggtctgcaagctgtcttggagacagcaccactcaaaaagaggtatgatagtgtaaacagccaattgaaggcagaggtgaaggcttggcctgggacgttggcctgggacaaatcagtggctgaagtgatgattcactctatgtaaatgaagattcagcttgttgtcaatcacagaaaggtaggcgtatataaaataagtgaaaagtaagagactaaggtgcaccaaggagagagaaatgtgtccaaaaaggaagtggaatttgttcatctgggttcacagagtaggtgtttccattcaaggatgctggctccttcttatctggggcctgcagtttgattttcaggctgttcttggtttgaaggagttttaccagggacccaccctaattgcctgcctgactggtttcttcctttctcctctctcatgagagtcatcaacagattcagaataaaagttgtatgtctacagtgtatttattgctgatagatatgtctgcttaaattaaaccaatagtattaaactagtattatttaccaaagatttacccaagtaacataaacttagaaagcatttgggttagttcctatattttatcatctttaagcatatattttatatgagtactcatttatgtctttagccaattaaatagactattttaagagattttatatcatatagacataatgtgcaagtatacatatacacatgtataaatatacacaaacatacagatagacacaaacaaatatcttgtagcttttatttttaaattttagttaagagacaggtataatagtataaaacttactagtctataaaaggacagttagatccattagaaagaacagagatgcctcaaaatatatattgatagattgataggcatagcctgaatatcagcttccaattaaactaacttttgaccatagacctctttattaaaaatattcttttcaaatatttttattatcaaatttagctggggcaaacagcaaacaattctgcttcctagcttctcgttccctgaaatttgcatttgaaaagggatggtttcttggtaaaactgattaggaaatttatatctcaaaggctcagggaaatacagttttcaccaagaaggtattttggggaggtatatttgcctattaaaggtctaggataattgctattcaaaattccttttttaaaaagtgcaagagagccctgtttcctgatgcttttcagtatcagataacatcctgaggtgaataggtgaggtttggggttttctttgaattgctttaaagcaattaaatttttgtttttgtaaagactcaatttgtaagacaagaatagttactttttttttttttgagatagagttttgctcttgttgcccaggctggagtgcaatggtgcaatcttggctcactgcaacctctgcctcctgggttcaagcgattctcctcctgcctcagcctcctgagtagctgggattatagccatgcgccaccacacttggctaattttgtatttttactagagactgggtttctccatgttggtcaggctggtcttgaacctacaacctcaggtgatctgcctgcctcagcctcccaaaatgctgggattacaggtgtgagccactgcgcctggcctaagaataggtacttctaattcccttaagaattgggtggcagcctgaatgattttaagggactgtcccatctatccaactatattatctttaacttatttctctctatcaaggagcagattttcaactaagatgaaaatcaaaagatctttctgttccagatatagacttaattacctttgaaatgttttaatatttttttttctgaatatatcgttccattttagctaaggagacaaggcaaaaaaagcaaacagaagtttctgtaagaacgaagtttcaaaccaaaggtatacctggaaaatgactcaaggcaaaattaatacttaagacaaaaccaataagactttaaggctttaattaacatctccaaaaaaagagcaaaaatatgcatccctttcaaaatacagaccctcccaaaaaacagccaaaagcgagaaaacctttgccagccacaaatagggtacaacaaacattttcctccagagacattcttaagtctcccaaccttttggctggctgcctgcaaacaaaggcccaataacctgtgggcctttggtggatgcaaagtcataaagacaatagtcagtaagacaaagagaaagacaagcttgccattaggtgtagggggaaggatcactaatgtaggggccaagggaagacttcccccacttattgtagggacaataaatgattaccagagagaacaaacggatcagggagcagagattaacctgtaaatgatcctccttggaaactgagcctgaaagagggacattatcttgtgaatgggtctggtcaggtgtggttccattcttcagtcttcttttctataataaataataagatgacatggaggggaaggaaacacaattgctccctgtggtctttatgtaggtggggaaggtctgccagcatctgttgatctgtaagggcccgtaattcaaaatactgattataccagggagccatattttagagtaaaattccctgcactcctttactaacaataagcctttatatgacttaaaaccacagatgcaagtatcaggttccaaagtgggtgcaaaagatgcagcccctcaagatctaaagtttttacctaagataccctaggaaagcaaaaactctcattattaacaaggtaacgaaggttgaggcaattaagacaaactcctgagagctggcatggtgagacaaatgtttggacttctagctagccggcataagtacaacaacttgtgatccccaggctggcccaagatactacaaagactaacctttgagacacagcagggaccccctattagggccctgagagccccccaaaaagcatggaaatatggaaagatcttgagttccttcaaaggaaattccaggcacatagctagccctgagaagtaaataaacaacttattaaaggagataatagtagcctgaaacgatggccaaggaagctggggtcaggagatgtttgctttccctatggaaactaaggatgacatcttaacatatgtccctgagttgtctttcagaaacatggacccccaccaggatccccacagaacagattcactggcatgtagacctcaaatgagggagaactgaaggctgaactgtgaccaccactctttgtcccaaatgtcttcctgagaggcctggtgggagtcacacccatgagctggttaacattcttttctgctgatccctaattttaaaataaagcttctcttccttaatcaattgcaaatcagaaaatctttgaatgtgcccatgacttgtaagcccttgctacaggatttcccacccttttaggccagaaccaatgtaacctccatgtattgaattatgatttttcctgtagcttctactcctgccttgaaaaattcttgcctgcaaaccatttgggaggccaggatttgaagatgagctgtctggtcctgcttgtttggcaccctgaaaataaatgacttcctttctgccactgcaacctcagtgtggatatctggttttactgtgttgggtgagtggactccagttctgtaacaccttgctggttacaaagccaaactctcaaaacataaagaaaaacaaaaggaagatattttcataattttcctccttaagacaaaccacacaaaagacagagataaggaaaacaaagacctcctggaaggctaaagatcaataactaggctgggcttggtggctcacgcctgtaatcccagcactttgggaggccgaggcaggtggatcatgaggtcaggagatggagaccatcctggctaacatggtgaaaccccctctctactaaaaatacaaaaaattacccgggcgtggtggtgggcacctgtagtcccagctactcaggaggctgaggcaggagaatggcatgaacaaggaggcggagcttgcagtgagccaagatcgcgtctctgcactccagcctgggcgacaaagcgagactctgtctcaacaaaaaaaaaaaaaaaaagatcaataactaacaggtgcccaaaccaaatccacaagagtcaccaattcaaataattaattattttttcaaaatcatttttttctgttgcaaatttgaatttaaaaaacaaaaaaaataggagttttgttttttttttcctttctctctcagcgaggcactacacatagagatacgagagagctcactttggtaaaaattctcttttttctgccagcttctgccacttctcccaggatcacatctgcagctgtcagggcaagtggagtgtgccagaatctcttggctagatcaccaaaatcaagcagagaaaataaaaattttaactcaatcctcccaagttcacagttggaacagactcctgtaacacgagactgattaacaaaagaaaaataggtgacttattaacacatgcagtgcacatcacctgtgagaaaaggaactcaaagcagtgatctaggacttacataaacaaagaacaataagttttatacaagtgacaagacaaagaaaagcagcaccagacttccaaacaccagaaactgtgggaaggtaaatatatggaaatacactaacgaagtaaaaatctgctcacagattcctctgagccatttctgagctgatgagcgttggagtggagaatttacatccgtgtttatgtgagaaaacaagggaaggataggaaagatgttttcttctatcaatctctgtcctgcttttaggcaaacagagagggaaggcagagactcttagttgagaatctaagttgtcttagagaatcttagttgtcttcagttcaacaatatttatgtcaaagaggcatactttgaggtgacacattctggtttccttcagttcaaagaccagattttgaaggaaagacatgactgataaagattattcagggatttgttcctctctctttagtacaaaatagctataaaatttatgctgttcacaaatgctgggggatttgaagagttgctgaattttgagccaaggacatgtgtatgtatataaacaatgacatgtatatattttttctttttataaacttgtaaatttcttgaaatccaaaataaattcatataaatttgtcctccaattgtgacttctaagaaatatttattaaatgaaagacatcctaacaatgacactaactcgtcctccagacatcattacagttggctccttgtcatcatttggcccccagtgcaaatgttcctcctcagcagtgctatagaaagcagctccaccttccctaggcaccctctacagtatcatctattcattatttaattgttttcacagtattaatcagaacctgaaattatcttattcaagtatttggttactgacatgaccactctccttcatcctggaagcattatgataactaagacctggtatgttttcttaccattctactcctagtcccttgaacagtgcctggtatataataggtaaatactaaatatttttcgaatgaaggaagggataaataaatgggttcagtagaatccatttcactcaacggaatccaactgaaaacatactctctagtcagcaaggtttttaacatgcagattagaagctctggggaggggttgattgtatctaggaggatgtacttaaatttcttctttgggcataggggcttctggcaaattttgtagcaaattagtatttctattggaatcctagtcagatatttctgagttttagacctaagtagttttcacatcaattatgaaagataaaattatttcaaaagatacttgaattcaaatctagtatatagagtgaatgcattttaaaagttaaaaaaataagaaattaggttatatttgaaagaatctcagctgaagatttttgtgcttttattacaaaggaagaggtaccactctcgccggttttacatcttgcattttaaaaagttaagtacagccagacacggtggctcacacctgtaatcccagcactttgggagaccaaggcggaaggatcctttgagcccaggagttcaagaccaggctgagcaacatggtgacaaaattaaaaaataaaaataaataaaaatgttaagtagtgatacgagaaaggagcaggaaagtgctgggttgagaaagatggggtccctggtgagagcttcactctcgagcctgtgcccacggacccaaatgaggacaggcatttctgattttgtgtccaaaaagttgccctttggcccacgacaccccccatcctgtgcccataaaaacccaggacccaacaggcacatacacaagtggctggacattgagaggagcagaagaagacacactggcagacatcagcaggccagtgataatggaacgacacagatgctgaggggaattcggccaggtccagtcgaagaagagtccagtgctgggcagcccgactccaggggaaggccacctttccactccatcccctttccagctccccatccatctcactgagagccacctccaccactcagtaaaacccagcacttgtcctccaagcccacatatgatccaatttttctgatacgctagagcaagaacccgggatatagaaagccctctgtccttgccataaggcagagggtctaatcgagctgattaatacaagcttctgcagacaacaaagctgaaagagtgcactgtaacacgtgcccactggggcttcgggagctgtaaacactcaaccctagacactgccatggggtcggagcccagaaatgctccccacaacctgcctgcctgcatgctccccgtaggggtttgggcagcagggcaagccatgcccctgtcacatgccctgagaggggggataagggaacttcttctgttttagtaggaagtactcgtctagctttcctaccagttaaaaataaaatcaaggtcttttggcttgtgtacaaaaaattcatcaggattgtagttattgtaatgcttattaataatctacaatggatcttcagttcaactcaaagtcatgatggacactgtttggcctccagctatgatctcagccttagtgttgaagaaagcccctgaaatacgggcagacagtgatattcagagccgcatgtaaagagcctttcggaaatcccctttgctctgccctgtttcattccacatccgtctgcaccttagccagcattgcatctattctaactaattggttcttaaaatgataaagcagaacaacagataacaataagaaagtcctggactgtgggcgcttctatttgtagagaatggaagactaactgagcctatcaatattttagtctcaagagcattacccctggacagtataatgctgctaacttgtctagagaagtatcattgtacgtgctaagtaataggaagaatatgtctagcatcaattataagttgcaattcacactgtgcagggtgctcttcaaagccgcaataccttcatccttacacaactgtaaatcatgattttatttcagaatagggtctctgcttttttactcactttgaaaagaatctgacacagtgtgaaagtgaacatttaataagtacttccttctacacctgcacacagggaatggatgataaatgctgttgtctgagtttatcatgataagacgaggcacaatggagagacaattaatgaatatcctttgattgatgataagacaagcagtacaaatatggatttttcttcttttgcagctcttctcaaatagctctaaacaaaagcaaaacatgctctggccacagaaaagacttacgacacaagattatttcttattgccattaatttcatcttaatagacattattagcttattacacagattatattatattatatttgcataaatttatcacatagcttattatgtgccacacaccatttacatgctatatacatgcaaatgtgtttagtcctcaaatccaccctaataataatgatggtgataatcataacatactattatgattcctatttctacagatgaagagaatgcacagagagaaagtatcttgtcaaagagcatggtgctagtaagtgtcagagtcaggatttgaacctaggtagcccagtacctgaatgtgtgtacttacactatttatcatttatttatatttatttattgtatttatttttattatttattatcatttatttatttttatttttattttattatttatttttattttttattatttatcattcatttaatatcatttagtgtaggaacaccaaatgatgtagtgaagtaattttctttaacatgctcaacacataaaggacttcacactataataaacccagagatattttaatgagctccataggaacatatctctaagttagtcatttaacttaaaatcccactgtacctagcttccactattagtaaatcaaagagtgttctatcaaaaaattccttttctccttacctccaaccctccttatttcatagaccttgcctaccacactttctaaatggagatgtagtcccagttgtatttctactgttcagagagcgaacaggcatccgtctccaactacaaactatacacttgtgctacgtgactgagaacagcatgtggatgcaagttcaccttggaattccaccacaatgaagctgtttgtgagccgctttctgcttaaagaacactttaagtttcctcagtaaacatcttttcataatgtgaaggtaatctcaaattttatttaatactaagtaggtcataaaaagttagagtttataagtttcatttgaccatttcttgttgaaaagattttggaaatgaggacataggtctttcttgaggcagaaagcattatggatataaagaaaaagataaagagcatagggtcagagagacctcagtttaaattttaaacacatctgagcctcagtttgcacatccttaaaatggggtaaatactacacctgacacacataaggtttatctgtaatgtgcaaattaacaatgtccttgccaacataatatttaaaagtctgctttgttcccaaccttgttagaatttccatttgggtcttctgcacattatttttcaataaaatgctgatttttcagtccttgaccctcttctcttaactcttggtagtaaaataaatctctactcagacaattactaaagttccatctccagcctggacctctcccatgaaatgtgactcatatattcaactgtctgcttcacttctcttcagaaatattataatataataatattattataatggtgtaatatataataagtatctcaaatgtaacttcttcaatactacacttttgacttggacactcaaccatagttcatgctgcagtctttcttatcacaatagatgacatctcttgcttcttagtacacagtcctaaagctctggagttgtccttgagacatttttctctgaaacttatatcttgacaacagcaaattctatctattctacatgtttaaaaatatttggctgcttcaaggtcagaaagatattctcctatttttttcttataaaaacatcactgtttaatctttcatttttagatctggaattatttttgtgtgtattgtgaggtagaagcaaaatacattttttgtattgatttccaactgacctacagccatttattgaaagggtcatcctttctcccactgccttttttgtcataaatctagattctctactcttttccgttggctttagccattggcatacatagttaagatttaattactatacctttataattggcatttatatctaaaaatgtaaatcttccagctaaattctgttttccttgactattcttgatcatttgcaatttcataggaattacaaaatgagcttgttaatttatgtaaacacacatgcatacacaccctgctaagatataggattgagattgtgtggaattccagatcagtttagagagaattgacaaaaatgggcacaagactgaaccagcacttaagaagagtatatccaaatgaccaataaatatatcaaaactttattcttcgtcagagaaattaaaattaaaatcatattaagattccactacatatttgccaaatgtctagaatgaaaaacacaggtaataccaaatgttggtaagaatgtagaacaactagaattctcaggcaaaactttggaaaagcatttggccgtgtctactagaaatgaccatatgtatctcctatttcttggcaatttcacatctaaaatatgtgcaacagaagtggatatttatgtccaccaaatatgtatgtatgtttgtgggtttgtgtatatacatatatatagaaaactgaatgagagtcaacaataggatggataaatacattgtgctatagtcatacaatgaaatccaatacagcaatgacaattaacaagctacatctatacaaagcagtgctgatgagtctaaaatcatagtaggcaaaataagttagacccaaataatacattttgtattatttaatttatatatatttcaaaagcaatcaaaacaaattcatggtgatagaagtcagcatagttgttccccctggggaaaagtgattcaaagagacacaggatgagccgggtgcggtggctcatgcctgtaatcccagcactttgggaggccaaggtgggtggatcacctgaggttaggagttcgagaccagcctggccaacatggtgaaaccctgtctctactaaaaatacaaaaaattagcctggtgactcatgtctgtaatcccagctactagggatgctgaggcaggagaattgcttgaacccagaaggtggaggttgcagtgagccaggatcacaccactgcactccagcttgggggatgagtgaaaatctgactcaaaaaaacaaaaaaacaaaacgaaacaaaaaaaacagagacacaggatggctctgagatgctggcaatgttctgtgtgttatctgcatgctagtcacagtgatggcggtggcagcccttctggagcagcctctgcgggacaccagctgcagtgggggaggtgtggccggggctgcgtgctacacagagtcagccaggttgggaacaagtgggagccccaccccttaccaagttggcaggttgggagcccagtgctctgggaacagctgcagccacccagccacggctctggactcggcatccctgcggtctcagtggcccaggaagccgcccccctcaaccaacagacttggaattgcctcctcctgttccctggtgtttccctgctcccattgcctccaattttggagcaaagttgtggcagagccaaagtgctttggcaacctggccatgtatgtgtacgctcagggcagcgctgacacaccagccccctgccacctcagccccctctggactttgggtgtcaacaagcatgggagggaggctgaggggacgctgagggtggctcagcatgggcctgcaggtgcccctcagcaggaacagccttagtgctgtggatggcatgttgatggtggcaggaggcaggctcctgggtggaaaggcgtgggtccccagtgaaacccaacctttaagccagggacagactgaagcctggggaccaagctgccagctccaggtggagtctatggccaggagtgagaacttatggtgctttttctgggccgcccatggccatccatggaccaatcagcacgcatttcctcccttctgagcccataaaaaccctggactcagccagactcaaacagacattgagactaccagctgcttcataaattagttaataaaagctagtgagttttgaatgccacattagtagaatgaacactttttttttcttcaattatcttaagctcaggggtgcatgtgcaggatatgcaggtttgtgacataggtaaacgtgcaccatggtggtttgctgcacaggtggtcccatcacctaggtatgatgcccagcattcattagcggttcttcctgatgctctttctcccactcccaacaggtcccagtgtgtgttgtgcccccaccctccatgtttccatgtgttctcagcacagaatgggcgtttgaaggaagactttgaagaagaaaatgggaatgatttccagtaagtattttttatcagtctttttatgactcatacaaatatttgtgggcctaaagtaaatgtaaacactaatcttaagaaatatttgtcctttttgagttttaatgtgtctttatgtttgcatttatccaattaatatcagaacaaaaatatataataagtactagagacaatttaaagaaattaaactgtttccagaaggtagctaaataaatcattacttgtatttagaggcagaaaatagagaagtaaaatttaatgctaactttagttgatgtactgtgtcatataatatattgcaatttttagctaatttaaattaaaatagttatatcaatgattttgaaaccatgaagcaacaattatcataaatgttgttttttcaaaaattagatggttccagtagtttttgctacgtgaaatctctgactactacatcatctaaggcactttttacgtttcgtttataaagctcataaaataacctaaatgaaaaagataaatagtaaaaagcctgaagagctgatggagctatgtttcttgatttattcatctctattccatatctgaaaaaataatttatgacaatttctttgtatggaagaaaaattttataatgtttagatctattgggggaagaatgatttcctaggatttgaagctataagaataatggaaaaaaagatatatcattcttctatcttttatcatgtgtaaagtcgatttttaatatggcaagatattcaatctaaagccattaaagatatttccaaaaccttacaccagcttcagatatgttacctattatacaatgactttatttttaaaaagtaaggaaatattcatccttttactagtagtagatgattggacagctgtcttcattggtaatttaaatgtaattttgcctgaagtagatagaaaaactaatcacctcttggggtcttttacagtgatataattttatgccaactttcaacactagaaaagtaagcatattctttatgaaataaccagaatttatagctgaaaggaattttagaaatctagttcaggggtcagcaaactactgcccattgcctgtttttgtaaataagattttattgtaacagccattctcatgtttattcactcatttgttgaaatgttgtctatggctgccttggtcctacgatggcactgtggaccagttgcaaatgagaccatatggtctacaaagtaaaaatattccctagaacttgaagtataataaaaaaaaaaattatctagccctttacagaaagacctgttaatctctaatctagttcatccacctcttttacagatgaagaagttgaacccctgaggaataaagtaacttgcccatggttacatagacagtaaaagttagccgaagacacaggtcttttgctttcagattcagtaaaggtctcattacattatcccactactcataatgtaaaataatgtgtttgatattttctagtattcatgttatgatgaaataatcccttggtaagtaaaattttccatacaggcagtcagtctgcctctgttagccttattcttttcccttgaaattcagaggaaaattttaaaggtaagaaactgaaacacatattttggtccttatattgtcagtgtttctacataaggaaaacaatgtgactaaaacagatgacatctattattggatttccactcaataaaatgtttattttctctaatcaactccactttttttttctgcccattagtgttatccaagtaatacatcacgtaaggacaccattaagtagaatgcctgtctgtatctacagaaaatgagcagatggttggttcctcaaacatttaaaataaagacaaatgtagtcttgggtttaggggtgagacagtggcaggcaggacacttgggatgaaatgtataatgacgttgtactccacactccctgcatgtttacaatgtactatagatgtgaaagttaatgcaccataaaaaattgttataaaattttattttattttaagagcatgagttgggtctggtcactttcttgattgtgttaatggttttatgtgtttattcacatgacaaaatttaccagattttgtactttaaatacctgcagtttcttaggtgtcaatgacatctttaattgaaaaaaaggagtaacagaaaacaaaaacaatgagataaatgttttttttcttttttagcaagaaaagaaaatataagctagtcatttcagatacatgtatgtattgacatcaggtttgtttgtgacaaatcttcactctgtgacgaaaaagtacacattttcctgttggaccaaatctttgtttattcttgtagcttaactcaacataaagaacatgatttttatttcatatttttgtggtgataaatattttcatgcaaatgctttatatcagatggaagaacaaattactaaaacaaatacagttcatatccagtattatgtattcaccagaaactgttatattaatgattctagtttaatgcagagaaaatttcagttctgaagagtacttacgaagacacattttgtgcattaatgcaaaactgtagaaacatgaaaagtacagtgcaataaagaataacaagataacatgggtctagagtacatttttccaagtttgaagttaaataaaattatttctttcaagaacctaacttctactttaattaagataggaaagaagtcagacttacaattgtttgtttttgtattagcccaataaaaatcctagaaatgatgttctttatgtttctaaaataaggaagagtatcctggggaagaaaataacacttctttagttaagttgtatgttgtgtgcctagtgaaaatacccacgctttgttggtaatatcccaatttgccatcttctttccatatttgctctcaggggattagtgttgacttctaaggagttaaagctgctcttagaatcatcttttctaacccactgtagctgtctggaaaacagtaagatcccaagggattttacaaaatgtaattcttcaacatgcacaataaatgaaaagaataatttatatttcatacaactctaattatcatatggtaaaaggaaaaagaaaggtcatatccttgaagttacaaattatgtatacgacccatctgaagccatcactttcatacaaggtaggtttatggctcattaactctgttctgtgtaacatgagttatatgatcttactgtttatgcattttaaactatggatatattgattattatatatttctaaataactagtgtgtaaaattatgacaggaatgattggatgtatcttgggataaatatattaactagaattagtttcttctcaactattggaagaactaaaacaaaattcttaaacagaagtgattcaaatgatattgttattctaaaaatcaaaaaatcttttaaatattcaacaattacagcaagtgggacacaatatgtgttccatttttttcttgttttctgttttaaaatctgaaataacattttatgtatacctccaagagcccaggctgcagtgcagtggcaggatcttggctcactgcaacctccaccgcctaggttcaagcaattctcctgcctcagcctcacaaatagctgggattacaggtgcacgccaccatgcccagctaatttttgcatttttagtagaaacaggtttcaccatgttggccaggctgctctcagactcctgacctcaggtgattggcttgcctcgacctcccaaagtgctagcattacaggcgtgagccaacacgtctggcccaagaagaaattttaaagccttctcatgacagctattcgcctagaatttgacatgataaaacttttttattttaaaaaagagaaaatagaataattctccactcttgacttgtacatttgaatcaacattaagttgtcgtgggattatctttaaacaaaggtgatgggttttgtcatggggctgaggagtttcatttgctttattttattataaaatgaatagtataatattctaaactctacagaagattatacagtgaaaagttcaagtttccctctgcccttctctacccaatctttccctcctgaagtaaccacagttaacaactttttgtgtactgcttaggttattttctttctttcttttttttttttttttttttgaggtggggagagggacaggatctggctctgtcacccaggctggagcgcagtggcgcattcactgcaaccttcgcctccttggctctagcgatcctctcacctcagccttctgagtatttgggactacaggtgcgcaccaccacacctagctaatttttttgtatttttggtagagatgggatcttgctatgttgcctagcctggtctcaaactcctggggtctggccatccaccagcctccacctcccaggcaatccactcacctgagcctcccaaagtgatgggattacaggtgtgagccactgcacagagcagtgttcgggttattttctatgcgtatacatataggttttatagtgccaaggcttgtagagaataggtgacagccagtgatcaaagtggaatattttagaagaatagaaagcagtattcaattcaataaaacacttttattggacacctgctgtgtgcaaaaccacaataataaatttcacagaaggcataggaaagcactaggatgaagaagtcaccgtagttctgtcttcaattggtatgtgtttctgaaatgtgcaaacaccattactgcaaaaaaactcaagaatgttacgcagcattaaagactgtttgggagaaaaaaaacacagcaggattgactctactttgatgaatttttaatctcatcatatagtcatggaagactgacactgaatagcatatttgcagaagggaaatatcctagcatggtccaagtttaaactacatgaggttaagaaaatagctgggtaacattttggattttatccaacagacaaagtagtgacattaatggttattttaaaatagtctatcaatatcagatgtattttttttaatatatatccagttgaaaggagaatggatcagagatggaaaagaataagatgagcaaaacaggcacttagtgtgatcctccaggcaaggacccaacttaataggagccatagtaagactgaactcagagacatttcagcaaaggtgggactggcatggatgtggggtatgaacacttgaatttggggtatagaacagacaacttgggaagctacaggatttcttgtgtgagtgattgtgtagatgttgaagttgttagttaagaaagagaatatagaagaagtagctggtgcagagtgggaagaataataaacttggctttgcaaacactacatttggattgtctatgaggcctttccataaatcctcccagaagcaatgtgtgggacatttaagttcattgactgtgtggaacttggagccatacagttaaagattatttgctagagttagtatcactccacaagatttttatttttttatgtcaacctttattttggattcagggagtacatgtgcaggtttatggcatgggtgtgcctgggtgttcataggtggcaggcttggtgtacaaatgaccccatcacccaggtactgagcatagtacccaatatgtagttcttcaggctttgtcccccttcctccctctcccttcaaatagttcctagtgtctattgttgccatctctatatccttgagtacccaatgtttagctcccacttaaaagcaagaacatgtggtatttggttttctgttcctgcatgaattcacttaggataatggcctccagctgcatccatgttgctgcaaaagacatgattgcattcttttctgtgtctgcatagtattccatggtatatgcataccacattgtctttatctagtccaccactgatgggcacgtagcttgattccatgtctttgctattgcgaatagtgctgtgatgaacatgcaagggcatgtgtctttttggtagaacaatttgttttcttttggatatatacccagtaacggagttgctgggtcagatggtaggtctcttttaaattctttgagaaatctccaaactggtttctaagaggtaaacacatccacctagctgaaaatgctaaagtgggtggtaaaaagaggtggacacagaaggagagcacttcatcatggaagagaaatagcaccttgatctcaaacaggcacctcatcctcctgctggctcacagggctcagcaccactcccgctctggcattggtccaaagactcctttcgttactgtgctcctgggctgtagtgacgggtctgtctggcccactctttgttatcagcagccattcctccactcacattctcatcttactagattttagttagtttctctttcaccctcttgtccccaagagttagaatttattttgagtttaaagagtttttactactaaatacttcatgaaaaaggaaaagattttaaaaaatagaaacaataagaaagtgataagaattaaataaactcttaaatgtttttaccttagtattcatgttcatctttgaaatgtgaggaaaacacaatgagtggttcttagctatcttcattgcctcaagtcttgtattttccttctttgcatcaaaacttttaaaactttaatgattttttttatcccacaggctcttcccctgagtctttaccaaatcttctaaccatattctttcccagccattacactgggaagccctcaaatcaatctgaatgttgaacagcaactgcatgcacctgtaagactcatttataattcagagattatcacatgattatcacatgatcagtgtttttgctgcttaatggaggaaaatgctccgtgttattcttttttttttttttctgttgagacagagtctcgctctgtcgcccaggctggagtgcagtggtgccatctcggctcactgcaagctcggctcccaggttcacatcattctcctgcctcaacctcctgagtagctgggactacaggcgccgccaccacgcctgctaatttttttttgtattttttagtagaggcagggtttcagcagggtcttgatctcctgacctcgtgatccgcccgcctcggcctcccaaagtgctgggattacaggcgtgagccaccgcgcccggcctgttctgtgttattcttaacataattaaggacacaaagtggaatataagatatttttgtcttctccatgttttatttcagtttcaacaacaataaacatttactgactgcttcctggccagaacactggaaaataaaagaaagtgttacgtgtgtttttggttctcaaaaggcttactaaaggatagttatgtaaacactggaagagaacagataacctcagaagagagaattccctacataaccagttagcatatcctaaacaagatatcacacaattatgctattaaaagggatattttatatacgtactatataaaaatatgttttatatatttttatatattatatataatgcatatttatataaaataaacattattgaataattatttttatatttgggaggaaggtcaatttaaatccataccacattataacccaaaataattctatttaaaaatattttaaagactatttttccccaaatctcaaaggttctctttcttaggttctctttctttctttcttttttcaaaaaaattttaaggaaaaagccatgtacaagattttctttcttaaactgctaaaagcatcaatagatttgaggataatggcacacaagaatgttatgtttaaaaatcatccaagttagaaacataaacatgcattagttaaatgataaaaggatatgaacttgcagttgaaacaagaggtagtgaagttttaactaaatgttggctttaaaatgtggtaaaggaaccggtggagggagatggctgaaaagaagaccctactgaccatctccccagcaggaacaccaacctcaacatctacacaagaaaagcaccttcatagagcttaaaatcaggtgagcactcacagtgtctggtttaaacttctaatcgctgaaagaggcagcgaagcaggtaggaaagggtcttgaatcaccgaggccacccttcccccatcctccagcagcagctgcagggcatggagaatctacgcacttggggaaaggagagcgcagtgtcggtgagacatcacatgaacttagcgcttccctgtcaccgtggaaagcaaaaccaggctgaactcagctgacacctacccacagagggagcctttagactagcctgagccagaggggagttgcctgtcccagcagtcagaacttgagtctggcaagccttgccaccatgggctaaagggggagctccaaataaacttgaaaggcaatctaggccgcgaggcctgtgattcccggacaggtccttggacaggtcctagtgctaagctgggttcgaagccagtggacttaaaaggcatacaacctactaagacaccagccagggtggctaagggagtgcttgcgccattcccccaaccccaggcagcacagcttacagctctgaaagagatcctttcattccccttgcagagaggagagggtaaagaggactttgtcttgcatcttggataacagctcggccacagtaagatggacaggtacccaccagtcagggttgtgaggcctcctttctgggccctagctcctggaccacatttctagacacaccctgggacagaggggacccctctaccttgtagggaagaaccccattgtggcaggaaccattgcctgatgactaaagagcccttaggccatgcataaccagcagtgacacccaggtattattctgtgggccttgggtgagattctgagacttactggctccagatgagacccagcacattcccagcaggggtggctatggagctatggctccttctgcttgagaaaccagagagaaaactaaaggggactatatcttgcaccttaggtaccagcctggctacagaggggtagaataccaagtgagctcttgaggtcttcaattccagagcttggctcttgaatggcatttctggacctgccccgacccagaggggagcccactgctccgaagagtgagtgccaggcctgacagtgttcaccgcaagctgactgaagagccgtttggccttaagggaatatcagtagtagcccagaggtactcccatgggcctgtggtggtggcagccaccaggcgagtctcctctacctgtgctaaggggaaggaagagcgaggagggctacatctcatggtttaagggccaactcagctgaagtgtaatataacactaggtagatttctaaggtttttgactccagtccctggctcctggaaagcaccttttgaccctcctggggcctgggggcactcagtgtcctgaagcctggctggctttgccatctgcttatcacagagctctagggccttgagcaaacctaggtggtagccagatagtggttataggaagccttgggtgatacccagcactgtgctggtttcaggtctgactcagcagtctcagtggtggtggccacaggggtgctcgtgtcactccaccccccggtccaggcagctcactacagagagagagagaggctccatttgtttgtgagaaagtaaggaaagatagtgagattctctgcctgacaatccacagaattcttcttgaccttatccaagaccaacaagtcagctcagtcttactgagcttgggtgccctctaatgcagatacagcttagaccacaacatccaagtcttttcaaatacctgaaaagcgtttccaagaaggttgggtacaaataagcccagactgcaaagactacaataaatacctaactcttcaatgcccagacaccaacaaacattcaaaagcatcaagatcatccacagaaatatgaccttaccacattagctaaataagacaccagggaccaatcctgaagaaatacagatatctgacctttccaaaagacaattcaaaatggctgttttaaagaaactcaaagaaattcaagctaacacagagaaggaatttagaattgtatcagatagatttaacaaagagattgaaataattatatagaatcaagcagaaattctggagctgaacagtgcatctgacatactgaagaatgcataagagtgttttaatagcagaactgatcaacctgaagaaagaattagtgagcttgaagacaggttatttgaaaatacatggtaagaggagacaaaagaaaaatgaataaaagataatgaagcatgcctataggatctagaaaatatcctcaaaagggcaaatctaagggttattggccttaaggaggagggagaggtaggggtagaaagtttattgaaagggataataacacagaacttcccaaacctggagaaagatattaatatccaagtacaagaaggttatagaagacaaagcagatttaaccaaaagaagacaacctcaaggtatttaataatcaaactttaaaggtcaaggataaagaaaggattttaaaagcatcaagagaaaagaaacaaataatatacaatggagtttcaataagtctggcagcagacttttgaatagaaactttacaggccaggagagagtggcattacatatttaaagtgctaaaggaagaaaacttttatcctagaatagtatatctggtgaaaatatccttcagacatgaaggggaaataaagactttccactcaaacaaaagctgagggatttcatcaacaccagacttgtcctacaagaaatgctaaaggagtacttcatcagaaagaaaaggaaactaatgagcgataagaaatcatctgaaggtttagaactcactggtggtagtacacagagaaattgagaatattataacactgtaactgtgatgtgtaaattactcttatcctaaggagaaagactaaacaatcaaccaataaaaaataataactatgacaacttttcaatatatactaaacagtatatactatactatactatactatactatagtatagtatagtttcaatactatactaaacagtatagtaagatgtaaagagaaacaataaaaagtaaaaagcaaggggacaaagttaaggtgtagaatttatattagttttctctttgtttctttatttatgcaaacagtgctaagctgttttcagcttaaaataatgggttataagatagtatctgcaagtctcatggtaaccgcaaattgaaaaacataaaacaaatacacaaaaaatagaaatcaagaaattaaatcataccgccagagaaaatcaccttcactgaaaggaagacagcaaggaaataaaaaagaaagaagaccagaaataaccagaaagcaaataacaaaatggcaggataagtccttacttaggattaataacattgaatgtaaatagactaaactctccaattaaaagacacagagcctctgaatggatgaaaaagcaagactcaaccatctgttgcctaccaaacaacacgcttaacctataaagacacacatagatggccaggcatggtagctcatgcctgtaatcccagcactttgggaggccgaggcgggtggatcacctgaggtcaggagttcgagaccagcctggccaacatggtgaaaccctgtctccactaaaaatacaagaaaattagctgggcgtggtggtgggcacctattatcccagctacttgggaggctgaggcaagagaatcgcttgaactgggaggtggaggttgcagtgagctgagattgcaccactgccctccagcctgggtgacaagagtgacaccccatctcaaaagaaaaccaaaatgcaacaacaataacaacaacaaccaaaaacacacatagactgaaaatagatggatagaaaaagatattccatgtcaatggaaaccgaaaaagaggagtagttattctttttttttttttttttttttttgagatggagtctctctctgtcacccaggctggagtgcagtggtgcgatctcggctcactgcaagctctgcctcctgggttcatgccattctcctacctcagcctcccaagtagctgggactacaggcgcccgccaccacacgtggccaattttttgtatttttagtagagatgaggtttcaccatgttagccaggatggtctcaatctcctgaccttgtgatccacccacctcagcctcccaaagtgctgggattaaaggcatgagccaccgtgcccagccaaagaggagtagctcctcttagacaaaatagacttcaagacaaaacccgtaagaacagacaaagaaggtcattatataatgataacagagtctattcagcaagaagatataataattgtaaatacatatgcatcaaacagtggagcactcagttatataaagcaaatattattagagctaaagagagagtcagacttcagcacagtaatagctagagccttcaacaccctactttcagcaccgaacaaatctgccagagagaaaatcaacaaagaaacataggacgtaatctgcactatcaaataaatggacctagtagatatttacagaacatttcacccaatggctacagaatacatattcttttctttagcacatggatttttcttaaggatagaccatatgttaagtcacaaaacaagtcttaaaattttcagaaacattgaaataatatcaagcatcttctctgactccagtggaataaaattagaaattaataatgaggggaattttggaaattatataaacacatggaaattaaacaatatgctcccaaatgaccagttggaaaatgaagaaattaagaagaaaactgaaaaatgtcttgaaacaagtaataatggaaacacaatgtgccaaacctatggaatacagtgaaagtggtactaagagggaagtttatagccataagtgcctgcatgaaaaaagaagaaaaagttcaaataaacaacctaatgatgcatcttaaataactgtaaaaacaagagaaagtaatctgaaaattagtagaatttaaaaatgaagatcagagcagaaataaatgaagttgaaataaaacaattaagaagatcaataaaataaaaagttgcttttttaaaaagataaacaaaattggcaaagctttagccacactaagaaaaaggagaaggcccaaataaataaaatgagatgaaaaaggaaacttttaactgatactgcagaaatggaaaggatcaccagtggctactatgagcaactatataccaactaattggaaaatctaaatgaaattgacaaattcctagacagatgcaatctacaagattgaatcagaaagaaatctaaaacctgaacaaaacaataacaagtaataaaatcaaagtcataatagaaagtctccaagcaaagaaaagcccaggacctgattacctcactgctgaattctaccaaacatttaagtaactaataccaatcttactcaaaatattttgaaaaatagaggaggagggaatacttctaaactcattctatgaggccaaattgccctgatactaaaaccagacaaagacaccacaaaaaaagaaaactataaaccaatatcactgataaatattgaagcaaaaatcctcagcaaaatactagcaaactgaattcaacaacacattaagaagatcattcatcacgacctagtgggatttatcccagggatgcaagggtggtccaacataaggaaatcaatcaatgtgatacatcatatcaacagaatgaaggacaaaaagcatgggatcattttcattgatgctgaaaaagcatttgacaaaattcaacattccttcatgataaaaatttccagaaaactgggtatagaaggagcatacttctacataacaaaagccatgtatgacagacccacagctagtattatattgaatgggacaaaactgaaagcctttcctttaagatctggaacatgacagggatgcctactgttaccactgttattcaacatagtactggaagctctagctacataatcagacaagagaaaaagggcattcagattggaaaggaagaagtccaattatccttatttgcaaatgatatgatcttatatttgcagaaaactaaagactccattaaaaaacctattagaactaataaacaaactcagtaaagttgcaggatacacaatcaacatacaaaagccagtagcactttatatagaagcaaacaatctgaaaaagaaatcaagaaggtaatcccatttaaaatacctacaaataaaataaaatacttaggaattaatttaaccaaagcagtgaaagatctctacaatgaaaactataaaacattgatgcaagaaattaaagagaacacacaagaaatggaaagatgttccatgtttatgaattggaaaaatcaatactgttaaaatgtccatactacccaaagcaatctacagatttaatgcaatctctatcaaaataccattgacattcttcagagaaatggaaaaaaaaaatcctaaaatttatatggaacaacaaaagacccagaacagctaaagttatcctaagcaaaaagaacacaactggagaaatcacattacctgacttcaaattatattgcagagctatagtaaccaaaatagcatggcaccggcataaaagtcaacatacaaaccggtggaacagaatagagaacacagaaagaaacccacatatctacagtgaactcttttttgccatttcccaagaacatacactgggggaaaggacagtgtcttcaataaatggtgctgggaaaattagacatccacatacaaaagaatgagactagaaccctatctctcaccatatacaaacatcaaatcaaaatggattaaaaacttaaatctaaaacctcaaaccataaaactactaagagaaaacattggagaaactctccaggaccttgaacggggcaaatatttcttcagtaatattccataagcacaggcaaccaaagcaaaaatgggcaaatgggatcacatcaagttaaaatgcctctgtacagtaaaggaaacaatcaataaagtgaagagacaatccatagaatggaagaaggtgtttgcaaattactcatctgacaagggattaatagctagaatatataaaaagctaaaacaactctataggaaaacgtctaacactctgattaaaaatggggaaaagatttgaatagacattttaagacatacaaatggcaaacaggtatatggaaaggtgctcaacatattgatcatcagagaaatgcaaatcaaaactacaatgagatattatctaatctcagttaaaatggcttttatccaaaagacaggcaataacaaatgctagtgagaatgcagagaagagggaatcctcatacactgttggtgggaatgtaaattagtagaaccactatggaaaacagttttgaggatcataaaaaaactaaaaatagagctaccatatggtccaccaattccacacctaggtatatacccaaaagaaagaaaatcagtatatcaaagagatacctgcactcccacatttattgcagcactgttcacaatagccaagatttggaagcaacctaagtgtccgtcgatagatgagtggataaagaaaatgtggtacatgtatacaatggaatactactcagccgtaaagaagaatgagatctagtcatttgacaacatgagtggaaatggaggtcattatgttaagtgaaataccctaggcatagaaagacaaacatattctcacttatttgtgggagctaaaaattaaacgattaaattcatggagattgagagtagaaggatggttacagaggctgggaagggtagtgggggcggtggggaggaagtgaggatggtcagtgtgtccaaagaagaagttagaaggatgaataagacctagtatttgctagcaatatagggtgactatagtaaaaaataatttaattgtacatttaaaaatagttgagtataattggattgttcctaacacaaaagataaatgcttctcgtgatggatacaccatttaccctgctgtgattattactgattgcatggttgtatcaaaatatctcatgtaacccataaatatatacacttactatataacaacaaaaattaaaaataaaaacatttttaaaatgtgatacagtgtggaaactaaataaatatgaaaaattttagatggtaaaaccgcagtaaagtaggattgctttcacatattgttggtggcagcctaaatttttataaccattttagaaagcaatttggcaatataaggtaaaagtctctatattctttaaatcagtaaatgtagtgcagaacaagctaaaatatattctcaggaaataaattgtaaattatgattaactcaatatagcatccattaaaattataattttacgattctagaaatagtgtaaagttataagtggaaaatcatggatattaaattacatatacaaggtcattgctactaggtaaaattggtttgttcatttgaaatatgatatataaaatgtacaaaaatgttagcagtattttgaaagagtgattatacctgagtatttttgcaattattcaaattttgttattggttatatgtggtttttatgattttttttaaagaaaagtgctcctggttccagctaaatggacctggggtcattggttttctttcccctttgccttttcacttgataactctcaggttttctaacttgtctttttattttctccaggattaatttatctaaaatatgttgttaccaaggacagtgcattattaagttattgctgcaataatactgctgatcaaatcactctgatctcagtggtcgacactgaagaacattaatttttggagtgggggctccaagttctgcagaccaattagggcaactctaattgaggatgcaggttgccagggcttgactctggggtctaggctgcagggctgacccattcgtctcatttgggggctaaagctccatggaggtagctactgaggcatgctcttctcatatacctttgctgaatttctattggttggatgaagttatgggactaaagccaacatcaatgggaaggagaaatatatctcacccactctgtgattccacaaagtcacatggcagagggaaggagcaaagaattaacaataatacggtctaccataagtaggttaactgtcatctgtatatttcacaatctccatctataagtaaaagatgtttggttatataatctcatcagcgagttatttaacctaagcctcaatttcctccttaagtatggatgatgatagtatctgtttatggaatgcaatgggattaaattagataatgcttgcaaaacactcaacataatgttcaacatgctatctgttattaatcttcaagtctcatgcagctgtgtgagacatctatgatatttcacggtctacaataaactctagtataaatagagacacagggaaaagacaagaaaaatctctctccactttacttcacattctctatggggcctccaaaggctaatggagattcatttcaggtctctatgtcatctggatcaccccttgagggcttatgtataaacactgaggccaggtcatccttggttttcaggactctgcactattagagatggttttaagatgacttgagtaacaagtttgctctgtgcaagaactgagaatctaattcaagttaaggaagatttacaatctttacttaggttccaagtaaatctaactacctctaagaagttgcagtcgccaaagggattcagaatagtctctgagagttaagtacctctgggccacccagatctcgtgccctgggaagcaggataccctggcccatcaaactgacaaagtactcggccatgggatggtcacacctttgttatgttcagatttttttcttgtctattcaccttatattacctaaagatagcatagtcatcaacatataagccctataaagattaatattagacaaaattaaaattatcattaatgtaaaatttctaaaacattatcaatatattattttaatgcttgcccttcattttagcagaagtattgaggtaatttttctattctgcttacctttttgtggaaatgctgtgaagatacattgataaaaatattaagtattttattatgtgatgtcatgtgttattttgctttaaggagaccagtctcaacttctgatttcccataaaattattatgggaaatgtattaggtagcactgcttcttatatgtatggcatttattagaaactggtagcataaatcttaagaataaggaaaaaagagagaattaaaaagacagagagaaagaaagagagagaggaaagaaggaaggaaaagaaaagatgagggaaaggcaggaaataacttgccaaaaggaagcatgtttgaaactaatatagcaaggacattagactatgcgttattttgaatttagttatcaccttttctagttttctttatatttttatatgttcaatattaaacatccaccaaattccatttacctgcattatcaaagaattaaaaaagcatactttatcatgcacctagctctccttttgttcagttgaaactctggattaaactcattgaagagtctttgaaaatatgaaataatctgtttatttataacctttaattaaggaaatatccattaccatgtttccagttgacaagaataatgtcttggtcatttcgtgatttattattttttaagtacttttcagataacttgttcagaatagggtagaaaaagtcatgtatttgaatcatgtgtctcactctgcgattcaggtacaggcctaaaactcccggggctttcatcaacatcgcatttcacaggatgccacactaagccacatgcacagacacgctccatttgcttcttccattccagtgacatggtgcagttctcctgccttctgttaggctgggttctccgtggagtgctggcctgagtgaataccggaaagaagctactccctgaaaaacgcctttgtctccttcagggattccttctcgttacttggggtggcccccttgcatcttccctggaaagatcctgccggtcaggagccaggccttggtctgttgccgaccattctccttccctcttatctcaattctgataggcctttttctgttacccacatctttaccttctctccagccttcaatattgtatacctctctgagttctctcctagtgtattaaaaacactgagcttccctcacatgcacaaaacaaacaaaaaccctatttgctatcaggagcagcgattcctcattacaagaaatgtctgagttccacgaggcgtgatcttcttctgaatcttctggcctcgctcatgcaatcacctgcctcctctaaaaacctccttgcctttaaaactatgcatccccacacaagtttccaaagaacctttcttaaattcaaagtatttttctccttgttttataaaacgtcctcccaggttatgtgactttaacatcattaactaacttccctgtgccttgctaggtttcctcacataaagataaataataccttcctcataaagtaacagtgaggattaaataataatgtgtgaaaggtgctcagtacgactccagattctacggaaaagatcaaggaaagatggctattgttggcttttattgttaatacctcacagcccataggcttcaaaaccaatgctatcttatttgatattttaattatttgctgtttttggttatcttcttatttgattttttaattatttgctgtttttggtcatcttctttggtcatctttggactctcccaaaggtgacagtcctcccacgtgccagtgctcaagtcctactccaaaataagttggctttctctgaggcttaacacttcccagtccagagatataattcagcaaactactcaaacttgaaaataactttaaaatcccaccctaattcaagctgccaccatttctcatctggtgtcccaaagcttcctgactcatctccacatgtcacgctgctgcagcacatccaaacccactcctacacactgtgctgctggagaccgtcactgtgcatggaaaggtccaaatcccaactccctaacttcaccttcctgatttcacatgtcctgtcctctgcttacctccccactgtcccttcagccactcttcctttgtctttatcttctcttacctcacagtttctctcatctcctcccaattaccttttgccctttttaatcttcttttttaggaaaattcatacaatacaatgtaaactctaccaggatgtttttcctctcaaacttccctcctcccttcctgcttcctcagcctacctgaccgtaggtaacattcaaagtgcagctcaatggccaggcacggtcgctcatgcctgtaatcccagccctttgggaagcttaggctggtggatcacctgaggtcaggagttcaagaccagcctggccactatggagaaaccctgtctctactaaaaatacaaaaaaaaaaaaaaaaagctggatatggtggtggatgcacgtaatctcagctactcaggaggctgaggcaggagaatcgcttgaacccaggaggtagaggttgcagtgagccaagatcacgccattgcactccagcctgggtgacaagagtgagactccttctcaaaaaaaaaaaaaaaaggaaaaagtgcacctcaaggattgcttccttacaaaagacttcccttaaccctccaactaaatcagaagcctctgtaacatcctctcatccgtctagagatcatttctttcatgacccttctccagactttaccttttgtttatttatttgtttgattcttgcatatgctcgcttgtccttgctagaacatatatgttcagtgagggaaggatcctttctgccttgtttattgctgtatctcagaatctagaagaatggggcatagaatagtaaagtttctatttaaaaaagagcaagaattgcacgtcctttaaaatattttcaataaatatttttaaaaagtcatttaatgaatttcattgaattgtgttcatgggacaattaaattgtctccctcacttgacagtaattccaaaggcttatggaaaccttctgctggtcgactgttgcaggtggagcctacacagtgcacggcgcgacggttggggctcctttaatattagatcaatcaacatgcatctttagggtgcccccactgtgcctgcgtgagaacgtgaaacgttactgcttcctcagccttctttcttccacacctctgagtggcaccctgaggaggaagtgctcatgacttccgtagtgaaggctgttctctctgaagatgtcactggggaaattttatcctttctaaatttagaaagtgggggagagaaatgcagctaaatggttcagattcagagggagatagtgagaaccctgaaaatgaatcatggtacttttcacacacatagtgaatcaaaatttaatggcagtgaaaggctgttgataacattcctttaaaaaatccacataaccaaagacatttacttgcagaaaacttcctggacttctaagtagaatactaggcaggtctgtatttttaaatttagaaaccagtcacagattttttttctctaaacttcattaagagctgtgctctgtatcagctggtaagcctctaatcctacaaaggttgcttatcaggtttggggaaaaaatattttaaagggaatacaattcttgctctttcttaaatagaaattttactattctatattacattgtcgtataacatgtcatttggtgcccctggaatctcctgtaaaatagaagcgtacgctagtaaatgtcatgatgaaatgaaaccagggattatgaaagttgtgaagctttcattaaatataaaatcttatattcggtaccttagaatcagtgactctaatacgttatttttaaaatttattgtcaatattagccgtgtccccaaattaagaaactgcactgagcgtttacggcattgacttaagagaaatacagtcaacgtattttaaatatattaccatctgtacccaaatataaaatgatctttaaatgtaaggtagttccccattttatcacaaactgttttgatcaacttgaaatagaagcccttaaatgaaagtgtcaaatgtcaatttacaatattaatcatttcagttacccagacatttaaaattacatattctggtacagcactgtttagggaactttctgtgatgacagaaatgttccacatttactctaatacgggagccaccggtcacatacggctagtgggcatgtgtgcccacttgaaacacggctagtacaaccgaggaactgaatttgtaaattaatttaatcttaactaatttaagtttaaattggttggtgtggctagtggctactgaaccagataacacagctctagaaaactaaagatttttttagaaatgttgctattttctactctcattcaaactccacacgcttcattgacaacactattgtcatcatcataacaatgatgttagatatgttatttaatttttcacagcacataatttttacttctaagttgattgaaaatacaaaaaaaattagaaaaatgttatgtgaaaaggaatatagaataagaaaaatgtgccctgatactcatggggccagattagcccttgtgtaaaaagagtttgaggagaggaggcacaaatcaagagatccgggccctgttctctttgaagaagattctacttagatgttcgggtttagcactttgttcttctaagttctcagaaaccaaagaatttgtgtagaaatggtaattttacctgatgtattacccaagaggcctcttaaggacaagggtagccctcttttatgaaggcaatttttgagaaaaaaagccattgctttatatatggtacatatggtaagtaagaacaattgaagaagaactgaacaccacttatttaaaaattgtgtactttatttacaaccacatgaaatattttccaatcaccaagccatctttagaagttttccttccttaatcatcaaaatgtcagtacaagaagtttggatttagttgtgagtgactgggtgctgtaaagtccaccaagtagtggcatcatagagcaccaggtggctccctaaacagtgagacctgggcacaggtgtcaatccccagagattctgtcatctaagtcatgaggtcatctaagtcatgagcatccacatggaacatacagctatgcagttactggcaaataaaacaaaataccgactgtgtctcctacagtgagatcaaagaaccactctccacttactctgcaaacttgccttggtaccatctccttccgagattcaataattgatgtttaatatgtgctatttagttctgctttattattaagaattccttgaatgagatgaatgaaaagaatattaatctacttcaatctagaaaaaaaaatcctcatatccataaaatgaaattaatgatttccagaagcaaataatttctgtgatgatgttctcagaagaattaaggtgctatctggtgccctgcttggatcgttagcctaatgggactgatcaatcagaaggataatggctagatggatatttttgttgttttatttttaatgaataagagatacttatattcattaaaattagaaaaaagataatgaatcacctcaaattacagaatttccatatttcccaaaaaactgacagtgtgtctgccaataatagccacatacaatatttatgcaagcctggctttctgtaatgagaaattcaacaattgccatggtgatatcttgggaggcaaggaggaaatactggtgataacgggagtcttgagtggtgatggcgggcagcatcataccatcccccttgggcctgggatgctgccaaggtctgcagcgtgatgtttgtcctcctccatcgtcatccaaacaaacaggaaacttgctctacagaaagtaattcttgctgtttttctttatacatttctcaaaatatcttttaaatactttgttacagtaggtagtcaggcctacatgagcagggcaagagagcccttccatcccaacagaaatgtcaggttaccattagatgatggtcaggcagttgttaaactgtctctctaaaaaaataattggttacagccagtgccgtggaaaggcagtctcccagcagatagaaacacctgaaactggtgatcagcttcccagtaaggtctcaggagttgcgcaagtgggctcaagcatgcgcattaagaggcaaaatggcggagtttaactggtagatgaccttgcacggacatttgactggtacgggaagaacgcttcaaatgagcatacatacagctccggtaaacacactgcacgtgtggcacctccaagagcgggcaggcaactgcacaggcagacagcccaccccaagggcagaatcagggaagaagagacgcaggaccccggaagcatgccaacgtcacaccgcgcacttcatccctcaagtcacccgcgtggccctcttgcgagtgagctttgcttcctttcgttcctgctctgaagctttttaatgaactttcactcctgctccaaaacttgcctcggtttctgtgtcttacgcgcctcagtcgtattctttcttctgaggaggctagggctgaggttgccgcagacctgccccgattcgccgctgctaagaatttctcagactccaagtttccagtcttccctgagcagctctctgtgacttttttcttcctgcgctgtctcgcactttacacacagttttctctgaggaaccttcctcctactaaatgttctaagttagttttccatgattttttttctcctccttcttcccttgactgttgggatacagaaatatttcacacaaatgatttctaatacgattgagtaggaaggaaatcagcttactttaaaagtctagaagcattcttaagtctgcttttcaataatcgtcttttttcatataatacttttcttgccctctttggaaactttgagcctgaatacaaattagaacaacacaaaattcaagtccttatgatggaattcaaatttgtattttggctcaattagctgctttctagtacatttaggatcatagcatttagcccacatttagtggcaaaggtagtaacattaacgttgggttaagtacaaaacattaaccaaaaaatcttgtagagaattgagatgttatgactagaaagaaattatgaagatgttattttcagggtatacatggactttaactgggcactgatttttatcaagaagtattagcaattaaattaactgtctttcatgtgtttaagaaatcagtcttctatccatattatatgagacaagaacatgacaaaatattttaaaaagcaaaagaatgattataaaaaataatgcagaaataatatttttaaagaaaatatatttaaaatgcagttttgggatattttacagcaagttacttcaaccatacctctagttatacagaattttgtcaagaaacaaatcatattttaacatatctagtttgaagttttccaaatacaaataaataaggcatcttaaaagcatgacaatttattctgtcattacttaaagcttttaattttgcatacttagggctagtaaagatataataagaaatagattggaagcagctgaacaaacatagtgttcataaatgcatttgatttgatattgacgtcaagcagttctaccaaagtgatttaagaacttgagagataagctaatacggtggtctaaagggagtcttatcttgttctgtacatatgagttcagagctctctattgaattctactttttaccacatctgattattcttcacggaccactgggaatagaccaaattggggccactgatcctaatttaagtcctttctgacccctttctgagtcttcaattcttgcttgcaaaagagagtattcaaaatgtccgtatcaaaataatatttagataaaaggtgtgaataattcatgataaaaaatttgctttctgattatgtaggttattatattaactaaacatgtttattttaccttttgatgtggctctgttctgttagccctaccacaaagatgatatttgtcacagtgtaacagtctattatattacctcttacaaaggcatgatattctattgatgtttaatagaataatttttaaagtacaaataaatgatttaatttatttaaataatttatattaaatattaaaatgtatatatatcacagatattttatatgtatattacctatattcaggcatgcagttagggaaagaaacggagggaaattgttagttaaacatgatcttaagaatttcttccatatgtggaaaagtcatcagttcatctggcatatagcaatatatacatatatatatacatatatatagaatgctatgtatacatttatcctacattcatttaacatcaaaacataaaaaagttatttctttattctctctaagcaaaaaccagtaataacagctctgtaaatagactctagaccaacagatcaagggaacaggttaaaccccttgcttatttgttagaattcaaagagcctcactttagctaatctgattgggctaatttgtgtgtaaatacagatatggatagatagaactatatatatatatacaaacaatatatattttatgtaatataaaatacatataatagataaattagaatctattcatttaacttacctgaaaccatataatcactcaaatgtgtctgcatgtctgtgtgtatctgtgtatgcatgtgtatgaaatgtagttttttaacttgacatataatagatgtaaatattttcggggtacatgcgataatgtgttacattcgtataatcaaataaggataattggaatatccatcatcttaaatattcatctttatgttagaaacactaaagttattatcttctagctgttttgaagtgtacaatagattaatgttaactatagctatcctactgatacatcaaatactaggtcttatttcttctgttataatgcatattcgtacccattaatcaacctctctttagctcccctttcccccaacccttggtagcctctggtaatcaccaatctactttttatcttcatgatatctttttagctcccacatatgagtgacagcattcaatatttgtcttgctgtgcttggcttatttcacttaacataatggcatccagttctattcatgttactgcaaatgacagaacttcattctgttttatggatgaataatactccattgtgtgtgtgtgtgtgtgtgtgtgtgtgtgtatcacattttctttatccattcatccaatgatggacacttaggttgattccatatcttggctattgtgaatagtggtgcagtaaatacaggagtgcagatgtctcttcgatatactaatttcctttcttttgagtatatacccagtagtggcattgctggatcatatggtagttctatttttagtttgtttaggaacctccatactgttctccatagtggtgttattaatttacatttccacgaacagcatatgggggttcccctttctccacatcctcaccaacatttattattacctgtctttttgataaaagttattttagctagagtaactccttgtagttttgatttgcaattctctgacggtgagtgatgttgagtattttttcatatacctgttgatcatttgcatgtcttgttttaagaaatgtctattcagatcttttgcccattttaaaaatcagattatttattttcttgctattgagttgtttgagctcctatattctggttattaattcctgtcagattgatagtttgtaaatattttctcccactctgtgggttgtctcttcgctttttttattgtttcctttgccgtgcagaagtttttagcttaatgttatctgatttgtctatttttgctttggttgcctgtgttttttgaaatcttacacacaaagtatttttccagacctatgttctgtagcatttccccatgtttttctcagtagttatatggtttcagatattaaatttaagtcttcaatccattttaatttgatttttgcatatggcaagggctaagagtctagtttcgttcttctgcgtatggatatccagttttcccaggtccgtttattgaaaagactcatctttccccattgtgtcttcttggcaccattgtcaaaaatgggttggctgtaaatatgtggatttatatttgggttctctattctgttctgttgatctatatgtctgcttttatgccagtattacactgatttggttactacaactttgtggtatattttgaagtcaaattgtgtgatgccttcagtttcgttcttttgtagttccatataaattttaggatagttttttctagttttttgaagagtgtcattggtattttcatgggggttccattgaatctacattttagggtagtgttgtcattttatcaatactaattctttcagtgcaaaagcatgacatatcctttcattattttgtgtcctctgcagtgtcttttatcagcgtttgatagttttccttgtacagatctttcatatctttggttaagttgattcctaggtattttatattcttcttagctattgtaaatgggattagtttcttgatttcttttctagattgtttgctgttgccacatctaaatgctacttattttggaatgctgatttttatatcctgcaacttgtaatggagttttggtggttatgactatgcatgtctttgaactgatttggtagttgaaagacatatatttttaaaacttcaaaaattagagaattgatatgggtagatatttaaactctacttcattaattcatctcattttatgaatgtgataagatactagaaagcaagtggcttccaaggggcaaaaactaataaattacagagacaagactttagcctaacttgtttaacttacaataaagtggtacttctctacctcacttagaataaagcagtattgtatctcctccaaagtctgtggtgaaacttaattctcagcacaactgtatcaaaaggctggcccttaggaaataatcagaccatgaggcctctgccctcatgaagaaagggctggagagaactaactagccctcttttgtacttttttgcctttccctcccttctggcatgtgaatatacagtgtttgctcctctggagaatgcaacatataaggcgccatcctgggagcaaagacagggccctcactagaccctgaacctgccagccccttgatcttggacttctctgttttcagaactatgagaaatcaatttccattgtttataaattactcactctgtggtatttttttataacaacacaaaaaaactaagacaaattggtaccaccagaaatgggtgttgctataaaaatacctcaaaatgtgaaagtgcctttgaaactgagtaatgggtagagcctggaagaatttggaggtgcatgctagaaaaagattagattgccatgaacagtgcattaagggtgattctgatgggagttcagaagagaagagctgtagacagagcctcaatcttcttagatattacatacatggtcatggtgagaatgctggtagaaatatggacagtaaggctattcttagttctcttatttggagatgaggaatgtcttatgggaaactggaagaaaagcatcctagttataaatggcaaagaacatggctgaattgtgtctgtgtcctagtgttttatgaaaggcacaacttagaagtgataagctgggacatttcgtgaacgaaatatctaacaaagcattgaggttgtcgtatagcttctcttgactgcttatagtaaagtgcaagaaaagagaaacctgaaatatgatcagagctgaaatctataatcaaaagggaaacagaacttaaagatttgaaaattttgggcacagccagatggtaaaaaataaaaaagcatgtttgggagaaaacaccaagggtgtggctaagggagcatttggtaaagaggttggtatgggtagaagaaggccaggcactattcatcagaacaatgaaataatcaccccaaagcatttctgaattctttgtggctgccctactcatcataggcccagcatgccagggccttgagggttgaactgtttcgaaagaagggcccagtgtggccttactgactgggattgcctcaagtctatgttccttgcatttcagtgcagtgctccttggtcaccccagcgtggctcaagtgggcccaggtgtggctcaggctgttgcctcagagggcacaagcagtgaatggtgacatctccatggtgctaagtctacaagcacacagattgcaagagccatggaggcatggatacctctacctagatttcaaagaatggctcagacagctgtggggcccagtgttttaaacttcaaaggctacagtttaaaacactacactcacaggcaggcccactgcagacagccccccatgagggcaatgcccagcacagccatagagtcaaggccaccatagagagctcccattagggcaatgtctggtggagctgtggggatggggtcatctccaagacaccataactgtagaggcaccagtaaagcaacgccagcctgcgagagctgcaggcacctgactccatcccctgaaagctgctgtgtgggctacaccaagcaaatcagtggaggtggggtcccccagtgacttggaggtccaaactctgttctaatgtgtccagcgggcagggcatagagtcaaagattgaatattgtttgacttgttgcattttggacttgcttaggattgtgttttgggagcatacaactgtttaatgttacaggctcacagttgaagagcaaattgagtctcacccatatctgatctagttgagatttgaatttagactttaaggttgaatctggcatgagttaagactttggggttattgggatgaaattcatgtgttttttacataagaaggacacaaatttgaggggagggtcaagagcagaatgcaacaggttaaatgtttgtgtctcctctaaaattcatatcaaaacttaatccccaaagcaactatattaagaattaggtcctttaggaggtgattaacctaagagggctccactctcatgaattagtgacctcatacaaaagctgaagataactagctaggcctatttttgcctttttgccttttgccttttgccttgtgagtacacagcactggaggtgccatcctcgaaacagaaaccaggaccaaaccaaacaccaaacctgctggtgccttgaacttgaacttcccagcctccagaacagtgagaaataaatttctgttgcttagaagttatccagtccaggtatttcattatagtagaacaaatggattaagacacactgtaatgcactgcttcataaatggcattatattatcctattaattttgttgttaattttgctctttaaagaaatgataaaattggggccaggctcagtggctcacgcctgtaatcccagcactttggaaggccaaggcgggtggatcatgaagtcaggagattgagaccatcctagctaacacggtgaaactccatctctactaaaaatataaaaaattagctgggcgtggtggcacacgcttgtagtcccagctactcaggaagctgaggcaggagaatcgcttgaacctgggaggtggaggttgcagtgagccgagatcgcaccactgcactccagcctcagcgacagagtctcaaaaaaaaaaaaaagataaaattagtaggaaaaatcattttaatgaacatgtgatcttggaaatttgctctgaagccctcatatggcagcaatattaaagcagattaaatactaagatacgtgtgtgcgtctgaaattatttttacataaactggtttctctaactttactcaagattattttaactaattttaggcagagtaataccctagtttgaaaatatttttaggcaaggaaattgcaagcccccgtttggcaatatgctctaacacagggcttctcaaccctcactatccatgaacccccagctaaaccacaacatgcatgagcacacacacacacacacacacacatgcacatacaagtcctccaaatcaacatgagaaaagtctctcacataattcaagaatgctgtttcaccaacttcaaccctcagtctgacaacaagatgtaatagtaaatgtagtatatccgtttgaagcactttataaactgaaagaaactggacacaaataaaatggttcaaccatctcttcgataatttttatagccatggaaagacacctcatagtcacataatcttaagcgtgttcatggagcagcgagtcaaatgacattatgtggcaataaagaagacttcagcgcgtttcctgactttaccagtgaaaacatctgaccttgaggagggcactgaaaatgccactgcatcgacattttttttttttttagatggagttttgctcttgttgcgcaggctggagtgcaatggcacgatctaggctcgctgcaacctccaccttccgggttcaagcaattctcccgcctcagcctccgaagtagctgggattacaggcatgcgccaccacacctggttaattttttgtatttagtggagacagggtttcaccatgttggtcaggctagtctcaatctcctgacaggtaatccacccgccttggcctcccaaagtgctgggattacaggcgtgagccacagcgcccggccgcatcgcatctatttttgtaaaatatgcataattctagaatatgtttgttgtgaggattgaagctcataatatgtacccttttaaaactttatgttgaaatgcctcaaatcaaaatattatcatatgatgcagtttattcatccttatgagaagacacctgatagggactgtcaagggtgactgtatcaaatgtgcaagagattcggggcatttgcttattgcagtgaattgcacaaaagaattatttgaaataaatataacatgcaatgaagttgtcaataagtagcataatttatacttgctagttcaatgctggacacagataaagtgtttcaaaatacaaatgcctcacagagaaaagggaagtgaatgagaagaaaggaaatttattgaaatgaaagataggagaaaacaggagaagcacagaagtgacagacaggaacctattgcacatgagaatgacacttcactagacagaccctttcagaattcaatcacaatgctaaactttccaaaagttcacaaagtaaaacttttgagtactagcagtgacacaggtcctgttgaaattttcacaggaaatagagggaacataaactgattagtttttaatcaagataaacacatatgtccactctaacttagtaatcgcttatgtttaacatgttaaatacaatgtattaaacttattatatgctaggcactgttttaagtgtttaatatctgtggtctcatttattgctgctaactgcctaagaaaataggtaatatccctactttagctttgtggaaacagatgttcaaagctattagtctcccatcatagcaagtagctgagccaagatgcacacgtggtccctacagtttaaaacactacactcacttttctcttctgtactattgaagtgatgctgtcattattcactattcatttaatgtcttttgcacttgttttaagatcagttcaggagtatttcagttcaagtcccaccatgaaaagagaagccacaccagcattttagtagagagaattgtttccaaggttattgtagacccgaaaaggcaaaaagggagacagaggatggttagcttacatctccaggactggaacaaaggaaaaagaatgggcttatcaccacctacaacctcagaaactaggcccagcagagctgtgacccagacacctgagaagtgggcttttctttggaggagtcagggagagaccccacagagctgggattcagatttctgaggggcggtgctacctcattgctgcttgttatctccaagctggagatgataggaatggttctgggagtgtggaagaaaaggtatgtcaactactaaaccgaatgctgccgtggctgtattgacttgagtgcttcccttctctccgcctgctgtcttcctgtctcccactagtgacttgtagctgcagaagcagacggcaaacagtcctacagtttccaacccagcaccactgagcagatatataaaggtagatttgagctatgcaagtcagtcagttccattattttataattaagccatactttttgtttaattactatatactcaatttatcagatttgattaaataacctctgagtattgtcaaaagataaatccacttcccaaagataaggatttgccaccatggaggatatcccaatttcagactacatctattttccaggcaaagtttcaaattattttcctcaggagacatcaaaagatgtcttcagagaaaagacctgctgatactggcgttaggggttacataaagaaaagggccagctccttcctgagttccctggagtgagttccagaaaacaacccagagtttccaatcagcgtcttagtgtccaaggaccagccgataatgtgagaaaatatcccatgatgaaagagtaagtcagtaataaagcaaaatgtggggacagaaagataattcaggaagtagaaaactgaaaaaatgagtataaattatcagaaaaataaaaacaaactattgataacaacaggaatgccatgaaaaatgaacaattagaaaacagtgacaactagaacaataaaaaagtctttgaaaattaaaaaaaaaatgatggtcaaaataaaacttctaatacaagaggaaaagtttcagaaatctatcaaaaaataacaaggaaaaatacaagacatggagaatcattgcaagaaactcactttctagaaaaaatggcatgagagtggggagacagaaaaaaacgctggagaaaaagttataaaagcactaatacaggaaaatttccccaaactaaaagacttgagtcctcaaaatcctttttaatggccaggatgaaaaatgaaaatgtcttatttaaggcatataaaattaaaaagcatcagcactaaagagaagcatctaaaattttccataaaaaccgtaaatcacatacaaaagaatgagaatctgaatagtgctgaaggatcaacagaagcctttttttttttttttttttttttttttttttttgctaaaagtcaatggaacaacaaggcctgataaattttaaagaaaaaataatgttcaaccttgaaattttgttaatactttattctacaggtgtactgcttttaatacacacttcctttaaaaatttccttgctacggcaaggaaaacagaaagtaactaagaaaacgggagtcagttctagaatatggtatatccaagttaggaaattaggaacacagccacagataacagcacacagctaaagccgagagcagccagtccagatcacagcaagtgaaaagagactccaaaaagttttttctagttaagagaaagactcagtagaaaagtagttgatatttagaatcatagccaagaagaattaagaagagtaagtaagaaaagaattaaggatgtgagaatgaattatacaagtgaaagaacaggtgcatctccttcaaaacaaatatctacacagtataaaaggagtaaacatagcatgctagctggcccagcagtgaacaatattttcatcacgtagtggtgtaaatacagcttgctaatctacattaaaaataatatgattctattgtgataattctattgcaagaacgagggaggggcaaataagagaactaagtctatatccatcatcatagaaaatcaatatgtaatatttcaacatgcaaaatcaataaatagcaatatagatttcatgtttagaaatagggataaaactacagaagaaaaagctgaaagagtgaagtgtctgcctctgtagggtggtactacaagaaaaaagaactgcaaggtgctattgtgtactgtggtaagttttcagtatggggctgtttatttatatgtttgatctaaaaatcgtccccccccctccgtggctctgccctgcgtgggcggactgcgaggacctgatctctgcaaactacacttcccaggattccttgtgcattgactgctggctcgtttcagccaatgagaggcactggcagaaagtcagttgtcctggtatatgctggcatatctccgcttctctctcttctgtggtgccacctctggccactgatattctcctcacaaggcacaaggtccccctgcctagtgaggcctccaaagttctacttcaggcttggcggctccaactcttaagctactctctttgaacctccaacctagggacaagggcaacttccagcagcaaggaatctcatcttccgctggtggctccttaaggtcttataacacctttaaaaatagcgtcctaggccgggcacggtggctcatgcctgtaatcccagcactttgggaggccgaggtggacggatcacgaggtcaggagttcgagaccaccctggccaggatggtgaaaccccatctctactaaaaatacaaaaattagctgggcgtggtggcgggcacctataatcctagctacttgggaggctgaggcaagagaatcgtttgaacccgagaggcggagcttgcagtgagccgagatcctgccactgcactccagcctgggcgacagagcgagactccgtctaaaaaaaaagaaaaagaaaaagtgtcctatattaaataaattcctcatattttatactaatattaattccaattcaatactttacatcagctttgatttttcaaatggccctgagtgatacaagtaactgtgtagtattttaatatacaagtgtcagaaagtattgacagagcctctcgaccaaactttactctcttcaacgatttctcaacttttagactttttttacttatctctacattgtccaaatttagcaagaagcttgctaagtcaatttagtcattctccttgtctgctcaccctggatatctgatcgggttcctcatcctccaccatcctccagatgatgtgtgattgccctggcctgcctccagccagcatcctggcaggtcagtttggccacagaatctcccttactactaatgtttcctcttagtaattttccgtccaccgagctccctcccctgctccttgtttataaattctcactttttcttatttttttcagaactgagcccaatctctctcccccactgcaaggcgccattgcagtagtcctggatctatgacaaaagtaccctcttgaacaaagtctcccttactgtttttaacaagtttcattaatacttttttcttaaacagtataagtttctaaaaggtcaaatatatatttcatagtgctttgtgaattcttaaggaaaaaaatcagaacaatggcagaatcacttcaaaagaaaaggcgtggtggctcgcgcctgtaatcccagcactttgggaggccgaggcagcaggatcatctgaggtcaggagttcaagaccagcctggccaacatggtgaaaccccatctctactaaaaatacaaaaattagctgggcatagtggcgcatgtctgtaatcccagctactcgtgagactaagcggggagaatcgcttgaacccgggaggcagaggttgcagtgagccgacattgtgccgttgcactccagcctgtgcgatggagcaagactctgtctcaaaaaaaaaaaaaaaaaaaaccaaaaaaaaaaaaccaaaaaaaaaaaaaacagagagagagtgagagagagatcttatattctcctaaagtgtctacttggaatgaaattctcaggagttcacttatggctagttaaagccattgcattgttctacaatactgcaaaatgaaataagtaaaatattttgtccccaaataaaagagtacagcttactttttctaagaattaatattcatgaaaactacacttgtgtttttattttgtccccagtgaaaatcagcgtctcagcagcagatccactgaatatatcggtacaacttgatagatcactgcttcttcctacgagacttcagcgtcaaactaaagggaaaaacccagcagttttcttattattatcatgtatttaattacataaataatatttttaaaacagtccagaagagcacataatgaaaaccatgtctctctcattcgagtgtgctctctgtgggcagccagtgtccacgtctcctgtacccttccataatccatttatgtagttataagcatgcatttacattttcccagaaaacggggataataacatcattaactgaagtaaaatttttgtaaggattaaataagaagagaaggaaacaaaaatttaatatattaagtccttaataaatgataaatatcagttattcatattttctaatttcatcaaactatctactatcaagtatggaaataaatttatctggtctcctactgaggttgttttccaagcttccaagtttccaaagtttatataagtataagtattgtataagtattataagtgtatgaaatgcatgtataaaaaatacatagtgttgttgtagatttaagggattgtgcatttttacttttgtattaccaaacaatcctccaatcaaaaagcagacacacgcacacactatataagaggtgtgataatgatgtatagattgtaagtgtaatataagtcttcaaaatatgtcttgtggaacagatacaatctttcacaggtaaaaactgaatctttagtaggtttaaaaaagacattgtatatcgacataatcatgtgtgttataacataagcagtgatgtgaagcaggaattggatttgtatattgactccctgtcacagttaagatgctagactagttgaaggggaagaagacgaggtgtatcaactgaagtcagattatagaggaagttggagccaaatttctgagttgttggagaaggtaattacagattttgaaaccctggaagatataaatgcaattttttgtaaggacaatcatacctcctcttctcagactgatgatttccattacattttaaagggcctaagcaacaacatgtttttggtaagtctgagcatagttgcaaaccaaccagttcctaaattatgaaaattgtcattttctttcaaagcaaaatgacttaaacggctacaaatcaagttgtattgaataatccagggtttgcaatgtttactgtaattctgttttctgcaatgtgtagttttaatggttcttttattttgagaattagttctattggtatcaatatactcttagctcaagcagtaggtttgcttttttatgatactgtacaacaacttgagtggagctagcaggctgatttcatatgctagacatatctacctatccagtacttcttggcatataattttttttggacatgtacaaagtgtttttttccaagtatacaatacttcaggattaactatagtggatatgctgtacaatagatctccagaactcattcatcctaactgaaacttggtacccttcgaccaacatctatctcctcattctcctcccccacatcctggcgaccaccgttctactcttggcttctatgagttcaacttctttagattacatgtagacgtgagatcatgcagtatttgtctttctgtgtttgacttatttcattagcataatgcttatccatattatctcaaatgacaggatttcctttcttttttttactctaaatagtattccattgtgtatatataccacattttaaaaaatcagtttatctgttgatgagcatatcttggctattgtgaatagtgctgtaatgacatgggagtccaggtatctctttgacttactgatttttttcctcttggaatttatacccaatagtggaattgctggatcatatggtagttctatttttaacttgttgagaaaccttcatactgttttctataatgactgtgctagtttacattcccaccaacagtatagaaaggttctcttttctacatcctccccaacatttgttatcttttatcttttcataatatctatttgaacaggtatgaggtgatatctcattgtggggttactttgagtttccctgattattaatgatgttaagcaattttttcatataccttttggccatttatgtcttcttttgagtattgtatatgcaggtcctttgccaattttttaattggattacttgttttctggctatttggttgtctgagttccttatatattttggatggtaactccttatgaaatgtatgctttgcaaataattccataggttgtttttcacttttgatcatttcttttgctatcagaagcttttattttttaacattatttatttattttaattgagaaatattgtatttatcatgttttaaaatgtgcatccattgtgaaatagctaaatgaaggtaactaagatatgcattacctcacatacctatttttctgtgtgtgatgagaacacaaaatctgctcttaacaattttcaggaatacaatatagtcatccctcagtgtagttgggagatttggttccagaagccctgcttataccaaaatctagggatactcaggttccacagtctgccctgtggaacccacatatgggaaaagtcagccctcagtgtatctgggttttgcatcccatgaacactgtatttctggattgaaaattctgtattttcaatacagaattctgcagatgcagaacccttggatacaaacggctggctgtatttattgaaaagatctgcatagaaatggactcaaagaattcaaaccagtgttgttctagagtcagctgtacattgttactaactatagtcaccatgttttacattaatgctcttcaacttatttgtcctatcttactgaaattttgtatcctttgcccaacatctccccagacctccatgtttagcccctggtaaccactattccactctctgcttctatgagttccatattttcagattccacatataggtgtaatcgtttatatttttgtgcttggcttatgttacttactataatgtcctcctccagattcatccaggttattgcaaatgacatgattttcttatttttaaagctaaataatagtccattgcatttatgtaccacattttctttatctgttcatctgtgatgtacacttaggttgcttccatatctaggctattgtgaataattctacaataaacatgaaaatgcagatatctctttgacatactgatatcattttctttggatagatatccagtagtaagattgctgggccttatgatagttctatttgtaattttttgtgaaacatccatactattttctataatgattatactaatttacattcccactgacagtgtgaaaggatttccttttctcctgtaggttttcagtttgatgcaatccaaatggtatatctttgcttttgtcacctgtgcttttggagtaatatccaaaaaatcattgcctagatcagtgtcaaaaagcttttttccctgttttcttctagcagttttacagtttcaggttttatgtttaatccattttaagttgattttccctatgatgtgagaaaagatccaatttcattcttctgaatgtagacatctagttttcccaataccgcttactaaagacactataatttctccattgtgtattcttggcatttttgtcaaacagtagtggactgtaaatgtgtgcatttatttctgggcactctattctgttccattggtttatgtatctgtttttatgacagtagcatgctgtttcaatttctgtagctttgtaatatgttttgacattaggtagtgtggtgtcttcagctttgtttgtattgctcaagatttctttggctacttggggtcttttataattccacatgatttttagaatctttttcttctacttctgtgaaaactgtcattgaaatttttgtagggattgcattgaatctatagctcactttgggtagtatgaatattttaactgtattaattctttcaatccatgaacatgagatatctctccatttatttgcatatttttctatttcttttatcagtcttttatagttttcagggtacagattttttacctctttagttaactttgttgctaggtatttttaaaatgctgttgtaaaattgcattgttttgattgtttactatatatatatatagtcagtgtttatatagactaacaatgaactaccatttttagtatatataaacttcttcattgaagaagaattcagatagttcattgttagtctgtataaacactttgtatatatttcaacatttataaacatacacaaacactatatatactaacaacatttataaacatatataaatactctataaatactaacaatgaactagcttacttcttcagatagtatacataaacactactaacttttgtacattgattttgtagcctacaactttattgaatttattatttctcaaatatttttgataggtctttagggctttttatatgatttatatatgattatgacatctacagagaccattttacttcttcctttccagtctggataccttttattccttttatttgcctaattcctctaactaggacttttagtgctgtattgcatagaaggggcatccttgtcttgttcctgatcttagaggaaaaactttcagtttttcaccttaagtataatgttagctgtgaatttgtcacatatgacctttattatgttgagatacattccttctataactaaaatgttgagagtttattctgaaaggatgttgaattatgtcaaaaggttttccttcatctattgagatgatcatatggattttacctttcattctgttaatatagtgtatcacatatattgatttgcatatgttgaaccatccttgcatcttagggttaaatcccacttgatcatggtgtaagatcctatcaatatgcttttgaacttggtttgctcatattttgttgaagatttttttatctgtgttcacagggttattggcctataattttcttgtagtatctttgtctggttttggtattaggtagtgctagactcacaaattggctgataactttgattttgttttttattctaaaccactgctttctttctttttaagcatgtttaacaatcagagtcacagtgtagagcaggtccatcttccatccccctccaactctcctcatgcccttcccagttaatcctcctgtcacaacctcccaaagttctgggattacaggcgtgagttatcatgcccgacctaaaccactactttcaataaagagtgagaataaaacaatctatcataatgtttatgtttcttcatgcatacagtttgtataaagaatgtataatcatttttacataagcacttcacatctatatgaaatcccatttctattcctatctaagtgacgtgggtttgtttttctcaagacaaatggtttgttctattttaatttctgtcttactgtttttcttaatagggtagaaatgaacattttgagatttggaatcagactggtataatttgaatactagctagtctgtttattaattccgtatgtttgtttggatcacttctgtaaattccagtttctcatctgaaaatgaatacaattacagggcttacctcataggattgttttttcctgttaattaagtaaaatgagaaaggcagttaagaaagtgactattatatatcaagaaaataacgtatgatatctgttattattattgctattattaactattataaaaaccatgattggaagatgacaacagagctgaaactccagtgaaagactgaactagttaaaaatgcaccaaagccttgttattctgtctagacatgaagaggcttacaagtggaaccacatctttgactccgatttagaagggtggcatgtggaactcactatttcatcttttatcattccccagcactagacactataattactctggttatcactgtttctgggctcagatttcagcaggattgcatatctatcacaattaaaaaggcaaatgttgtatttttttaatgtggttagtgaagaaaagcttttaaataagtattctaaacctctggtttgagtacttgggaaaccatgaataggattgtaagaaggcattgagagaagaaaacttcaaaacttgcatttttgagataactttttaaaattctaatttccagtgaaaaatgtatagtgttcatgcaaatatatgcaaataaatacagctgcttttctattttaatcgtaaacctggccccttgaaatattttagcaaaaactatttgcatggaggctgtaataaacgatagtacatgtccctgttacatcaaacaaggcattctctgtatgtagactgctgcatttattattattattattcattacttcagaatcatatcatgtgaagactattgttctctggatcctggtgatggttttcattcagctgattttggcaatgattaaatttcttgttttgaagctagcggcatctcatatacaagttccctgagcatagagaccatgtcttatcttgctcatgactaaatctccaatgtcaagtacagtactcaaaacacaattattttttgataaacatttattaaatgaatgaataatgtctagtttaaatatatctagtgttttcatgatattctttatgtgttgaagcacccataccagttcccttcaaaatctgtgagcatagttctttcactgagtgtaggtatttgcaaatttgaccaagttttctgtaatagtacagaaaggcagaatcaatgctttctagaaaaaaaaaaatgaggttcagcttatcttgtcactattatgagaaagcatctctgtcccagtcataagatgtgtcatagactggaagtttctgggattttccataaaggagcagaatcacagacagtagaggggacatatggccccagtcgccctgctctgttcatggtgcctccttcctagtctaaggagagccagcaccactgcctctctcccatctgacctccactcatgactgcctagtacagcctgatgcacgctaaggccagagtagtgccatgaggaggtgtgtattttttatccccagtcacttatggctattttaaatctacggaagatcaaaaaaaaattatccttaagccaacctcatgtaattatacccattatacagaatagaaactgagttaatggaaagttaatgacaagttcaaagctgtcaaataataattctgtaatgggaacacatagcccttgaattttcctatatttatcctaagagcaggaacaatcctttttttgtctttcaactgaaaggttttattttattttatttttcatcaatttttattttaagtttcagggtacatgtgcaggatgtgcaggcttgttaataggtaaacatgtgccatggtgatttgctgcacagatcaacctgtcacctaagtattaagcccagcatccattagctattcttcctgataggctcccttccactgtcccccacaacaggccacagtgtaggtcattccctcccaggtgtccatgtgtcctcattgttcagctcccacttacaagagaatgtgcggtgcttggttttctgttcctgcgttagtttgctgaggataacagcttccagctccatccacatccctgcaaaggacatgatcttgttcctttttatggctgcatagaattccaggtgtatatgtaccacattttctttatccagtctatcactgataggcgtttggattgatttcatgtctttactattgtgaatagtgctgcaatgaacatacacgtgcatgtatctttaccatagaatggtttatattccttttggtatatacccagtaatgggattgctgggtcaaatggtatttctgcttctagatctttgagaaactgccacactgtcttccacaatggttgaactaatttacactcccaccaacagtgtaaaagcattcctttttctccacaaccttgccagcaactgttgttttttgactttttaataactgccatctaactggcaagagatggtatctcattgtggttttgatttgcatttctctaatgatcagtgatgttgagccttctttcatatgtttgttggctgcatgtatgtcttcttttgaggagtatctgttcatgtcctttgcgccccttttaatggggttgggtttttttttttttttgtaaatttgtttaagtaccttagagatgctagatatttagacctttgtcagatggatagattgtgaaaattttctcccatgttgtaggttgtctgttctctctgataatagtttcctttgctgtgcagaagctctttattttaattagatcccaatttgtcaatttttgcttttgttgtcattgcttttggtgtttccatcatgaaatctttgcccatgcctatatcctgaacagtattgcctacattttcttctagggtttttattgttttgggctttatatttaagtctttaatccatcttgagttgacttttgtatatggtgcccagtttcagttttctgtatgtggctagccagttctcctggcaccatttattaaataggaattatttcttcattgcttgtttttgtcaggtttatcaaacatcagatggttgtaggtgtgtagtcttatttctgggttctctattcttttccattggtctatgtgtctatttttataccagtaccatgctgtttaagttactatagcactgtagtatagtttgaagtcaggtagggtgatgcctccagctttattctttttgcttaggattgccttggctatttaggctcttttttggtcctatatgaattttaaaatagttttttttttttttacttctgtgaagagtgtcaatggtagttttacaggaatagcattgaatctacaaattgctttgggcagtatggccattttggcgatattgattcctcctatccatgagcatggaatgtttttttcatttgtttgtgtcctctctgatttctttgaacggtggtttgtggttctctttgaagaggtccttcacttcccttgttagctgtattcctaggtattttactctctttgtagcaattgtgaatgagagtttattcatgatttgtattttctgcatgcctgctgtttgtgtataagaatgctagtgatttttgcacattaattttgtatcctgagactttgctgaagttgcttatcagcttaagaagctttggggctgagggccgggcgcagtccctcatgcctgtaatcccagcactttgggaggctgagacaggtggatcacgaggtcaggagatcgagaccatcctggctaacacagtgaaaccccgtctctactaaaaatacaaaaaaaaaaaattagctgggcatggtggtgggtgcctgtagtcccagctgctcgggagactgaggcaggagaatggtgtgaacctgggaagcagagcttgcagtgagccaagattgcaccactggactccagcctgggcgacagagtaagactctgtctcaaaaaaaaaaaaaaagaagctttggggctgagacaatggggttttctagatatagggtcatgtcatctgcaaacaaagataatttgacttcctttcttcctatttgaatacccaccctttatttctttctcttgcctgattgtcctggccagaacttccaatactattgttgaataggaagggtgagagaggggatccttgtcttgtgctggttttcaaagggaatgcttccagcttttgcccattcagtatgatattggctgtaggtttgtcatatatggctcttactattttgaggtatgttctttcaatacctagtttattgagagtttttaacatgaagggatgttgaattttatcaaagatcttttctgcatctattgagataatcatgtagtttttgtctttagatctgtttatgtgatgaattacatttattgattagcatgtgttgaaccagccttgcatcttggggatgaagccagcttgatcgtggtggataagctttttgatgtgctgctggatttggtttgccagtattttattgaggatttttgcatcgatgtttatcagggatattggtgtgaagttttcttttttgttgtatctctgccaggttttgatatcaggatgagtctggcctcataaatgagttagggaggagtccctcctttcagttgtttggaatagtttcaatagaaattgtaccagttcctgtttgtacctctgttagaattccgctttaaatcctttggtcctcagctctttttttggttgatgggctatttcttacttcctcaatttcagaactcattattgatctacttagggattcaatttcttcctggttcagtcatgggagggtatatgtgtccaggaatttatccatttcttccaggttttctagtttatgtgcatagagctgtatatagtagtctctgatggttgtttgtatttctgtggggccagtggtgatataccccttatcatttctgattgtgaatattgattcttctctcttttcttctttagtctatctagcagtctatctattttattatttttttcagaaacaaaacagttcctggatttgctgattttttgaagggtttttttttttgtgtctctgtctccttcaattccaaagatcagaatcttatctccaagaaatgggtaaatatggtattgtgtctttgcctcaaactgcaaactttgacatctcacaaattttgaaaattccacatagccctagaagttttctgctttttcttgtttctttgaaacccatttcaatgtaactttttctttgatttgctctcttgtatacaaatctaaatagaaccacaaaaaaaaatatgcaataccatttggaaaaaggaagcaatttataaataatcaatgactaataaaaatgaaactagttttccttttttaacacttgataaagaaaagttaggtcaactttgaagcacttaataaagtgttttaaattaaattttttaggttggatttgtatctcaaagtagaaatgcctagtcagccttatcaatgaatactccttttggtttgcattacatatctgaacagtttttttcatttgcattaaatatcctaatatttttcctaatatgttaaaagatgatattgcatctgtctgatcagacatactggtccaaaacttaatttactaggatatgaaatctttgttagcttggagaaataatttccaattatgcatttcagtctcaaaatgcacacctaaacccatttaagactagctaagaacatttttataatgcatttcttagaattagctacagttatggactagtttttcttagtctttttttatgaatcaaagatagattgtctaccattcttcctcccctcccgttcaccttgttctagatggaatgaattgatgcaatttattctgtatcatttaactcatcctttatttctataaaggcaaaaataaagatataagtgtgaatccatgttttcctatttttttggcatttaaaccgaagtgtagaagattaggtattaattataattgcttaaaattcttcatagtagctttttaaataaatgggaattccaagaataattataaggtgattttaaaaacaaaaatacaagaacttatgctcctaaataattgttatccttctaggaagttatattggataaatagcaaccttattgaaataacctgtggcctgaagtaacagtgaaagacctatatggatttaaaacatctttctaccacttaaaaatagtatgatctaaggcaagttatttaagcactctgtctctcaatttaggtatctgtagattgttacaaaatggccttgagtggaagacatctccctaaatgcatcccgcattgaatcctggctggccttaggccgacagaatgtaacagatgtgacatcttgccagttctaagcctaggcattgaagagcttttgtagcttttgtctgaaatcaaaccactctgctatgaagatggcccatctaccctattggagaatgagaggtcatgtggagaaaacatgtggtagcttagctggcagccaaaagccagacgtgagcaagtccatcctggaacctccagcttcaattgagtcatccagtgacatcaccacatgaatgatcctaagtgacaccagcagaagaaacaaccagattgccaatgcacactaagaaccaagccaggtactaaattaggcagagataagggctggagtttagagattctaactccagtaatgtgctacttccacctctctgtctgaggggcaaccatctggcaatcctgagtacaaggcagaaattcagcatttggataaggaatctgctactgcttgggggtgtttgcaggaggaaatatagacatgcagttacaatgataccatccgtttctgaaaggtaagaagcaaaacacatgactagacacaacttccaagtcaagttaggagtttttcttttgtgctatgtgttggttaaaatcagaatctagcattatatgacttcagaagcttcctagttacacatacccagggaaggagaattcccataatcccataatcttattcagattaaactgatttattcacttccaattatgtgccattttttgagaaccttatcttggtaagagtagatttgggtgagagggaatcagtcttaggtagaattgaagaatctcagcaccagctaaatatttttgagcagcctatggacacgtttccagtgagagaaagaaagaggattggctaagtgtggtagctgacaccttccactgtgctcacaaagtgtgttgctctactccatgcagctctgaccagcagcattgacataatgacctccttgctacagggagcatctcaagctcagggattcaggctttttatcttttaaatagaattgccagacagcatacacgatgcccaatttaatatgaatctcaggtaaacagcaaatcatttttcagtatgtctatgcaatatttgtgacatacttatatcaaaaaatgatacactgttaatctgaaattcaaattactatttaactgggtgtcctcttgtgtttttagtcggtttgcttattttgcttcatttgttttgtttttggctaatctggtaaccctccttagaaatgaatgtcaatacagttgtgccatagaagaggtgctcaaggctgggcgtggtggctcatgcctatagtcccagcattttgggaggccgagatgagtggatcacttgagcccaggagttccagaccagcctagccaacatggtgaaaccccgtctctactaaaaatgcaaaaaatttagccaggcatgttgacatgtgcctataataccacctaccagggaggctgagatgggaggatcacttgagtccagcaggtggaggttgcagtgagccgaaatcgcaccactgcacactagcctgggaaacaaagcaagagcaagactctatctcaaaaataaaaaaaaaaagaggtgctcaataaatgctatttgaatattgattcaaactttttgcaattccacctaatttcttgtcttgttatcatggttccactaaccttttcgatgtcacagactctagtgtgattctacacagaaatctcaacccctgtaataattatagccaaaataacagtattatctatatttctgcagcagcttatggtttttcaaagagggagtacttgcttattttaaaaataaactctgagtaattacacagttaaactgtggctgtagatgaaaagaaaatggagagagtgaaaaatggtggttcatagaaagatctttgtgcttacataaggcactacatttctggttcatacattttccctcatattctgaaatcagatcgttgtttttctaacatgactgtggcaggttcaaaggaagagaaaataactaaatgtagaatactgttggctgtaggtgaacatgcattaattccctgtcatcccatttcatgccttgcaatcttccaactgttaattaagacaaacagcaaaatcatatcctttagcaaacagtctagtaccctttcccagtctgggatgtgacaggcaccacactcaaagtatgctttttttggtcatctttatatagcataatagaccaaccaagtacaagttaagcagactgaaaggaagaattatttcacactcctgctgatgctgctggaaagtgtagaaatgatcttggagtgcttcctttagttctttatcctttagaatagctcacagaaggcaacctaacaagcattaggattcacaatgccatctgtctgttaaaaatatagtctaattccaaagaagggcattacataatagtaaagggatcaatgcaacaggaagagctaactatcctaaatatatatgcacccaatataggagtgcccagattcataaagcaagttattagagacctacaaacagacttatactcccacacaataatagtgggagattttaacaccccactgtcaatattagatcaacgagacagaaaattaaaaaggatattcaggacttgaactcagctctggaccaagcagacctaatagacatctacagaactcttcaccccaaatcaacagaatatacattcttctcaacaccaaattgcacttattctaaaattgaccacataattggaagtaaaacactcctcagcaaatgcaaaagaatggaaatcataacaaacagtctttcagaccacagtgcaatccaattagtactcaggattaagaaactcactcaaaaccccacaactacgtggaaactgaacaacctgctcctgaatgactactgggtaaataacaaaattaaggcagatataaataagttctttgaaaccaatgagaacaaagacacaatgtaccaggatctctgggacacagctaaagcactgtttaaagggaaatttatagcactaaatgcccacaggagaaagtgagaaagatttaaaattgacaccctaacatcacaattaaaagaactagagaagcaagaggaaacaaaagctagtagaagacaagaaataactaagatcagagcagaactgaaggagatagagacacgaaaaacccttcaaaaaaatcaatgaatccaggagctggttttctgaaaagattaacaaaatagactgctagccagactaatgaagaaaagagagaagaatcaaatagacacaataaaaaatggtaaaggggttatcaccactgatcccacagactaccatcagagaatactataaacacctctacgcaaataaattagaaaatctagaagaaatatataaattcctggacacatacaccctcccgagactaaaccagggagaagtcgaatccctgaatagaccaataatgggttctgaaattgaggcaataattcatagcctaccaacaaaaaaaccccaggaccagacaaattcacagccgaattctaccagaggtacaaagaggagctggtaccattccttctaaaactattccaaacaatagaaagagggaattctccccaactcattttatgaggccagcatcatcctgataccaaagcctggcagagacacacagaaaaaaagagaattttaggcaagagaattttaggccagtatccctgatgaacctcgatacgaaaatcctcactaaagtactggcaaaccgaatccagcagcacatcaaaaagcttatctaccacgatcaagctggcttcatccctgggatgcaaggctggttcaacatatgcaaatgaatcaatgtaatccatcatataaacagaaccaaaaacaaaaaccacatcattatctcaatagatgcagaaaaggccttcaataaaatttaacaccccttcatgctaaaaactatcaataaaataggtattgatggaatgtatctcaaaataataagagctatttatgacaaacccacagccaatatcatactgaataggcaaaagctggaagcattccctttgaaaaccagcagaaaacaaggatgccctctctcacccctcctattgaacatagtattggaagttctggccaggacagtcaggcaagatcaagaaattaagggtattcaaataggaagacaggaagtcaaattgtctctgtttgcagatgacatgattgtatatttacaaaaccccattgtctcagcctaaaatctccttaagctgataagcaacttcagcaaaatctcaggatacaaaatgaatgtgcaaaaatcagaagcattcctatacacctataatggacaaacacagaaccaaatcatgagtgaattccctttcacaactgctacaaagagaataaaacacctaggaatacaacttacaagggatgtgaaggacctcttcaaggagaactacaaaccactcctcaaggaaataagagaggacacaaacaaatggaaaaacattacatgctcatggttaggaagaatcaatattgtaaaaatggccatattgcccaaagtaatttatagattcaatgctatccccatcaagttaacattgacttttttcacagagttagaaaaaactactttaaatttcatatggaaccgaaaaagaacctgtatagccatgacaatcctaagcaaaaagaacaaagctggaggcatcatactacctgacttcaaactataccacaaggctacagtaaccaaaacagcacggtactggtaccaaaacagatgtatagaccaatggaacagaacagagccctcagaaacaacaccacacatctacaaccatctgatctttgacaaacctgacaaaaacaacaatggggaaaggattccgtatttaataaatggtgttaggaaaactggctagccatatgcagaaaactgaaactagaccccttccttacaccttatacaaaaattaactcaagatggattaaagacttaaatgtaagacctaaaaccataaaaaccctagaagaaaacctagacaataccattcaggacttaggcacgggcaaagacttcatgactaaaacaccaaaagcaatggcaacaaaagccaaaattgacaaatgggatctaactaaacctaagagcttctgcacagcaaaagaaaccatcatcaaagtgaacaggcaacctacagaatgggagaaagtgtttgcaatctatccatctgacaaagggctaatatccagaatctacaaagaaacaaatttacaagaaaaaaacaaacaaccccatcaaaaagtgggcaaaggatatgaacagacacttctcaaaagaagacatttttgcggccaacaaacgtgaaaaaaagctcacgatcactggtcattagaaaaatgcaaatcaaaaccacaatgtgataccatttcatgccagttagaatggtgatcattaaaaggtcaggaaacaatagatgctggagaggatgtggagaaagaggaatgcttttacactgttggtgggagtgtaaattagttcaaccattgtggaagacagtgtgtcaattcctcaaggatctagaaccagaaatgccatttgatccagcaatcccattactgggtatatacctaaaagattataaatcattctactataaagacacatgcacgtgtatgtttattgtggcactgttcacaatagcaaagacttggaactaatccaaatgtccatcaatgatagactggataaagaaaatgtggtacatatacaccatggaatactatgcagccataaaaaaggatgagttcatgtcctttgcagggacatggataaagctggaaaccatcattctcagcaaactaatacaggaacagtaaaccaaataccgcatgttctcactagtatgtgggagttgaacaatgagaacacacagacacagggaggggaacatcacacaccagggcctgtcagggggtggggggctggggagggatagcattaagagaaatacctaatgtaaatgatgggttgatgggtgcagcaaaccaccatggcatgtatatacctgtgtaacaaaccttcacattctgcacatgtatcccagaacttaaagtataataataaaaaaagtacagtctaattcattagacactgatatatatatatatatagctttgtttgctagttatttcttattgctctctgttgacccgaaactaagtcattaagcagcaggaaaagtaataagagctaattttctgttcaagtcaagaaaatgtgctacctttatagtgctttaggaagtcttcatcatcaaaaaatactaaagaatactggaagaggaaagcatttacatattaaagtggtaaaaagatagaggccaaagtctatacaagagataaaactaatcaaataacagccataactcttaagggatatgactgtctgcaaagactaacatttccttctactatttaagagaaaataaccccaaatcaaaaccagaaaattaaatgaactgaagacaatttattgcaaaatatgacaatctgtacaaactttgtgagaatggcatctctttgtactatgctccagagtttgtctaatctttcaaggatgaaatgtttacccccagttgtggttctctgagatctatgtttcttacttgattagacacaggacaaaaatctcaaaagaatcctttgagatttttttgcatttatatttgagatttacatttatatatttatatgatatatttgtatataaatctgtgcattatgtattatataaatttggcaatttagataatgtattctccttagtgatatctaaggagctatcatattcccttcttagttatcttcccaggagtgaagtgaggtgatatgaattgagcaattgaggcagattttaacagcaattcctctggatcaggactaaatatttttgttggtggtgcttgtttttattctgcatatattatatatatatatatatatatatatcattaaatttaccttttaaaatgactttaagtgtataattcagtggcattaattatattcataatgttgtacaactatcactactatctatttccaaaaccttttcatcatgccaaatacaaactcagtaactattaagcaataactctccattctcccctctgccaatactggtaacttctaatctactttttatcactatgaatttgcctatactagttatttcatataaataataaagtatttgtccttttgtgtctcactcattgcactcagcataatgatttcagggttcatccatgttgtagcacatgtcagaactttattcttttttatggctgaataataatccgtagtaagcatatacattgtgtttatagagtcatcttttgatggccactaggttgtttacaccttttcgctattatgaataatgctgtgatgaattttggaatataagtatatgtttgaatacctgtttcaaaaaacaaaaaaaaagattgtttcctgttttgaaaaactgctgcaccacattacactcctaccatcaatgtatgagaatttcggtttctccccatccttgccaacgcttgttttccttttcattttgtttatttatttcagtagatttagggggtacaagtgggttttggttaaatggatgaattgtgtagtggcgaagtctgggctttgttttttgttgttgttgtttttcagacagattctccctctgtcgccaggctggagtgcaatggcgcaatctcggctcactgcaacctccgcctcctgggtttaagcgattcttctgtctcagcctcccgagtagctgggagtacaggcgtgcccatgcccacctaatttttgtgtttttagtagagacggggtttcaccacgttggccaggttggtctccatctcttgacctcgtgatccgcccacctcaacctcccaaagtgctgggattacaggcgtgagccaccgcacccggccaaagtctgggcttttagtgtgcctatcacctgaaaaatgtacattgtacccaataggtaatgtttcatccctgacccctgcccctctctgagcctccagcgtcctttataccactctgtgtgcctgcatccccttagcttactccctcttataagtagaactaagtatttttgactaaagatttggagcgccatgctgcctccatcctcatcagaaagcaccatgttgccattcgatggaaacctttgacaatggagcaccatgctgacagacgagaaccaaaaggaggctccagggctgctgccccacgtgccatatattctgactgtatggcaggttcttgaattcactgcttcaggtcctttgaattgtaacaaatgccttcaggttacaagcccttagtttattatgacttgtgtgcttcctttttacagccctaacaaacataagactcttaatgtaaaggagatctgtagagaagcttcacttacactctaatttggagatttgtcaacatcagtgtattaatccctttcctccctccctctctcttccttctatgtgagtttatcatttgaatgtaaacatttgcctttgaactgactggataattggttcggagactctttaagcatttatttagaaagcaaagttcaggtttaatttccctacagttacatagtatagtgaggtgggaatcttcactgcatattccagctgttttgatataattagatgtttatgctatgtccacatccgcttttcccttctcacactcctctagttttccctgtaccattggtttataaatcactcccaaactgcccctccttaatcaggccaggcagaagccagcggccccatgccagcggccagcagctggagatgtggggtcgcagccacgcggcgtgacccagggtcagaaagagtgggccagagagaaccatggcccgcactgctaacttccaggacatccacaattttcattcccaggaagagtctttcctgggaaaggtacagaaatttcagttgctctagcatgtagtgggattttataatgagccaggcaggaaaataacagatggtgcactgagtgtaaatatatgaaaatacccttggagcagaaacagaaggctggcactcccaggggactcgggcgaaaacagacaagactccccgctgtctctcagctcttctaatgtttttctcacgtcttaaggcacagacaatgtctattgcatgtaacatcttatattctctcaccttagtgcaccaaatcgtgatcctcttggaggccctcccctctgatctctgtgccctctaatctccttgcttcctcctctctgctcaggtttgctttcttgggtctctcctctttcatcttagctgtttctccaggctgtttgaaggttcccacctccgttctttcttggttctggatctgtctgttagaatgactccaactccagcgctgtggctttcaccatgtttcttcactttcatgtctttttttatttataattgagcacacacacacaccacacacacactctctctctctcctatacttccttctttagaaagctttctgctgttgttgttgttttaataatctttcagatcattttatttagctttcatccatttccctcattaaagtcagttgaaagttttgtcaacatgtaatatgcatttgatataatgattttagtataataattacctgaggtaacactgtgtcagaggagaagtgtggccaattatatcttaaattacatgaacagcgctttccctttcacacagctatacatttctttaggcactaaaaatctgtaatctgtagcttccattaaattggatttagttgttttgcaaataaaattgtggaataaaaggttgtattagttactgttctccagagaatgagaatgaatagggtgtatgcatgtgtgtgtgtgtgtgtttacaatcagttgactctaagtaaagcagtggagagcaatgggtgggcctcattcaatcagtggcaggcctaagagcaaagagagatttctcaaaaaagaaggaagtttcctcaagactgcaacatggcaaagctgctcagtagactcagttagtctattgccctgcagaatttggactgaaagctgtgacatcaattctttcttaaaactctgagagattgcttgattgattttaaggaattggcttacatgattgtgggggctgacaagtccaaaatctctagggcaggccagcaggctggagactcaggacagagttaaagttgcagtcttgcatataaattctgcagggcagtagtttggaaactcaactgggtttctgtgtggaagtcttgaggagaattctttcttctttgagaaacaggctttgtttgcaatctttgctcttaaggctttcaactaattgaaagaggcacacctgtatgatggagggtaatctgctttacttaaagtctactgattataagaattaatcacacctaaaatatacctttacttcgtggcaacaacacacactgggaacgactagacaggggcaagggttgaaaaactaactgttgggtactatgctcactctccgggtgacaggataattcatggcccaaacctcaacatcaagcaatgtacccacgtaacaaacctgctcatgtacccctgaatctaaaataaaagttgaaattattaaaaagaaatattgaaggaatgatataaagattttaaatgaataaataataataccttgactggtgtttggccaaacagctgggcattctagtcctcgccaagtcaacacacaaaattaaccattacagtggtgtttccccatttgtagggagagggaaaggatcacatttaatgaaaaacatttttgtttccgaatgtatatttctaactcatttttctttgaattttcttatattttcatgtttatacagaaatacggtatattggcatttaatttagcacaaaacttgagattcgttattctaaagttttaatattttgtgatgctctacaagaaggactgtaactcccagacacaaagctacctgcaagttcaagcattgctgctttttacatgaaatgtcatggtaactggcaaggattccccaagggcctagaagtagtggaagtcagattccccttatatgcagtgtactgtatgaacatatttacatcctccaacaataggctgcctttagcagcctgtaggtttggaaaacactatttttgtttgggctccgggtccagccatttcaagcctggtaataactgcggtctccctcaccaccttcctcaccaactggaatggtgtgttggaatattttcagctgttaattacataatacctcaaaacagtgcttaaatagatatttttgtccacataaaaataatctgaaggtaggtggttccaggttagtaaagtggtcagtgatgtcaggagccgagtccacatctctctgggtctgtggcctcccttcacagtcgcatgagagctgctgtagctctaggtgtctccttacaacaccatggtgcttgaaagcaggaaacgggtgggagggaacaaaaccttcttctcatacatttcccacatttcaggtagaaaaagtttcccggaggcggaggttgcagtgagctgagatcgtgccactgcacgccagcctggcaacggagcgagactctcttaaaaaaacaaacaaaacaacaacaaaaacgaaaaatgtttcccagaatcctcggcacaggtttctgcttccacctcataggccaaattgatcacatgttcttccctagccaatgaccgggcctttctcccctgacataaggggatctctcctgtcaaatgaatacaataaggttgggttagcaagcaagaaagtgggtgtggatgccgttgaatagctgcagcaatatctaccagatgccacccctttggccgcttggcattcacactcaccctccttccacacatacacaacacatcagccctcactgcacaaatgaggcccacagcttccttcagctccaacgccatgatctcaggtgaccacctggactctctgtcaagtccaaatgttgctcctcacaaatgtctcctatagtaaagcataagccatctgtccactacatacctaagacatagaaatggagaaggaacaagttaaccctaataaagccttgtatttggcagaggggagaacaggaaatagtaaccacttgtttacagcacatatcagatactgctcagcaggaatagtgaggaccatatattctggaaatggagtaagctcctcttagctgctctgagagccctgattctttctttcagtagattttcttgtccattttaccacatggcaattttggaatgcacattggagagtaaggtcttcctaggggctgtagagattgcgcagccctcttcctattggtggaattgtggggaactgggaattgctttgaggattgaactttcacagaattctgcagccagccttggaagttctgttagcacaactccgttatcttaaaaatttagtatgcttgttgtcacagaaattaaaaaaaaaaagacatcataacttctgaccacaataaaattaaaagtaaaaataaggttttttaaggcataagaaaagtcttatgattaaaaatacactcataagtaatactaattcctgctcaagaaagaaattatgatatacatttaaaacaatagaaaaaaatggaaatataccatatatcaaaacctgtacacggcagataaggtggtatttagaggttaatttgtagccttaaataaatatctcaaaaacattatatgtagccttaaataaatgtatttaaatagtttttaaaatgaagaaaaccattcagctaaaggcactagaaaaagaacaacagcataaacttaagttttgtggtttttttttttttttggagacagggtctcactctgattgcccaggttggagtgcagtggcgtaagtttggttccctgcagcctcaacctccccaggcttctcccacctcaacctcctgagtagctaggactacaggcgcacaccaccatgcccagttaaatttttttagttttgtagagatgcagttttgctgtgttgcccaggctggtcttgagctcttggactcaagcaatccacccaccttagccttccaaagtgctgggattattacgagtgtgagccactatgcctggccaacataaactttaaaaagtagaaaataaacttaattctaaaattttaagagcagaaattactaaaaagaagaaaaaatagagattaacaaaatcaaaactgattattgaaggaaaattaataaaataggcaacattctaagaagactgagaaaaacaaaataagaaaaaatacaacattagaaattttaagagcagagatactttaagatttcaaaacgtataacgggatacgttaaaaactttatgacaatattttaaaattagattaaatggatactttaataaaaatggcaaaaatttgacaagaagaaacaaagaatctggataacataataataaagacattttatctcatcaagatgtaaataatttctattttatataaactttttcaaagaagatgaaaaaattacctatctcattgagtgaggataaatcttgctttgtaaggatagaataacactgacaaggacagtaaacgaaaagaccatatgacctactagaatataaatgaaaaaaatcgggggaatagcattaggagatatacctaatgttaaatgatgagttaatgggtgcagcacaccaacatggcacatgtatacatatgtaactaacctgcacattgtgcacatgtaccctaaaacttaaagtataataaaaagaaaaaaatcctaattaaaatattttcaaattgaattcaatagtatattaaaaatgataatacttaagtagcattttatccctataaatgaaaatctggttcaagagaagaatcctctaatgtcgtttaccacataagaaattacactggtggttgccgggtgtaaggggaggggaaatgggcagttcttcttttaaggacatagagtttcaattttggaagatgaaacagttctgaagattggttgtacaacaaggtgaacatacttaacactactgaactatatatttagaaacagttaaaatagtaagctttgttttttctaataaagctttttaagacattgcagaacaaatatataaattttatctcaatagatacagaagtgttcaataaaatcagtggtcatttataatttttttaaaattagcacatctgaactataaaggagtttccccactgtggttggctcgataacgatccccttatgtccacatcctaatccctggaacctgtgaatgtcaacttgtagggcaaaagggaccttgcaaatgtgattaagaatctcaagaaaggaagagtatcctggattagctatggggcccagtgtgattacaaggatccttagaagagggtggcatgaggagtcaaagatcagaaagagacgtgatggtggcagcgtttggagtgacgtgctttgaggatggaattccttggctgccaagggattcaggcaggcactagaagctgaaaaaggcaaccaaacagatactttcctcagagcttccagaaaaaaccagcccaacagacaccttgactttaccttagtaaagctgattttgcaatctggcctccatgactataagaaaataactgtgtgctgtttttaagtcactgttttttgtaagttgttacagcagcaaagggaaactaatacactcaatatcattgattcatttattcaacaaatatttagtacagacctgtcatgtattaagcgcttttccagactctggagatatcaaaataaacaacaaaaaaagcttcaaacaaaacagtaacaacaaattctaccctgttgcacttgtattctaatgaggaagttgagggtaaataatcacaaattagtaaaaaaaaataaagttagacaatgatcatctccaaggagaaaaataatgcagggaggagaggacgtacacatcatggtagaggaggtattgttactgaaacaccaggtgctcggtctaggctctgctgctcaccgcacagaaagccaatcactgagatgatgagtgttgccaaggaagaaggctttaattgggtgctgcagctgagaagatgggagctcagtctcaaaatccatctccctgactgaccaaaactaagggtttatatatcaggaaagaaatgtaacaacgtgtaagaagacaggaactccggaggagcaaaaaaacaatcataatgaatgagaggtggcatcccattatctggatgtgatgatctggtgagttccagttccttgatccttttcttgagaggcatgaaggttgtttccggaggaactcagataaaataaatataagtttcaagctttaagaccagagggtcaacttctatgtttatcaaaaaataaaataaactatctgtgggactattgggtcactttcagtgagatgcatttctggattgggagggtaggataggagtcaattaaaaagtgtcattggagtaacatcggaggaagtaaggagcagggccttgtatgtgtctgggataagagcactacagtcagaaaaaagtagcgagtgtgaagtttagaggcaggggcgtgggcctgtcaggtgagagaagaccagtgctggagtcaagggagccagaggagagtcccaggagatgaggtcagagaagcaaggatggctgtagaccatgccaggccccacagattgcaatgagggctgagggcacactggggaccctttgtaaggtctttttttaaaaaattattattattatactttaagttttagggtacatgtgcacaatgtgccagttagttacatatgtatacatgtgccatgctggtgtgctgcacccattaactcgtcatttaccattaggtatatctcctaatgctatccctcacccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctcaaaggacatgaacttatcattttttatggctgcatagtattccatggtgtatatgtgccacatttcttaatccagtctatcattgttggacatttgggttggttccaagtctttgctattgtgaatagtgctgcaatgaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatggcatctcattgtggttttgatttgcatgtctctgatagccagtgatgatgagcattttttcatgtgtcttttggctgcataaatgtcttcttttgagaagtgtctgttcatgtcctttgcccactttttgatggggttgtttgtttttttcttgtaaatttgtttaagttcattgtagattctggatattagcctttgtcagatgactaggttgtgaaaattttctcccattttgtaggttgcccattcactctgatggtagtttcttttgctgtgcagaagctctttactttaattagatcccatttgtcaattttggcttttgttgccatttcttttggtgttttagacatgaagtccttgcccatgcctatgtcctgaatggtaatgcctatgttttcttctagggtttttatagttttaggtctaacgtttaagtctttaatccatcttgaattaatttttgtataaggtgtaaggaagggatccagtttcagctttctacatatggctagccagttttcccagcaccatttattaaatagggaattctttccccattgcttgtttttctcaggtttgtcaaagatcagatagttgtagatatgcggtgttatttctgatggctctgttctgttccattgatctatatctctgttttggtaccactaccatgctgttttggttactgtagacttgtagtatagtttgaagtcaggtagtgtgatgcctccagctttggattgacttggtgatgcgggctcttttttggttccatatgaactttaaagtagttttttccaattctgtgaagaaagtcgttggtggcttgatggggatggcattgaatctataaattaccttgggcagtatggccattttcacgatattgattcttcctacccatgagcatggaatgttcttccatttgtttgtatcctcttctattttattgagcagtggtttgtatttctccttgaagaggtccttcacgtcccttgtaagttggattcctaagtattttattctctttgaagcaattgtgaatgggagttcactcatgatttggctctctgtttgtctgttattggcgtataagaatgcttgtgatttttgtacattgattttgtatcctgagactttgctgaagttgcttatcagcttaaggagattttgggctcagacagtggggttttctagatatacaatcatgttgtctgcaaacagggacaatttgacttcctcttttcctaattgaataccctttatttccttctcctgcctaattgccctggccagaacttccaacactatgttgaataggagtggtgagagaggacatccctgtgttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttgttggttgtgtctctgcccggctttggtaccaggatgatgctggcctcataaaatgagttagagaggattccctctttttctattgattggaatagtttcagaaggaatggtaccagttcctccttgtacctctggtagaatttggctgtgaatccatctggtcctggactctttttggttggtaagctattgattattgccacaatttcagctcctgttattggtctattcagagattcaacttcttcctggtttagtcttgggagagtgtatgtgtcgaggaatttatcaatttctagattttctagtttatctccgtagaggtgtttgtagtaatctctgatggtagtttgtatttctgtgggatcggtggtgatatcccctttatcattttttattgcatctatttgattcttctctcttttctctttattagtcttgctagcgatctatcagttttgttgatcctttaaaaaaactagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggctgttcagtttccatatagttgagcggttttgagtgagtttcttaatcccgagttctagttcgattgcactgtggtctgacagacagtttgttataatttccattcttttacatttgctgaggagagctttactttcaactatgtggtcaattttggaataggtgtggtgtggtgctgaaaaaaatgtatattctgttgatttggggtggagagttctgtagatgtttattaggtccacttggtgcagagctgagttcaattcctaggtatccttcttaactttctgtctcgttgatctgcctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctctgttggtttaaagtctgttttatcagagactaggattgcaacccctgcctttttttgttttccatttgcttggtagatcgtcctccatccttttattttgagcctatatgtgtctctgcacaagagatgggtttcctgaatacagcacactgatgggtcttgactccttatccaattcgccagtctgtgtcttttaattgggacatttagtccatttacatttaaagttaatattgttatgtgtgaatttgatcctgtcgttatgatgttagctggttattttgctcgttagttgatgcagtttcttcctagtctcgatggtctttacattttggcatgattttgtggcggctggtaccggttgttcctttccatgtttagtgcttccttcaggagctcttttagggcatgctcggtggtgacagaatctctcagcatttgcttgtctgtaaaggattttatttctccttcacttatgaagcttagtttggctggatatgaaattctgggttgaaaattcttttctttaagaatgttgaatattggcccccactctctttgggcttgtagagtttctgccaagagatccgctgttagtctgatgggcttccctttgtgggtaacgtgacctttctctctggctgcccttaacattttttcctcatttcaactttggtgaatctgacaattatgtgttttggaattgctcttctcgaagagtatctttgtggcgttttctgtatttcctgaatctgaatgttggcctgccttgctagattggggaagttctcctggataatatcctgcagagtgttttgcaacttggtttcattttccccatcactttcaggtacaccaatcagacgtagatttggtcttttcacatagtcccatatttcttggaggctttgttcgtttctttttattcttttttctctaaacttcccttctctcttcatttcattcatttcatcttccatcactgttaccctttcttccagttgatcgcatcggctcctgaggcttctgcattcttcacgtagttctcgagccttggctttcagctccatcagctcctttaagcacttctctgtattggttattctagttatacatttgtctaaatttttttcaaagttttcaacttctttgcctttggtttgaatttcctcctgtagctcagagtagttcgatcgtctgaagccttcttctctcaacttgtcaaagtcattctccatccagctttgttccgttgctggtgaggaactgcgttcctttggagtaggagaggtgttctgctttttagagttcccagtttttctgctctgttttttccccatctttgtggttttatctacttttggttcttgatgatggtgatgtacagatgggtttttggtgtggatgtcctttctgcttgttagttttccttctaacagacaggaccctcagctgcaggtctgttggagtttgctagaggttcactccagaccctgtttgcctaggtatcagcagcggtgtctgcagaacagcggattttcatgaaccgcaaatgctgctgtctgatcgttcctctggaagttttgtctcagaggagtacccggccatgtgaggtgtcagtctgcccctactggggggtgccttccagttaggctgctcgggggtcaggggtcagggacccactttaggaggcagtctgcccgttctcagatctccagctgcatgctgggagaaccactgctctcttcaaagctgtcagacggggacatttaagtctgcagaggttactgctgtctttttgtttgtctgtggcctgcccgcagaggtggagcctacagaggcaggcaggcctctttgagctgtggtgggctccacccagttcgagcttcctggctgctttgtttacctaagcaagcctgggcaatggcaggcgtccctcccccagcctcactgccgccttgcagtttgatctcagactgctgtgccagcaatcagcgagactccataggcataggaccctccgagccagttgcgggatgtaatctcctggtgcgtcatttcctgagcccgttggaaaagtgcaatattcgggtgggagtgacccgattttccaggtgccgtctgtcactcctttccttgaccaggaaagggaactccctgatcccttgcgcttcccgagtgaggcaatgcctcgccctgcttcggctggtgcacggtgtgctgcacccactgtcctgcgcccagtgtctggcactccctagtgagatgaacctggtacctcaggtggaaatgcagaaatcacccgtcttctgtgtcactcacgctgggagctgtagaccagagctgttcctattcggccatcttggctcctcccccccttgtaaggtcttgaacagaggagggataaaagataaaattcaactcctgtgttacaaacattgttctagtgctgtttaggaaatcgtctgaaagaggagaagagtgataccaggaaggccaattaggaggttaatgaaaaaacattagcccaaaatgatggtgccttagaccagggtggcagtcgtgaagacggcaaaaagtaattttgtaaatatttatataaagtagaactgccatgatttactgacaagctaatgtggcgtgtaaaagggttttggcctgggtaactgacagaatggatttgcctttagtcaagatgaagtagagtgagtttggttggggaaggatggaaaataccaggcattcagtttgaaatgcacaatttgtcattcaagtagaagtgaaaagtaggcagttggacatacaaatttaaacttctgaaaaacttaacaaactagagatataaatttaacataatcaaaaataggtagtattcaaagccaagagtgagcatacatagaagaaagaaacccgggaactcattcctggaactccaacacatcaaagtaaaggagatgaggaagaactagcaaagagagtaagaacagctggagacgcagaaagaaaagcaagagaatacagtgctctaaagtccaagaaagctcttcatgaagagtatgtgggccccatatacctgattagccacgtaaaatggggactcagcatgacccagcggtttcagtcacacggagggcagaggcaaaaatgggcagccggtataggcgcacgacggacagcacacttcatgatgacactttggaagcagcttcactgaattttcagggaaagacaaacatgccctctttcatctcttctagtcacaagtgtaccagagcttaacgacaacaacaacaaaacaggaaaaacaaatgaagtacaagaagtggatggaaagaggtaaaaactcttctctgctgtttatatgatgtctgtatacaaaatccaagataatctacagataaacacttagaaactgataagagattttaaaatgtattagattcaagattagcatgcttgaatcaaactattctaccatactaaataaaaacatactttttccattaacttcctataagcagttacgtgctggttacttgaagacaggaaaggaaagagagacacctgatatgcggtgattgctgatttccaaggtgcaacttctcctcccacagcccatttgaagctaccagtgtaatgtcactgaagcagaactgccaatagttgcacgtaactggcccttgcaaactggtgtcagcgccagcacaccactgcaaatcaactaaaatgttgaataaagaaaacatcacattcatagatgttatcaaaactacaagatctattttaaaaaactaaccaaatggcaataacatgcagagatcttttttaaaaaatgttttaaattaagaacggaatacttcagaaaaagtaatactaatggcagggaagaattgatattgttgatgccaattcaccccaaataattataatttcagcacagttataatcaaatctcaacagagaatcttcaaattcatttgaaagaggaagtggtcaaaaataattgagacagtttttaagaacaacaaggtagggtgacttgcactactaaaaaataaatccctaaatacttgatattgatgttaggatgaacaaataaaacaatgtaaccgaatagagagcccataaacagttatttttagaaacctgatatataccagatgtggtattactaattagtgtggaaagagtggcctctcaatcgatggttctgaggctattgaatttccatatgggaaaataaacaaaattcaaatttctctaagacaagaaaaaaataatccaccaagaacaaactgaacaaattgcaaaatataacaaagggtaattatctcaagtttatagggagctcttaaaatgaataaatatattaaaccaaatagaggggataaatccacgaaaaacaatagttaaagttagaaaaataaagagcctattttctttttttttttttaattccttcttaaaaaaaaacgggatacatgtatagaacgtgcaggtttgttacataggttgcgtgtgccatggtggtttgctgcacctgctgacccatcctctaagctctctcccctcacccccaccctccagcaggccctggtgtgtgtggttcccctctctgtgtccatgggttcttgttgttcaactcccacttaggagtgagaacatgcggtgttcggttttctgttcctgtgttagtttgctgaggatgatgaagagcctattttcatttaaaaaatcaaaatgtattttaaagtactcaaatccattaagaatgtttaaaactaattttaaattaacaaaatacttttatttccctatcaaaatgaaaaaaaagtaaaagactgatttttaaaaaatccataatctgtgttcaagaacttatttctccatacagtaagggcaactttacagccaaacatattttccaaacttggcagaagtataaattggcaaaacctttttggattgagatatacttacggaaatttaagtataccttctttgaccaaaaaattcaaaaagttatcctaaagaaagcagaaaaagtataaagggtcatatgtagcccatttaagtgaagaaatggaaaattctttgataaccaaaaaaactagttcatagaagttccatatagtatgatgtatttttcataaaacaaaaaaagtatgtatttgaatgacttaaaattttctagaagtaacatgcagaagtgagtatttctccatgctgaagttacggagttctgttttcttgtttatattttgctgtgctttcttaattttgcagtattactcatatattaggataaatcattttcaaaaaaataagcaaagcagacatgcacttggggtttttacaaaatattttattgacaagtattatttttaaagtattatttttaatgtattatctcccaccctaggagaaaattttgtgccctctcctaggatgggcttaactataagaatgttgcaaataaggaaaaagtgagtagtatgtaccaccactctctctattttgccaactagctcagctccccctggagtccttcatgcgcatgttcccattggatgaacctcccacgtgatgtttcttggtctctaaaccaatgagtctccgtgagtcaatatccctacatcacacacacacacacacacacacacacacacactctctctctctctctctctctctctctctcgtatgatgactcctgaatcatactgtgtattaaagttgcttattcacatgtcatcttcctggtagactataaagccccagagaataagacaaatgcactattctttttatatctcccagaaacaattaacaaaataccctgcatatactgatgtaaattacttatttgttgactaaatattgcaaggacttcataggtttaacttggactaattcatggttacggttttttgttttgttttgtttttgttttttagatggagttttgctctgtcgcccaggctggagtgcaatggtgccatcatggctcactgcaacctctgcctcccaggttcgagcaattctcctgcctcagcctcccgagtagctgggattaaagtcatgcgccaccacgctcagctaacgttgtatttttagtagagacggggtttctccatgttagtcaggctggtctcaaactcccggactcaggtgatccacccacctcggcccccccaaagtgctgggattacaggcgtgagccaccacacccggccagttactttttataaattgaaaataagtaatttttaaagaaataaaagtcctttttatttaaaaaataaataattacacaaattatgaatgacattgggttcaactacaattatatttgagaagattacatttaattgatggataaatgatctgtagtgatttatgattggaaacataagggacaccttttttcctatttttatctgtgccatagaagccaaaaatgttctttcataaaacatactttgaggcctctgttagagacagacagtaagaatgcatgaaacagggtctactctaatacatcaatttcttagttatcatgaagtattttatttgctggatacaaagagattgatgtataaactaaattgataataacagctaccatttactaaaaacctgccacgctgagtgtcttgtgttcattctctccaaccccataaaaaaccttgttgtatagtgagggaaggagcagatattctaactaagctctattaactgcaaaaccaaaactctcaaccaatagatccacttttttacagatatactaaaagcagtttagtagcaatttcagcaatgtagtcaaagtttctggtgctatgtcttcaaattttcatggatcataacacatctgcagtacagttgtgatcaaattattatatccactgcatttaccaaaaataaaatgatacacaaaaagtcctcaggaaaactattctcttgaaatatctttatagtgatgcctgggggaaaatctcgtttagctaaagtgctgtttgtaattagcatggcattcccttttacgtctaaaaatagaattacaatcatcattttaacactatatatacattggtctagcttttatattttatttggatgaaaatagaatagcaaaaaagtccatgttttctcaaaaatacttacgatgaaagctggatgtattaacacatatctagcttataaaactagctacccaatagagtataatgaaatattgttcctttatttagcaattgctttttatctaggggcacagatcactgacgaaactataagaaaacaatgcaatgcaactgctatttcagtcttgcatgtgcccgggtgtaattaacaaatgtatcatatgtaaacaattacatacttcatagtacaattccaaactcaaatctcacattttagagacctacctttagaaaagctctttcttttctttagatttgatcatactgcttcagaaacactgtaagtttcacagggaaaggattattttgcaaagttgcagatccaatacattgctttggttttacatacaaagtaagtatgggaaaatttatcatgcaaataaagaggttcaacaaaatatcatacaggtatcttctattcatttttgtccagcactttgtaatttgagtgacacgtcctggccaggcaatgcactatgtggcaagagtgtagattcaggaactagatcatctggatatcacgcagcttcatgacaagcacattggtctccaggactgcattgtgggtgaccctaataaacttactcagatatttgaatagcttctctattgtttgatagagaaaaaagaatggctggacataacaccaatttttgattaccaaagctacaattctttgttttgggttttcttgagacagggtctcactctgtcgccagctagaatgcagtggcacaatcccagctcagtgcagcctcaacctccagggctcaagtgatcctcccacctcagcctcctgagtaactgggactacagatgtacaccaccacgcccaggtaatttttaaatttttttgtagagataagagtctcactatgttgctcaggctggtctcacacacctgggttcaagcagtctccctccttggcccctcaaagtgctgggactacagatgtgaaccgtcgtgcctggcccaaagaattacaaatcttaacctttatccgaagtctaatgaatttgatataatgctttattgaggataaaagaattaatttcagctaattatcttcaaaaaggatttttatttaaaaattctgtccttgcatacattttctggacataagctaggacatcatttcggtctgattttggttacaaagtgcacaggcgccgcttcaatctgctaatcaagctttaatgtgtcgtgttatgttgctctcaaattgtgaacatacggtagtttataaataaacgtctcaaggacttagtttctgaagattacggagctggaagagctactcagagaaactgaaataccttctaaaatgtattttcaagtttcttcttaaatcttcaaattggattattagagagaaagcatgaatagatctgcttcttccctttggggattgagagaggtttcgtgtctttaagaagcctcttgaaatatacagatttatttaatatatgtcagaatctagagagaattatgatatcaaatgctttttcggaaatgcagtgtatataatagagaatatgatattgttttctgaacttctttcctacatcctacgatattcaaagagtaattcagcatggcctccagccctgcagctcatccctgtgcgttttggattcaaggactccagcctgcagtggccaacaggaaatacagtaattgtgatcttgctctttgaagatgggatgataattatcacagaactcataggaaatgtcttttttgctctatagactgtgagattatgcatatcttttagtagtttattccctgaatccttaaaaattaatttaagtttaccatcagattttagattttcctctattcctacctttggttatgacatcagttttgtgaacaaagtaaactcaatacattataaaatgctgaagtaacatatcattttccctaaggcttacctcttttatttgatttaaggaaaatttcttattttctgtgggggcttagtgcattgatgtggagaaattcatccttcttggtttttgtattcttttttttttttttttttgagacggagtttcactcttgttgcccaggctggagtgcagtggcgtggtctcggctcactgcaacctgcgcctcctggattcaagcgattctcttgccccaggtttttgtattcttaaaggccaaaacatatgtctggatggcctcatgctcatctgtgcacaccatggcagaacccagtacattgttttgtttacatccccccaaaatagtgaaaaaaatgaagcaccaccatttttatcttgagcacctcttcactgttcttaacgcatttgggcggtagcagaaaagatcattccccaaaaccttgctaagcacgttgtccaggtggggagagtattactgctcagttttccagttacaggtgctctagtatctttcttctaatttaggcatcactggcaacaatcaacttgtcagatttatatagtagatgaaaatggaaaagagaaaaatcgagtccaaggctgcttttattctgaagtttaaatggcagctattatcatttcatgtagcccattatgtaggaatgatgtctaggactgtacagtttcatcatgagtttccatgagcttcttttcatttttacatcttttattttaatcagtgggaaatcacgatattagagattccactggtgccctgaaagacatgctttgtgaaatttttgtttcaaaacattatttcaaaataaataatgtatacttaattcagcaccaggacccatgattagatgcaaatgagatgacatgaaatatctttactgtgctatttacattcatatatgtttacttgtactttaaatcctataacaaaattatgtaagtaaacccaaagtataatgtttagagaaaattagttcttcacacttcaatatttatgaagtacaactttttgtaaacatggaaaattgaaaaatgtcattgaaattaacctgtagaataatatggattaaataaatgctattgctgttcctctgactttaaaaaatcaaaagcactttctagattaatctgagtaatcacaggccgcttaaagtagccaggaatataaagtggaacaaccaacctcagttccctgcatccgaaggtttagacctattttagttcatctcacgctgctacaacgaaattccacagactaggtaatttataatgagcagaaatttatttggctcaaagttttggagtctgggaagtccacaattgagaaaatgcatctgcatctggtgagggacttctgttgtgtcataacatggcagaaagcatcacgtggggagagagaggaggaggccaaactcatccttttacaaggaactaactcctgaaacagtggcatcaatccattcatgagagggaagccctcatgacctaaccatctgtgatggtcccacttttccacactgctggattgaggattatgtttctaacccgtgaaccttgggtgacgcatttaaaccctagcaacaccctagctgattcacagatatttatgctaaagcctagttgatacagtttgatatttgttccctcaaaatcccacgttgaaatgtgatccccaatgttggaagtgcagtctagtgggaggtatttggttcatgggagtggattcctcagaatggcttgatgccctccctatagtaatgagtttacacaagagctggttgctcaaaacatcctgacatctctcttgcttcctccctcaccgtgtgacacatctgctcctccttcgccttccaccataagcggaagcttccggaagcctcaccagaagctgagcagatgctggagccatgcttgtacagcctgcagaactgtgagccaaataaacttcttttctttaaaaattacccagcctcaggtattactgtgtaggaatgcaaatggactaacacactagttattttcagatatttgtaagtattatcatccttcatccaaatacaatttttaacatattttaaatgaaaataatttaagaaatatggagctggatagtaaaagagaaaaaaatgttatcttaatataattttagtgggtttatacatcaaacattaagtgggagaggtctttaagcacttgcacaaggctgaaaaacaaggaaaaggaagttacctcgtagatgtctaacagagatgcagaactgatctgcagcagcagttaggacaaaggcaatcatatatggaaaagcagataatatgatttttaaagctttgagacatttccaatttggagtaacagaatgttagccagcacgtgccaatacagccttgccagttacttattgctgacattcattctgattagcccattattagcctgagctgagctgattagtgtagtttacatctccctgggttaactacagcccatcctcattatttgcagattccagatttatgaatttgcctgctcactaaaatggatttgtaaccctcaaatcaatactcccaagtgctttcctggtcatttatggacatgcacagagaggggaaattatttatttatttatttatttcaataggttttgggggaacaggtggtgtttggttacacgcataagttctttagtgatgatttctgagattttggtgtacccatcacgcgagcagtgtacactgtacccaacgtgtaatattttatccctcactcctctcccaccctttccccaagtccccaaagtccattgtatcattcttatgtttttgcatcctcatagtttagctgccacttatgaatgagaacatacaatgtttggttttccattcctgagttattcacttagaataatggtctccaattccatccaggtttattttgttcgtttttatggctgaatagtattccatggtatatatttataccacaatttcttttttattattattattattatactttaagttttagggtacatgtgcacaatatgctggttagttacataggtatacatgtgccatgctggtgtgctgcacccattagctcgtcatttagcattaggtatatctcctaatgctatccctcccccttcccccaaccccacaacagtccccagagtgtgatgttccccttcctgtgtccatgtgttctcattgttcaattcccatctatgagtgagaacatgcgttgtttggttttttgtccttgagatagtttactgagaatgatgatttcccatttcacccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatgtataccacaatttctttatccacttgttaattgatgggcatttgggctggttccatatttttgtgattgtgaattgtgcttctataaacatgcatgtgcaagtatcttttttcctgtgatgacttactttcctctaggtagatagccagtagtgggattgctggatcaaatggtatttctacttttagaactcagttctttaaggaatctccacactgttttccatagtggttctgctagtttacattcccaccagcagtgtaagtgttccattttcaccacatccataccaacatctatttttttttaattttttgattgtggccattcttgcaggagtgattttgatttgtattgtggttttgatttgtatttccctgataattagtgatgttgaacattttttcatatgtttgttggccatttgtgtatcttcttttgagaattgtctattcatgtccttagcccactttttgatgggattattgcatcgttaggcaacttcattattgtgcaaacatcatagagcgtactacgcaaacctagatggtatagcataatacacacctgggctatctagtaaaatctattgcttctaggccacaaacctgtacagcatgtgactgtactgaacactataggcaattgtaacatagtggtatttgtgtatctaagcatatgtaaacatagaaaaggtacagtaaaaatatggtataaaagataaaaaatggtacacctgcatagggcacttaccgtgaatgaaggttgcaagattgaaagttgctcttggtgagttgatgaccagtgaatgaatgtgaaggcgtaagatgttactgtgcactactgtagactttataagcactgtacacttagactatactaaatttattttttaaatttcttacctcaaaaatagattaaccttagtttactgtatcttttttacttataaacttcttaattgttttaagctttgactcttctgtaaaaacacttagcttaaaacagaaacatattgttcggctgtacaaaaatattttctatctttgtatccttattctataggcttttgtctgtgttcaacctttttttctacttttaaaattaaaaaaaaagctaagacatatgcacacacattagcctaggcctacaggaggtcaggatcatcaacatcactgtcttccacctccacatcatgtctcactggaaggtcttcaggggaagtaacatgcatgaagctgtcatctcctatggtaacaatgccttctgctgcatacctcctgaaggacctgcctgaggctgttttacagttcactctttttaacataagtagaaagagtacattctgaaatgacaataaaaatttagcatagtaaaatacataaaccagtaatttagtcatttgtacatgtttgtacgtgctagtctttaaatgactgggagcacagtaggtttctttacaccacatcaccacaaacacaggactaatgcattgtgctaagacactatgatggctacgatgtcactaggcaacagaaatttttctgcaccattataatattacggaaacaccatcatatatgtggtccgttgatgatcaaaacacattaccggcacatgactgtatgtataagtacaaattggataaaatatatgtaactttattctatctaaaattatttcccagagtaatgctaagtatttttaaaataatgttctttcacattaaaagtcaatgaatttttgtggtttttgttttttgctaataataattttttttaatttctaacttttaagttcagaggtacatgtgcaggatgggcaggtttgttacataggtaaacatgtgtcatggtggtttgttgtacagattatttcctcacccaggtattaagcctagtacccattagttattttccctgatcatctccctcctcccactgtccgccctcccatgggccccagtgtgtgttggttcctcctatgtatccatgtgttctaatcattcagctcccacttacaagtgagaacatgcagtgtttggttttctgttcctgtattaacttgctaaggataatggcctctagttccatccatgtccctgcaaaggacatgatccccttcttttttatggctgcataatattccatggtatatatgtacattttctttattcagtatatcattgatgggcatttaggttgattccatgtctttgctgttgtgaatagtgctgcattgaacatacacatgcatatgtctttacaatagaatggtttatattcctttgggtatgtacccagtaatgggattgcttggtcaaatagtatttttctctctaggtctttgaggaattgccacactgtcttcaacaacggttgaactaatttacactcccaccaacaatgtaaaagcattcctttttctccacaaccttgccaacatctgttgttttttgactttttaataaacgccattctgactgtcaagagatggtatctcattgtggttttgatgtgcatttctctaatgatcagtgaatgttgagctttttttcatgtgtctgtttgccacatgtatgtcttcttttgagaattgtctcttcatgtcctttgcctacttattaatggagtttttttccttataaatttgtttaagttccttatagatgctagatattagacctttgtcagatgcatagattgtgaaaaatttctcccattttgtaggttgtctgtttactctgttgatagtttcttttgctgtgcagaagctctttagtttaattagattccatttgtcaatttttgcttttgttgtaattgcttttggtgtcttcaacataaaatcttttcctgtgcctatgtccggtatagtattgcctagattttcttctagggtttttattgtcttgagttttacatttaagtctttaatgcatcttgagttgacttttgtatatggtacccagtttcaattttctgcatatagctagccagttctcccagcaccatttattaaatagggaatcctttccccattgcttgtttttgtcaggtttgtcaaagaccagatggttacaggtgtgcagtcttatatctgggcactctatgctgttccattggtctgtgtgtctgtttttgcaccagtgccatgccatttgggttactgtagcactgtaatatagtcaggtagcatgatgcctccagctttattctttttgcttaggattgccttggttattcaggctcttctttggttctatatgaattttaaaatacatttttcttttttttattatactttaagttttagggtacacgtgcacaatgtgcaggtttgttatatatgtatacatgttccatgttggtgtgctgcacccattaactcatcatttagcattaggtatatctcctaatgctatccctcccctctccccgcaccccacaacaagccccgttgtgtgatgttccccttcctgtgtccatgtgttctcattgttcaattcccacctgtgagtgagaacatgcggtgtctggttttttgtccttgcgatagtttgctgacaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggcatctcattgtggttttgatgtgcatctctctgatggccagtgatgatgagcattttttcatgtgtcttttggctgcataaatgtcttcttttaagaagtgtctgttcatatcctttgcccactttttgatgtggttgtttttttcttgtaaatttgtttgagttcattgtagattctggatattagccctttgtcagatgagaagattgcaaaaattttctcccattctgtaggttgcctgttcactctgatggtagtttcttttgctgtgcagaagctctttgacaaacctgacaaaaacaagaaatggggaaacgattccctatttaataaatggtgctgggaaaactggctagccatatggagaaagctgaaactggatcccttccttacaccttatacaaaaattaattcaagatggattgaagacttaaatgttagacctaaaaccataaaaaccctagaagaaaacctaggcattaccattcaggacacaggcatgggcaaagacttcatgtctaaaacaccaaaagcaatggcaacaaaagccaaaattgacaaatgggagctaattaaattaaaatacatttttctaactgtgtgaagaatgtcaaaggtagtttaatagaaacagcattggaattagaaatagaaatctataaattgctttgggcagtttggctgtttacacgatattgattttttcctatccaagcatgaaatgtttttccgtttgtttgtgtcctctctgatttcctttaacaggggtttatagttctccttgaaaaggttcttcacttcccttgttagctgtattcctaggtatttgattctctttgtagcaattgtaaatggaagttcattcttgatttggctctctgcatgccttctattggtgtataggaatgccagtgatttttgcatattgattttgtatcctgagactttgctgaagtggcttatcagtttaagaagctttgggactgagacgatggggttttctggatacagaatcatgtcatctgcaaacaaagataatttgacttcctcccttcctatctgaatgccctttatttctttctcgtgcctgatcgttctggccagaacttccaatactatgttgaataggaggggtgagagagggcatccttgtcttctgctggttttcaagggggatgctttcagcttttgcccatccagtatgatattggctgtgggtttgtcatttatggctcttattattttgaggtatgttccttcaatatctagtttattgagagtttttaacatgaagaaatattgaattgtatcaaaggctttttctgcatctactgagataatcatgtggtttatgtctttagttctgtttatgtgatgaatgacatttattgatttgcatatattgagccaaccttgcatcccagggatgaagcctacctgattgtgatagacaagctttttgctgtgctgctggattgtttgccaatattttgttgagaatttttgcgtcgatgttcatcaggttattggtctaaaattttctttttttgttgtatctctgccaggttttggtgtcaggatgatgctggcctcagaatgagttagggaagagtccctccttttcaataataatttttattagtttaactatttccacttcctcttttcctccccccggtaacttgtaggcatacacattatcttgacttctcaagacacgatctcagaattctccattcatcagtctgcaagaactctttgcaacaaaaccatttaaagtctaccagagcctaggtctctggagcattttgtttgcagttgtttataaccaacttccagaaacactgaatgtcaattgcagtatactttgaaaagaagttatttgtcactatagatttcttaccaaatttagtttgttgcaacggaaaggccttttattttaggtgaaaaatgacttctgatttgatttagtcaaagttttaatttaggttttctagtttcattttctttttcctcttctctaatcttataaaaaatatcccactactgcaaaatgtgcctgcttgctataaacaaaagcaggctctaatagagtaaaaagttacaaacatactaagatgtctaattaagatacttattgtaaaattggaaaaaatatttataaaaatagagaattttaaaaaatcgaattgccaagcatttctaagtactcacaattctacattgcacaggagatgtttcactcctgtaactaaattttaaacaaaagaaatgagcttttaatcttgggcacctagaaatagttattaatatagaaaaatacaaagttctataacacggaaccaatatgatatatatggttattggtcttatgttagatcttaagataaaactttttcaaatagatattcaaacagtacaatacactgaaaatttttctaaaaccttttctatttacataacattttatttctgaaagcaaacacacatgccaaaaaggctgagtttaccaaggttacaaaatgaatcagtgaaaggacgaggaatataatttaaatctcagattttgtggtagtatctaatagactcctcatttccattaatttcctaaaatatagtattgttttatagagaaagcaaaagcatttcacattttttctgcagtaagctgttagagtgtaatatctttggagatcaagactccgcattgctcttctaggtgtctacatgaaaaataactgattccactaaagagtagagaggaaaaacaaaactggaatcaagcaaatatgaggacttacaaacatacaaaaggtttatttttaaattcactaagaacactaaacgtgtttctgattctcaattttaaattttgtttttgttccaacaattccaactggattttacacaattggatttaatccaaaactctatttccatttaatagcacggaaactggacctgatatttgtttaaaaggaggccttggcctccttacattaccctttcattgattcacagccttgcactcagaaagtgtataccacaaaatggagatatcccagcaagaacagagagagagagaggagaagggttggggagctggtgtgtcctgtccccttgctgctgacagtgactgtcatacagacaggactcaactctctgtccatttgtctcttttcaccaacctttgccttcaaggccattaaactccctctattcacttagcttcaccaccaccaactcaatgcctatgtcagctatctattgctgtgccacacattaccacgccttggtggcttcagacagcacacattcattatcacaggtttctatggttggaaatctggacgccacttagctgcctcctcggcttcagcgtctcttacaaggctgccatcacagtgtcgacggtgctgctgtctcatctgagggtcacctccaagctcacgggggttttggcaggcttcagttcctcgcagactatcagactgaggacctcaggcccttgctggctgctgcccagcagctgccattggttcttgctatgtgggcttcttgctatggcagcattactctatctgagccagcatgggagagcggcaatagggagagtggcacagtaaggcaagagttaaaatcttatgtgacataatcacggaagtgacatgctaccacctttgctgtactcttatggttagaaacaagtcacaggtgccacccacagctatgggaaggggatcagaccagggtgtgaataccaggaggcagagatcactggggacatcttcgagcctatctaccaggaggcttgagctcaggcccaggtctattggccctagaccagcaatccattatttcagccttaaatcagattcttagaacttcattttggtgataaactagtttactgtttttgttttttcgttgttgttttttgtttttttttggcttgatacctggttccaagagcaccgtgtcccagccttgctcttgatagcggaatacttgcctgcaaatgtttccccctattttctgaatgtatcactccttcatttctcctcgccgtatgttctgttttgggccccggcatgaatacactgcctctcatgcacatttgcagactgcccactgctgaatctcccgcgaggtttttcgacaactggttagttgaatactctgaaaatacgctagtatctttggctaatagtgcttgtagcacatctctatggaccccacagactaacagctgcttttcaatcctgatacgtatttctttgcacagatttcctaaataaacaagtcttattcacatattgtgacacttgccattctcctgacttttaggtcggcctggtttcctgaccttaacttgttctttctgacccaccctgacagtgcctgagctggggctctgatacatgtttaattgccagcaaaaccctttatctcttataaatccctctccagttcgagttccatatctaatcacaacattcacaaggatttaagaaaatacaactacttattgaagcacaaatctataatgatggagaaaataggctttcaaagaaagtatgtttttatactaaatatttaaaactgtcaaactacttattctggaggtttctattttttaacagacaggtcaagtagaagaaaaggcgattctctaaagaacattattccaaaaagtacatctctgtttaaatcatgtttttgctctttcctgtgcctcagataacctcctgtgtcatccatttttacatgtcaaaagcccatctacacttgaggtccatttcactggatacttcctccttggagttttctctgatcaccctaacccaacacagtgagtcccctctctaaacccccaaacaatactcatactggtcgtggggtatgtcatacatactactttttatattctcctttcatgatcctgatgggttgtaaatgtctgtataccaaaaacaatgtatttcttttttttttttttaatactttaagttctagggtacaggtgcacaacgtgcaggtttgttacatatgtatacatgtgccatgttggtttgctacacccattaacttgtcatttgcaataggtatttctcttaatgccatccatccctccccactcccgccaccccacaacaggccccaatgtgcacacgtatgtttattgcggcactattcacaatagcaaagacttggaatcaacccaaatgtcacatatacaccatggaatactgtgcagccataaaaaagatgagttcatgtcctttgtagggacatggacgaagctggaaaccatcattctaagcagactatcgcaaggacagaaaaccaaacaccacatgttctcataggtgggaactgaacaatgaaaacacttggacacagggcagggaacaaaacaacgtatttcttacttttctactcattgagatagattcagtgtcaacatatttttagtaaatttatatgagtaacatagtaatactcaaagttttattatgaatagacaatacccgctttaggagacagagttgaaatctttaatatcatatgtaatttcattaaagatctaaatgtctaatatcttatgtgatgttagtatttattaaatgatattagaaataaactgcaaaactcattttttgaaatatttaccacagttaaatatatcatagataataaatacattttcattttctttgccttgtatcttcctatttcttagtaatctaccagtttaatttgggcatatctgtacccctaaaataaaaaatgttgcatttttgtatgtggatacattaattcaaagtatagtagcacttgaaataccttgaaggtcttaaagcatcacaaagctgaacgttagaatcagtatctgatctgaataaagatgacctctctatggctgcagcatcagctgcaaaagcctcaccaagggggtctgcaggaaatgcggagggcagtggggtgccccagctggatcctacttgccaggaggcactatctctctggtagctgggagtactgatagaacagggctctcagctgtcagtcctctttgaggattgcttcagctaaagaatactgcttcacccaagcccacagctactgactaaccaacatacttactctgtggggcaactctgaaaggtcattctggctccagagctctctgtagattaggctaagtccttcactggatcttcatttcagctcaactgtgggccagtcttgctttcatctcctccctcctacaggtgttaatcctaaaattatttcctaataaacaccctgcttaaaaattttcatctcagagtctgttccccaaagaacttaacttgcagcaaacactagggttgctcttgggagaagagaggatttccacaaagagataaaatgattattctttgctgtttctacctagagaaggttttttccaacctttggtactattgatgttatgagctggataattatttgctgttaagggctaccctgtgcattgtaggatattgagtagcatccctggcctctaccactagatgctagtagcacacgtgcatatgtgtgcacacaagcgtgcacgcacacacacacaacccatgtgacaaaaatgtctgcagatattgccaaatgtcccccgaagggcaaaatcctccattgagaatgtctgccctaggactaattctggcgataggagaacaacaagcaatgaaagaagctggtgcctcccagatgccaggggtagcagttgacaggacacaggtaagcggaggcccggcacaggcagtcaggaacaccttcctccgccacccagcccttgactgcacccccacacctcaccactgggttagctgtgaagagctgagactccataatttggaactagaggtcagtcgatcattttggggggtgcactgtcatgtatggaacgtctttcatcctgctcaatgcatattcactatttataggcttctgaaaggtgtcacattctcttcagtctttgatgaaaagcaggattctccaattccacagagaagctgtaggttttagttgtttttttttcctcttcaaattcttgaagtgccagtgttcttaaaggctttcctgatctgctttaaatgtcctgggtatgcatttaagtaagagagacacttccttcacatataatctcttcaattgcaggggaagctagggtattgggattctagagaatttccttcactcttgaattcctcgatttacatagaaaaagctggagttgggggaaatgagatgtacaattgaggcagaaggaagtatcagagctatacaggaaccagcataaacagaatatctgtaagttgggacatattcaaaatactatcactaagtgctccaattaccactactactattattgtcacatttccatccacatactttttttccttcttttttctgttttttaatggaagtatgattgatatatgaaaaagcagtatatatttaatgtatacatcctgatgagtttggagataagtacatatctgaaatcatcaacagaagcactgccgtaacgttacccgtcactggcccaggttcctgcctccctctctttttgtgtatataataagaacatctaacataaagtctaccctcttcataaatgtttacatatataatatggttttgttaactatatgctctatgctgtgccgatctccacacttattcatcctgcgtcagtcaccctagggacgcttagattgacatctatctgctgcccactccccccagccatggtacccaccattcgactctctgtttctatgaatttgactattttagactcgtgacataaatgggatcatgtactatttgtcattttgtgcctagcttatttcctttagtgtcctccaagttcatctatgttacaacaaatggcaggatctctctttttttttttttttttttttgagacagactttcactcttgttgcccaggctggagtgcaatggtgcgatcttggctcaccgcaatctccacctcctggttcaagcgattctcctgcctcagcctcctgagtagctgggatttttttttacaggtctgcaccaccacgcccggctaatttttgtatttttagtagagatgtgatttctccatgttggtcaggctggtctcaaactcccgacctcaggtgatccacccgcctcggcctcccaaagtgctgggattacaggcatgagccaccacacccagccttttttttctttttaatttcaacttttattttagactcagggggtaaatgttcaggtttgttacactggtatattgcctgatgctgaggtctgcggtattaatgatccatgagcatagtaactgctagtttttcagccctcactccccttcctccctttctttttctggagtccccagtgtctgtgtttgtcatctttatgttcacaagtgtccagtgtttagcgcctacttataagagagaacatgtggtatttggttttctgttcctgcatttgttcacttaggataatggcacccagatgcatccatgttgctgcaaaagacatgatttcattcttttttatggctgtgtagtgctctatggtgtgtaggcaccacattttctttgtccaatccactgtgcatgggcacctacgttgattccatgtctttgctattgtgaatagtgctgcaaagaacatacctggcatgtgtctttatagtagaatgatgtattttcctttcgctgtacacccagtaatgggattgctaggttgaatggtagccatgttttatgttatttgagaaacatccaaactgctttccacagtggctgaactaatttacattcccaccaagagcatataaatgttcccttttctccacagcctcaccagcatctgctattttttgactttttagtaatagccattctgactggtgtgagatggtgtctcattgtggttttggtttgtatttctctgacgataagtaatgttgagcagtttttcatgtttgttggccatttgtatgtcttcttttgggaagtgtctgttcatgttctttgcccactttttaatggggttgttttttgcttgttcacttgtttaagttccttatggattctggatattagatctttattggatacagtttgtgaatattttcccccattttgtagggtgtatgttagctctgttgataatttcttttgctgtgcagaagctctttagttaggtcccacttaccaatttttgtttttgttgtagttgtttttgggatcttagccataaattccttgccaaggctggtgtccaaaatggtgtttcctaggttttcttctagattttttaaaagcttgaggtcttacatttaaattcttgctccatcttgagttaatttttgcatacgctgaaaagtaggagtccgggtttaatcttctgcatttggttagccagttatcccagcaccatttactgaataggaagtcctttccccattgcttattttagtcaactttgtcaatggtcagatggttgtcgttgtgcagctttatttctgggccctctatactattacaattggtctatgtatctgttttttgtatcagtactatcctgttttgattactgtagccttatagtatagtttgaaatcagataatgtgatgcctccagctttactctttttgcttagggttattttggctattttggctattttttggttccatatgagttttagaatagtttttttctaattctgtgaaggatggcattggtagtttgataggagtagtgctgaatctgtagactgctttaggcagtaggccattttaatgatattaattctgccaatccatgagcatggaatgtttttgcatttgtttgtgtcatctatgatttctttagtagtgttttgtagttctccttgtagaaatctttcacttccttagttagaggtattcccaagtttttttttgtagctattgtaaatgggactgcattcttgatttgactctcagcttgaatcttattggtgtatacaaatactcctgttttttatatatactacattttctttatttcatcttttcatggacatttagattgtttctatgtctttgctactgtaaataatgctacaatcaacgtgagagtgcagatatatcttcaagatcctgatttcaattttgggaggtttatactcaaaagtgggatggctggatcatatggtagttctatattaaattttttaggaacctccatattgttttcaatagttaatgtactaatttacatttccaccagtgtacaagagtgcccctttctccgtatccccaccaacacttgttgttttttgtttttttgtgaatagccatcctgacagatatgagatgatgtcttgtggctttgatttgcatttccatccacatattttttaagaataaatagaaaaaggaggtgcttttatatatgtgtgtgtcacaaaaggattatatgcaaaccaactgcaaaatacaaatgctgcatttcagcactgtctttaacctttgtcttaatttttgaatttaagattttacaatagctataatttattttctgttaaccaacttaatttttacatgcttactaatgcacctttgtatcatagtgtttagcattagcaacactgtgggagaagaggcagagaaaatatccatgaaatacaggtaatctttaattttatgagacagtttcttcccatgaagaatttataactttctcagctctaatcaaattccctgccacaggagcacgttctaattagagccatctgctcctagcaggatattcatcccaggccaatgtatggtgaaacattctaatccattttaagcatctaatttgtttctgcactaaaattctaggcaaagagcagctggatgtcattggagacttttcctgcacaatgagggcaaggaaagttaaaacagaaattcactgagtggaaaccacggatctgtaattaggaaatattaatctaggacatgcagtgataaaaatcaatgaccagctgctcatatcatgcttattgaagtagttgaccctagaaaaactactaccatctcatttgttcataggcttttcgccactcctttttttggatcaagagacatggatttattcatccatccactcatttattcattcacactaccaccattgacaatttttgagcaaggcactgtgctttgtgctaaagacaatgggtacagatgtaagtcactgatctggttttcaaaagttgatagacagtgtaaaataatttcaagagtgttttaaaaggtcattttaaaacttatcttgggggcagaaaggaaataatgtatgcaatagtctatttttgttcctaccatacatatagcaattaagtgtaagtattatattattccctccagaacttgtatattattacataattacaagaattgagatatctcagatactttgtaaggatggtacatctttgacatagttgtttatattcaaatgccaccatgaaactcagagtagatacaggagctataaaaggagaaaaaaaaagactattcaaatttccattaattggaaatgattttaaaggaaaatgtaaaataccaattcaggtgtcaatgaatgactcctaggggacaagttaacacacacagacacacacacacacacacacacacacacaatcagaagctacctcctgttagagtctatttttctattggattttaaaatttctactttaagtcacaattaaatgcaaatacttaacagaactgttcttgagctcttcattgctaatagcctctgctgattttgccctcttcttctctacccctttgcttcagctccagtttcccaaatttctgtgacggggtgaaagagtacactgagagagagaaaaacaccacacctccggaagacaaagggatgcaatcacctgatccagaggagattatttctttaaaaaaaaaaaaaaagtcacacacacacacacacacacacacacacacatgcgaagctttgcatactgaagtgaacaccaacagtttcagatttcaaaacgaatggacccatgtgcacacgggcacatagacatacacacacacacacacacacacacacacacacgacatgatttatttcagcagagcatcagaatgcaataataaccaaaaaggtatcatatattttacaattattctctattaaatgtggaaccaagattaagctctagtgacaaaaaaaaaaaaaaaaaaaatcctagacccaggaccagagcagctggtggctacaggtaatgtcactgaagtggttcagctatgacagaggctcaggtgtagactgctgagcagaaacatccttgtgggtacagacgcgcttccactggtccgcaaagaaacacaatccaccaatttcaaatgcaagttcatcctggaagcaaacctcagaactacactgatgacataatcgatgcccacattaagaatggaggcccagcactaaaggaaagctgtctctaaacaagtcatcacagaagcatatctgtgattattgccagtaatactttgtcagccttaattcatcctttctatcacaagagcctatagtaagagacttagcctgtaaacagttgactctgagctcatttcaaatcagcaacacataggcgagagttataaataatgcatgcagtgatgctgcagaatggtttgggtgcatgcagaatgaatgaccgtgttgcatacgtcttaaaaagtgtcgatttacttttgttcacaactggatagtggctaagcatagacatttgtataaatattcgccaagacgagtcttccaacaaaccatactaattaggatgctgtaaaataatcgcaaaccaaaagactgctgaatagtttacaggtagggcatatgtgggccctaggacaatgtatattctatttggcatattcatcatggatttagaactaatagagatcctatctttttagtgcctgaagtggctaaaaaatatcttcttaagtggccaagcgtggtggctcatgcctgtaatcccagctctgtgagaggccaaggtgggaggatcccttgaggccaggagttggagagcagtctaggcaacatagcaagaccccgtctctacaaaaaaaataagaaaattatccaggcatgatggtacgtgcctgtaatcacagctattcaggaaactgatgcaggaggatcacttgagcccagaagttcaatgcttcagtgagctatgatcacatattttatacataaaatatgacatattttatattcgaggatatatataatatatatcttttagttatcttgatgggaatgggtggtttatacttcccaaaacccaataagatatttaaacatgttttttcatgctgaagttatttatttactgccatgttcaggaaagtatgatggaaaagaaataaagagaagaggagaaataactatctttaaactgcctcccaagattcacagataagctatacaaaaactctaagctctggcctatcaacgttgttggtgtttggggatcctttttcaccagctctactttaagcttctattaagcttgccaaattgatttcagatttgttatacgcctggcacagcaggcactatttaaaatgtatgttcctggcagctgaggtggggcagtgccgtccagtctcaacgtcagctggccttgtttggcaccttcatcacatgtacatgctcctattaatctactgtctaacaaagatctggaaaagcctagtatcttcccatattaaagccagatcattaaagaaataccacttgagattgtatagaagggcaagaaaataattcttaatttctaaaccaaattggtttcatagaaattctgcctttggctgatcacttcactttagtagagcaaagcaataaatttttatcccttttcactgaaacccttggttatctctgcaccagggaagaaaataatgtcttctattaagattaatattgttatgggaatattactatgattattattataaattcacctccatctttgcttgtttgcttgtttggtttgcttctttcttctttgaatacaccatacctgaggaagcagaatcacatggctgatgatatcaaactggcttaatgtaattatggactagttgtgaataaaaatatgtactgaccgcttattatgtgaatagcactgtgttaggtaaataatgtttttcttttacccaatggggaaatgatctcttcccacaaagagtccagtgattaggttgggtaagaaagccatagccatgaaagaattaatgaacagaagtgtgctctagtgcagagtcatttctactgaaagcatcagagaggcttcgcagaaagattggaacttgaggtgagtcaggaagtttcataaaagatggataagtaggccaggcgcagtgcctcacgcctggaatcccagcactttgggaggccacggcgggcggatcacgaggtcaggagatcgagaccatcccggctaacacagtgaaaccccgtctctactaaaaatacaaaaaaaattatccgggcgtggtggcgggcgcctgtggtcccagctactcgggaggctgaggcaggagaatggcgggaacccgggaggcggagcctgcagtgagccgagatcgcgccactgcactccagcctgggcgacagagccagactccgtctcaaaacaaaacaaaaagaaagatggataagtagacagaggaaggaggagctggcttggcaccaagtctaaggtatgaaagaacatggtttgtaatataggaaagcacaatctatttataatacacacatacttaaatatttaaaattgattcaacaggttaaagaccaggctttgccaagagtagataccagtattcctatggtttggtctttcaacgagtagactctttgaagtgtttcaatatattgtatttcccaccgatggagtttaaaaagaaagggaaagaaaaacagtgcaaatcgattcctgctgacaacaacacctacacgttgctctttgggagtaactgttttccaagttgtaattaggatcttttgtccattctacgtaaggtatggtaacatcacaaatacaaaactgcagtggattttatattttaaaatataaataatgaattagatgtcatgatgaccagctgcttagctgattttaccactcatggctatttgaccgggttcagaagggcaagagccattaacaagggtaattacctcctgcgcctctctcctcttccgcagaccctggcctgtaataggtgccattccaggcactccctcagtgctgaatgaatacataaatgaatgaattgtagatatggcttcagataataaggaaattcaaactactgcatgctctttgcccaaaatgactgtgtggaaagaaaataaatactgcttctattaagatattccttcattataggaggtcatatgagaaggttgggagaagaagggagaacgatagtaataacaagggatttctcttcatctttaatgctaaggatcaaagacctttctcctatttgaggctgactgcatttgcattgtacacctttagatgatgaataactagacatgttgtgtgtatttatgattgtgggttaaattttaggctgtgaattctgatgtcaaaatttagaagcactgacctctacttattcatgtattggtaacaaaaagaactttccaaagttttccaaatttggtatcaccttagaagagctaacctcattttacacttgaataacccagtatttcattaagcacttaatatgtatggagttcagttagctattgttcagtaatccaatagatgttattgatttttgggacttatcttgggggagataattcagagacaggacaggacaagaaaatattaaagagttaattaactagacagtgtaacacacatatagtaagtaccatataagtcaattaaatagcattgtaggacttaaggaaagtaagaatcactactagtgaaatattcttggatgacttcatggagaaaaaacaattgtgccttcgaagaagggtgtgatttagaatgttgaagaagaaattcgagtgtgtttcaggaattcattcatagcatgaagagaattaccaacagccacgacatgtttagagcaaaatgcagactccctttgataagggcggctgttcttatgggagtggggaagttgatagggaaattacagtttcattcagcatgtagagagccttaaatgacagcctaggcttttaagacaattccgtaagctgtgattggtgatatgataaaaggagtcattttaagaccatttatctaatgcgtatactagtgtgcaagatacgtttaaggtgggatgtactagaggcaggaaaccagctgagaagctaagagccaagcacaggaccctaacagccacagctccagtgacagcaacaggactggaaaagaaagaatggaagagtgacagttcaaaaagagagatcaggctgtgtgtggtggctcatgtctgtaatcccagcactttgggaggccaaggctagctgttcacaaagtcaggagatcgagaccatcttggccaacatggtgaaaccccatctctattaatatacaaaaaattagcctgacgtggtggcatgtgcctgtaatcccagctacttgggaggctgacgcaggggaatcacttgaacccaggaggcggaggttagagtgagctgagatcgcaccagtgtactccagcctggtgacagagcaagactccgtttaaaaaaagaaaaaaaagaaaaaggatggaagagtgacagtttaaaagagagatcaggccatgcaccgtggctcatgcctataatcccaacactttgggaggctgagtcaggtggaccgcttgaacccagaatgtggaggttgcagtgagccaagatcacgccactcaaaaaaaaaaaaaaaaaaaaaaaaggaaaagaaaatcagtggcactttttgaccaattggacttgaagagaggttctaaaggtgatttaaaccaaaacaactacaaaaatgagcccagaaataaaggcaattcatgtacaactcagagagttggaccagctgaccactaaggcctcaaacaaacaaagttccactccttgtgtctgcacaaattatgttcctctctctcccctttgcctgtccagttatggctgtgtattaagatctatttcaaatctctccactccttgaaaaactgcatgactactccctgttatgtgcaagatcctccttgggctcccgatacattcacttctcttccacataatcacgtgtgtcattgcatcctctttttgctacagtaattcttttccctatcaatccctccaccctcactagtttttattctatcttacaaaagctagcactgaattaaatatgaactggtataaaacacaaacttacagctagaggtaaaaaatcttaataaatgcatctcttttactagaccactagaaatgttaatacccaaaggatacagggaagcctattggcactgaatattcaaaaatttaaataagctcttttgaaacttgaagctgaaagtctttctagatattcaagtattatctatggaaataaatcaagaagccctggaaaagtgtggcaaacaccttccattgctaaaggaacaattaaaaagcctattctaagaggcacaacggagctaaccattttctatgtcgtgcaagcggaaataattcagtgatgtctttgtgcctctcagaaaatcacacaaagtcactttctgctttttagtttgctctttggccctatgtaaaatgttgccacagaaattgctttgtgctcagcaaaaactcaacctgttaaattccagtgactggaatcattgaaggtcaagaggtaaaactcacctgctgtgccacattttcacaattcagagggttcttctgcactcagcatttatgtgatggtttctttctgtggaacatgtattccattttcaaaaggtctagtcttgattaacttgtacttggttaacaaacatgtattgagagtcatttgggttctgagcacagtattaagggatttggaaaagagaaggtaaaaaaaattgtatacagagaagtcaacttaaaatcctgaaatagcaacaaatataccaaccttgacattgtagtttataaatccattttagaaaaacaaacatattgcagagagaaaaaaacagaaatgatgatctataaaacaacatatattttaaattaagcaaactagaacatcatgaaaatttcatcgtatgggctttaatatgagaacaggaatgcaatcagtactgaaaaaaggtcaaaagaaaaatctaaaggttcatttaaagcatagagcagaaaattctctgaaaatgttttctctatatctaaaatgataaatttcatcaaatttgaaatttgggtaataaaaatggactattcaatgataacattttcaaaatactttataatgccttatttatattagatctttgttcttaagtaacatcatgacaaatacgtttttctaaaatatacagttataataaattaatggcaaaaagtatgaatattgtcatagttatgtcataacttattgtcataagttaagtgggctcagactgctgggccttttatatgtcaatttccagcatttttgtccactcatagtatttaatggttaatttgccattcactgtagcctactaagaactaaatagtgcaaaggaaaatcatgttgttaaatcaattacatgacaacttttaagaaaaattcacagtcaataggctcttttctgagagcctgtgggaggttctgtgagtcctctatagtttctatctgtccattactatgtgtccaatacctgccacatcactggcaaccaatttaattgataacacaatgataaataaataaagcatatatatttgtgacttttttcctatattatttcaaatcttccatttatttttaagtctatgtctgcttggaataggttaaactgccaaaagtttgaatgccaaagtaactgaggtgctagctatcatgtgcatttttgatatttcatactaaaattaaacaaattttctttgtaaatttcttttcattgaaaaaaaatatcatgggatgacaaagatgttttgttccagtatcaaattctctttctttgtctttatttgaactatagatgtgtatagcaaattcaactttgaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaattcaactttgaataaaaaaagttatgttcttttttgcctcgctaagtattagtagcaaatattcaggtatagctaatattttcatgcatcaaacataaattagaaagaaatagtgttcagtataatcaacaggttcacaggaaaaaaagaaagaaaagaatggtgtttgattttacccatgtctggaaagacaacatcgtgttctggaaggctctctgatgggaagtcagaggtgcagaagtgcaggagagctgggaaacaggttgcaatatactgtgagatcctttagtttgtaaaacacaaaggctcagattgcagggaagatattaagcttcacatatttcatttgaagtgtttttacatttacctcctgtggtaaaatggccatagcatttcagggcaaacgtccttgatgtgaatgggagtcccagtgttgagtgctaccccacttctggcacacactgtatttgtttccgaagaatcaagcttgtgaggagagacaggacatacaacctagcatgtcccggggaagccgactttgtcatatatacacacacatatatatatatgaataatataaatgaatactcacctcccctaatgtgttcttttataagctaaaatttttatacaaagcaaaatctcatgggatgtcacttgaaagaaaaacatgttttatgaaatcaagatctctagaaaaaaagtaagtagacatcattaaaattgttctagtgatttttttcaaaatgatcagatatgccatttgataacatccccagaagttaagctattagaggatttcctgaaaaatgattaaatgttacccacttcaccaaggatataaatatcttacactttcaatcaatctttcacgcttttattaacaactcataattataattctttcagtgcttatgactctcccaacttgataaataaataaattgaatgtatctgccctgccctgaggtcaaaaatactggtgtgcacctcctcccttgtaagattcttgaacccacttaatgactctgcactctacatgtgggtcttaggagggactcatcatcatcactgaatggaccgtcaatgtggcaaaagctcaagatacttttggaagtcaatatttcgatactaaaaccaatatttaaaattgaaatataatttacataccataaaatttacccattgaaagtgtacaatatagtgctttttagtatatccataaggcattacaaacatcaccactatcgagttccagcacagttccatcaacccagaaagaaacaccctaggccgggcatggtggctctcgcctgtaatcccaacactttgggaggccgaggcaggcgtatcacttgagctcaggagtgcgagaccagcctggccaacatgatgaaaacccatctctactagaaatacaaaaattagctgggagtggtggcaggtgcctgtagtcccagctacttgggaggctgagtcaggagaatcgcttgaacctgggaggcagaggttgcagtgaaccgagattgcaccactccagcctgggtgacagagcaagatcctgtcaaaaaagaaagaaaaggaaggaaggaaagaaggaaggaagggagagaaagaaagggaaaggaaaggaagaaaagaaggaagggagggagggagggaaagaaagggaaaggaaaggaagaaaagcaggaaggaaggaagcaaaaagaaacataatccccattagcagtcactctgcactgcctctcccccagccctggcaatggctaatcaactttgtggctctgtggatttgcctattctgtacaccaacaccagttttgaaagagaatttttttcattagttcacttggatattttgtgctgctctattttctttcttaaaaaaaaaaaacatctagaggataaggaaaataaaactttgcagatttttgtcaaatactattcagtagaaggattattttcttaaggaaataaaaaatgaaacttagattcctgggcttagtctcttggaattcattatttcaattattttgttcatgctaccaaagaaaccttcttttttttttttttttttttttgaaacagagtctcgctctgtcacccaggctggagtgcagtgacacaatatcggcttattgcgacctccgcctcccagattcaagtgattctcctgcctcagcctcccgagtagctaagattacaggcgcacgcccccatgcccagctaatttttgtatttttcatagaaatgaggtttcactatgttggccaggctggtcttgaactcctgacctcagggaatctgcccacctcggcctcccagagtgctgggattacaggcatgagccactgtgcccggtctcaaataaaccttcttgaaaaaattatattctcataggaagcgcattagactaattatattttgtagataaataacactaaacatagcttacatataaaaatttctttgcttaagaattaaatgaaataattctctggaaaacattcaattactagatattttagcataattgctcaattttgtgaaagaatcaaatgcacatttgtccttaataatatgaagaatggaaattcagttttctaaactatctatattttaattaaaagaaattcactctctttgtaataagataataatgcggtattaaaataaaagcattctcaatagtaaaatgtttttgctgactagctttgttaataaaactatgttttgaacaatcactggattaatcctagtgacaatgtgtagagttttcaaaacaggaacattaacagactcttgtcccatagtcttggtacaatggtaggagcctggcttaaggtagatgggctagagagaaagagagggaaataggagattgtaatgaaatagagccaaccaaacgtgttaaattttacacaggagatgaggaaaacttcaagatggtgccataatttcttgcttgagtgactgcccgtggaagacagaatttatcaacatagaagatggggaggaattaagatcttttcttactgaaaagatcctaagtttggagcgttttgccctgtagctatttaactctcaaccaggtatttggatatacaagtttattgttcagagtaatagaagctagagaaaaatattggaaatggtcagtataaaacttgtggatagcagaaattctggttgaaatcacccaaagtgtttaaagaaaatagaaggtggttaaggacaaaactgatagaaagagaaggaaggaagggaaggacaaatggagacctgaaagtttctgaacaaaacagggaaatcggagaaaacccaaaagactgatgtggcaaaaaccaaagaactcaagttttaaaacagagcactggttaacagaaatgaatgaagcagaaatattcaatataagcaggactgagaggtgaatattggaattgcctatctggatatcactagaagaaaggtttcagcagcaagggagatgctaagccagcagttagacgcttgaggccaatgctgctaagctgaaaatgtgcacttagaactgattagtatgtagacagtatttggagccattaaatcagtgtgagatgacttggggatgagtgtgggtaaagagaagagaacctagaactaagaaagagacagagggggaaccagcaaactgagaaggagaggccagggagacgagagggacaccaacagcttgtggggccctgataggctttatgaacttgagtcaaagaggaccgggtggtcggctgtgtgaagtgctgccaccagatgagatgggcagttccactggaattcatactgcggaggttattggccatgctagggaaatgcctaacaggagccactcaaaaacatgtcaaagtcaacaaaggtaaagaaagcctaaggaatggttccagattaaaggctactaacaggacatgataattacatgtgacatatgaccctggactgcattgagatcactggcaaaatgtgaatgtagactacatattggatagtaatgtggtatcaatgtttagttttctgattttgataactttactgcagttatgagagagaatactctttttcttcggaaatatacaataatgtgcttcagaataaggggcatggcgtctccaactcactctcaaattactcaggaagaacgaagtgtgtgtgtgtgtgtgtgtgtgtgtgtgtgtgcatgtatggatagataatagaataataaagtaactagagcaaaacataaacaaatgatgagtctgaatataagctatagaatagtttcttgtactattattttaacttttatgtataatggaatgtagattttagaaattacagaaagaaaatgaggagagggagaaaaagggggagagcaattggaaaaagcaagtctaccaactctcgtaaaataaacacctgcgctctagagaaaagtaaggaaatggggtgggaaatggtggggaaggtaacatcaaaacaagattagggtttttttctccttacctgaccaaaattacagcacagtggcaagctgatgtcaatatgccagtggaaagagaaaaaaggttgaatagcagagaaataggggaaattgctggcatgatttcctttcatgaggagaagagggtgagtctgcatacaaatggagaaactggctctcctaggagtagggaacattcatctttggtaataagcagaaaaacaaagcatgagaatgcaattactggaaggtagaaaaaagagataaagagtgcctaccccactttttgccctgggggacctggaaagcacctcccttgaatggattcgtgggaagtagtgtttccaagggacaaccaggtttcagtctgagcaataaggtgaaaggaaagttcagagaatatcctaacaaatggcagagcttgcatttaagaagctatatacggagacacatggaaaatccagccatggtagtggatatacagatagcacaaggttgagggcctgcgtcatgatggatggcctgtgtttgaaatgctttttccttggtgtcataaagaaacagcacttgaacataaatttaattttctcagcaaggccatttcatactttctgcagaaagggtacagcagcagcagttttgccacaacggcacaccgaacaaaccggagacagggtcatttataacctgatgcatccaccctactgctgtgtccggtttccattggctggaatggggcctcacattctgtatttgtcctgattggctagtaacttagaaaatttttaaaaagacaaaggcagaggagaacaaaggaaggaggaagtaacttgtggcatgctgagaaaggtaaaaacaccttcaaataaggaagaggaacaggctatggcctaatgcttgcttggaccagtataagcatgccagggcaaatatttaggctaaactgtgggagctaagaacataaagtacattgatttctttattatggatagcagatatttaagaatgttagcacaggtctatgaataaattttgcttctaagagaagttactatgtattcctaattagatggggaggaaagtctttgaagaggaacctctactttactttttacacctgggacctggtttctgggtgaatgagggaatgaaggatgtgagcataatgagctcagtgctgattatttcctgaagagaagtgggcaaccagttcaagacagatgttatgggtccactggctgaccatgctttcctgcagaagccagtattacggcaaccaaggggagaaagagagtctccataacaattaatcttcctggaagctgaagcaccaaatggtttgagtgtttcttcttcttaaagggaaggtagtgtggcccatatgaaaagggtggcccattgtgaagcaggaggctagaaatgggctcttctttgtgggatgaactgtatagcagctggtgtgggagctggagcataagtggcttagaggcagcttcttctctccagcagcgggcaggttggctctgggatcacctcagtcaatggcgtcaccatccaattcaaagataaggatggaagcagttataagtatgtttgtacaggcttaattttctctggaaagtaggaatgggtcacctgaggataaaagggggaagtgaataaagtcgggggacagaacatctgaggtctcaagggggattcatgagattttggatcaagccactgagggcacatcaaaggttcatggacgaagacatggaagaattatagaacagggcccagggcccacccagtgttggagtttacaaatcagtcactacatagtggtcctggatctgttgaatagtagactcttcaaaacacactgataaatccctccctcttaaaagctgaagaattggccctctctgaaaaccacagcactgtctcgcattatagggattaacccaaactgctctgtgaagctcgtctaatctatgagcaatgagaaaggcagaagaatttgtaataataaagaaatgaaaactgagctgtagccttcgattacactgtgacatttggtgagttcactgtctttctttagtgtaagaatcaaggaacaaatttgttttattgtttggcgtattatataactcatttgacagtactgcttaagttatacaacaacccctaattcatatttttaagctcgtttgaaaaaaaaattaaaatgctctcaccttggagcattactttacattttgcagcacacatttgtagtttgggttctttttaggcagaaatctgaactaacaagtacttctattttttctccagattctttacatttctacagctttatttcacccttttctaacataataaaccatttctcagcaaacatttagataaaatgtcacagacttggagaaagaaaatctaaattgcagatcaaaaacaaggccatattaagcatgagaagtggtagtgggaatacaatttacaatgttttgatttaataccataaagaatgtccacagaatagactgcaggttggaattcgtggagatgtcttctttagtttatgtaatgaatgccattcttattcagtaagatttaatcaggctacttgagactgagatataagtgtagagaagatattggctttccttctccatatacttggaatgtaaaattacttaggaaattttacactgacactacatggtgaggagatatatatatcttaaatatatatatatatatttctttttaagattaagtatgagacctcaaaaatatttggactgcaaatactattttaaagtaataaaatattatttctgtgaaatagaaactaaaattgaaaagtgcttgaagtataaattctattaaattttagtgaaaaaatatcaagaaaatactcatcatataattaaaaatttattgtgtacaaatgggttctgctatttctaatatattttattatcaatgtattatattctgttatataactttatgatattcatttaatttcaagtactagattttgatatactactttaccatattttggtttctatttccttttatagacaggttcactccctaccactaaaaatgtttaaatacttaatttaatctgagacaacatctgcaacaaaaaaacagaactgctgttgtaagtttctgatattatatgtaaaatggcataacaatataattttatttgaaggtagactgtgttaacttaaatatatatattatcaatcctagagtaaccactttaaatataaagcagcatagctaatgagctaaaagaagacataaaacagaacactagaagataaccaattgaaactaaagcagaaaataaagagggttgaatgaagagaagatggcacacacagaaaacaaatagcaggatagtagatttatacgcagccataccaataatcacagcagatgtaaatcatctaatatttcaattaatagtcagaaattgacttccaatttctagtccggcataaaaggaacctgaaaatcatcactgtctcctaaccataagtaaaaagctgaaaaacttgataatcaacaagtcttctacatctatcagagaagtgagctcataggacaaactgcagccctcaaaactgaagagacactagtggatacagacaggtcccactcaccagagcagaaacctcatgggaacgaatactaggctaggaaaacctgaactgtaatctatacattgcacgaaacctcatgggaacgaatactaggctaggaaaacctgaactgtaatctatacattgcacgaaacctcatgggaatgaatactaggctaggaaaacctgaactgtaatctatacattgcgtgaaacctcatgggaatgaatactaggctacgaaaacctgaactgtaatctatacattgtgggaaacctcatgggaacgaatactaggctacaaaaacctgaactgtaatctatacattgcgcgaaacctcatgggagcgaatactaggctaggaaaacctgaactgtaatctgtacattgctacaggcttgatttggacaattctgagagttaaaatcggggtggggcagttttagggggacctccacacttttgagttttacctctagcagcaccaccagagtctcatagtgaaggttagagaagaagtctgtcttagtctgtctggactactataacaaaatactttgaactgggtgatttataaacaataaaaattgttcactcggaggctgggaagtgcaagaacgaagtgtgggcagatccagtgtctgatgaggacttgctctctgctttgaaaatggagccttctttctccatctccacatggtggaagggcaaaaggactccctcaagctgtataaggatattaatcctatttatgaagacaagccctcatgaccttattacctcctagaggccccaactccgtaccattagtattagatttcaacacacaaattttgggggttcagagagattcaacaatagcaaaactcctcatgcttttgacagagagagtagaaaaataactactttgaaatatgcccggagcattctgctctttttaacaaggcgtgccctcaaaaggacgtattttaccacagctagccccatctggcctttgacatggagtgaaaaaaaatacacaacttcagactgctctggccatcctgtcccacctaagtggaaagaagagagagactccaaagcatttgcgaaggtcacagcacaggaacacaagctcattaaaagactggaacctaatcatcggactacaggacactttccctcccactccaccttcccgccacatcactaatgacctatctaccacagttccttctacctgcatgttcagctttcaacaaaagttacaatgcacattaaaaagtagaaaacaggccaggcgtggtggctcatgcctgtaatcccagcactttgggaggctgaggtgggcgtatcacaaggtcaggagttcgagaccagcctggccaacacggtgaaaccccatctctactaaaaatacaaaaaaaaattagctaggtgtggtggtgtgcacctgtaatcccagctactcaggaggctgaggcaggagaatcgcttgaacctgggaggcggaagttgcagtgagccaagattgtgccactgcactccagcctggggacatagcgagactccatctcaaaaaaaaaaaaaaaaaaaaaaagtagaaaacacaatctgaagagacaaaacaagcaccagaacaaggctcagatatggcagggatgttggaaagttagagattgtcagactggataaaaaacaaatcttaaatccatgctgtgtgcaataaactaattttaaatagaatgatacatataggttaaaaataaaaagaaagaaatatcatgcaaacactaatcaaaaaaggtggagtggctatagtagcatcagagtaaacttaaagacaagaaatactactagaggtaaagaggaatattccataataaagaagtcaattcatcaagaaactataacaatcctaaatgtgcatgcatctaataacaaaacttcaaaatcataaaacaaaaacaattgaaaggaaaaatagacaaaaatccatatttacattggatagtttaacactgttctctccacaactggtagaactagtgaactatattcactaagaatatagaaaatgtgaacattatcaatcaacacatcttgactgatatttgtacaaaataacacctaacaacagcatactgcacactattcacatgtgctgtggaatattcacaaagacagatcatttgctgatccatgaaataagtcttgagaaatttaaaagaattgaaatcacttcagaataggttctctcaccacaaatgaattaaactagaaatcaataatgaaaaaaatatctgggaagccccaaactatttggaaattaagcaatatggttacaaataaccaagcaccaaagaagaaattaccagagaagtcagaaaatactttaaccaatgtagcagtgaaaacttaacatactgaaatatatggatgtcagttaagcaatgcaatgctgagagggaagcttgatctccatatggttatattaagcaccgtgaaaacaaataactataatatactaaaacagtatttattgtttttgtttgtttgtttgtttttttggcgacagagtctcattctgtcgcccaggccggaatgcacatggcagcaatctcggctcactgcaacctccgcctcccaagttcaagcaattctcctgcctcagcctcccgagtagctgggattacaagcacccaccaccatacctggctaatttttgtatttttagtagagatggggttttgccatgttggccagtctggtctcaaactcctgacctcagatgattcacccacctcggcctccaaagtgctgggattccaggcatgaaccacagcacccagcctaaaacagtattttttgttaatgagggaccatttaaaccttctctacttggaaggggcagggaatgaaggacaggtatgaggctcaacacagtaaaacctagggacgggggcgacatttaggctggacattgaaaaatgaagccagatgaggaatttctgtgaggcaggagcatgaggaaaggcagggcatgctgtccctgagatgctgtggatagaagaggtgtcattccagtgtggccggagggtaagatttctggaggaaagtgagcggggccgagaacatcaagctgagcgcgcaacagattgtgaagggcctcgtatgctctacatgtacatagaagtaaatgtgtgagtcagaattccttctgtggacatactcaacaatattctctttttgcttctctaaaggaaaaataactgactaatgcaacagtcagctcaatatgaatcataactattgaaaaagagaaagaagtttgatgaataccaaaattaacagaggcttttccatatgtatcctttgggtagcttcccagaaggaagaatcaacacagctacttggcaggtctacctaagctagccccagtcacacttcttcacaaactccagctggcatgcaaagtgtgagaaaacagcccagctaaaacacagtactgaaaagtcttgaatttacaaacaaaagattgctattaaataaagaaaatagaaaacaaaacacagcactgtgttgtgactgtgaggaatacttttgcaccagaagatataaaatgtgattaaacaggcgttgattgatttgggttcggtgggtcaaggcctctccctggatttgaacatttcagagtccagactactgactggctgtaatatcaaaacactgtataaaatgcttcgatttgtaacagaatttaacactgtcagaagtcataaggcagttttgtttttcctaattcacaattaagttataatagcagcaagctgactttactcagtcacagagccagaggatttgatgaggtgtacaattttccctcaaggataaaaatgtaattatgaaaaagtcctgaactgaaaaacagtattgtcagctatttccaagaaagataaaagatcatttaaaggtaaagagattacagataaaaggaatacaaaattaagttgaaaccaccagggtagagagaacaagttctaaacaagaaccaaacattaaaacattttattataacaagaaaatatggctttcgtttttctaaaaggacaataagtttttaaattcatgtctgattagttcatccagatgtttaaagataaatagatatcaattgatgattatactttccatgttgctgataaatagatatcaattgatgattatactttccatgttgctgataaatagatatcaattgatgattatactttccatgttgctgataaatagatatcaattgatgatgatacttttcatgttgctgataaatagatatcagttgatgatactttccatgttgctgataaatagatatcaattgatgatgatactttccatgttgctgataaatagatatcaattgatgatgatactttccatgttgctgataaatagatatcaattgatgatactttccatgttgctgataaatagatatcaattgatgatgatactttccatgttgctgataaatagatatcaattgatgatgatactttccatgttgctgataaatagatatcaattgatgatgatactttccatgttgctgataaatagatatcaattgatgattatacttttcatgttgctgaagaagcgaaccctgaatgtgcctcagtctgtcaaactgacagtcagagggaggccctagtcagagggaggccctattctacactcagtaaccaggggactccttttcataagttcatgtaaactgcaaggggtacttaatagttttgttttcatttcttaccccaaaacctatctcccactaagccctctctataaaatgaaaaaattaatatctgtttcaacaggattgctgggaagatcaaggaagagaaaatgaataatatatgtaagagaactttgcacactacatagccctacacagaacgcattattaccaagtattttacatttataaagtgcttttcaaagcactctccacttaaaattcaattcacaatcaccagctaaggctgaagattcagacacaaaatccccgcctgcatgaagctcatgttctggactctagaggaatcaggtaatcctgtctatacctgtggaaaatgctgtgaaaacataggatgttgctacaaagaagttggcgtccaaattagagaaatgagtgcatcgctcctgttctcaggactctggatttctgcaaccttcttaaaatctttaatgaatatttgaaattatctcattgcacctgttatcaatcctctgataggaaccaagagagatatatgttatttctgagaaaagtgaggcttcgaaaagataaacaacctcattgtgattcaatgacttgacgttcagctcacagtctagaaaatggctaagtggcaaaactggtcttcagactcaagaaatgttcagtattatacaatagagtgcatttggtgtttgcagtcatggaaatggaatgtggggtcttattggaaataagctactccataccagacacgtattttaaaagaagaaatcatgattcttagaaaatcgggtgtcatgactatacatttaaaattctgtcaaaatcagtaaaacaaagtaaacagccaatgtgtatgcaaatgctttacatgaatagactatctagtctcaaatccaatagctgttccgggaggaaaaaatctcaatttgtttgccgtgagaatgtcaaactgatatttctgtaacagttagcatggccacagtgctccacagagagtgcaaagatcctgcatactgggtggccaatatgggtttaaaaaagaaggaatttttattgccctctccccaacaatactgtgcgtgcacacacacacagacacacacacacacacacacacacacacaatgcagcagcaacaacaggtgcagggaaaggttccagcaaccctttctctgctcctcagggaggatattctggagccttttcaaaggctcttccagagctgattgagaaggttttcttcgtcaataaacagaggtcaaggaatgcctctttgccatggagtctggtcaaagttaagtgtcccacttgtggacaggaacggaggtaggagctggatgcctgtcgaaaacaaactaaattccagaaaataatcttagtgttcaacaagaaagaaatgttttcaataaatttgtgttcatttacaagactggaaaactgtttaaagtagactacaagattggtgataattacttaaataagcatttatggaaaattgttgttttatatatttttataaattttatatttatataatatgaaaattcatattatatatttaaatattgtcatatatttaaaattcatatatattttaaaattaaatattaaaaattaaattatatatttacatttaaatattaaacctattaaaattggcattgaatttcttatatatgtcatgtatattatatatttaaaattatatattatatattatatatttataaaaatatattttttattttttataaattttatatttttataatttgaaaattcatgttatatatttacatattaaatatattaaaattggcattgaatttattatatatgtcaggaaaacaatgacaaagaaatacagcaacgttagcaatcagttttttttctcatacttttttttaacttttattgtgggtttgggggtgcgtgtgcagtttcgtgataaaggtaaactggtatcacgggggtttgttgtacacattatttagtcatccaggtactaagcctgatacccaaatagttattttttctgctcctctccctcctcccaacctccaccctcaaggaggccccagtgtgtgtgttgttcccttctttgtgtccatgagttctcatcatttagttcccacttataagtgaaaacacgcagcatttggttttctgttcctgcattagtttgctaagtaatggcttccagctccatccatgttcctgcaaaaatggacatgatctcattctttttaatgactgcaagcaatcagttttaagcatggtccagtattaaccacaatgaatatttcttccatattaataataaaaaatgtaaaataaaaaataatttccctattaaagataaaaaattggaaataggtattaaccttcctctcaagtctcaataaaaataacaataaaaataacaaaaagtgttctgttttgttttattttaagttgtaaacccataagagcagaaatatcaacagaggaaacaataacaacaaaataatgggggtggaaagcaaacaaatgagcaatcatggactaagagaccagttcaagcataaatcaaggctggcgatgggaaagcagagaagcaacatggtttacagcagaaaacccacagagcctcagaaacgagcagcaacagaaaaacaggctgttaaggaagcaggtcaacagctcccctaccgtggtcctcatttccacaccatcctgcatgccatggaacgatccgtcctccaccctggagaagcttagagcttattctgtggaatgggagaaacggagagtccctgtaatggagataccaagaaggagaggcgggtcatatactggaaacaagagaagcaaagttgatgtaaggaatattgagactacaactggatctttccttctgtggctcctaaaatgcaggtggcagagttgtaccttccatgcaggaaataagagggtttttctagggaattgagaggatctccagatagctgggcctatttaaatgagagtgaagcccaagctgatgtgaagcttgcacctagaatttccaatcaatcttctagggcctcactcttaaatataagcagacagctaaggatcaccatcctttgataggattaagaatgagcaaacactggaaacatactgaaatacagccggctgtctaaaacagaagatatagaatataatgaaagaccaaaatggatatgtgtagagattacacagggaagatagtggaattgacaactctggcagcaacgctgctaaggacaggatgaatatgaaaattgcttgaagttcaacaataaggagaaaggaggttgccaaaaagaccaggagaggcaagaacaaggcctgtcataaggttatagtgcatgaatggcctatcggttaagaattaattcagcagaacataattgaaaatacattttaaaggagcatgaataatatttgtattttctctataacaaggcaggttagttcaaatgcatcatgacgtcttcaggaacccacacttgtctctctttattgaacccacactcttctctttctattgatcccacactcctctctctattgaacccacactcttctctctgtctctcttttgttttgtttttgttttttgagacagagtcttgctctgtcatccaggctggagtgtagtggtgcaatcttggctcactgcaacctctgtctcccaggttcaagtgattctcctgcctcagcctcttcagtagctgggattacagccgcccgccaccacacccggctaagttttgtatttttaatagataccgtgtttaatttcaccatgttgaccaggctggtcttgaactcctgacctcaggtgatccgcctgccttggcctcccaaaatgctgagattacaggcatgagccactgtgaccagcctcttttctctctattaaacccacaatcttctctctctgttgaacccacactcttctgactctattaaacccacattcttctctctcaactgactcacactcttctctctctattgaacctacgctcttctgtctctattgaacccacactctcctctctctatggaacccacacttctctctctattgaatccatgctcttctctctctcctgaacccacacttttctctctctattgaacccacactcttctctctctattgcatcaggcttctcctgcgccttttcgtctcatgacttttcacctcattgttgaacagtgtctgctttaccttcaagttctgggtaggaagaagagcaaagagaaaaaggcaagaagtagttgccagtgtccatatctcttttaagagctctcctagaagccctacctagtgacttctgattatataatagcttcaaggagtatgtgggatttggtggttgttttaagctggactcattaccactgtgaaaaaaaatcacattgtatatttaagaaagaaagagcaaatgtatattacatagagaaccagcagcatacatcgctgattatttttgaaaattaaaatgttttagtaatgggcttgaaattcaattccagtcatcaataaattaaatgtatacaatgaagaagacttgtaatttaacaatcattctgggttgcttagtgggtgtgcaataatgacctttgaagaggggaacaggccgggcacggtggctcatgcctgtaatcccagaactttcggaggccaaggcaggcagaccatttgagatcaggagttcaataccagcttggctaacatggtgaaactccatgtctactaaaaatacaaaaaattagccgggcatggtagtgcacgactgtagttccagctaatcctgctgaggcaggataattgcttgaacccaggaggtggaggttgccgtgagctgcaattgcatcactgtgctccaggctgggcaacagagtgagtgagactccatctcaaatttttttttttaaaaaagaagggaacaaacaaaggaaatttctgggagagagaaaaatggaaaatgagtagctgtctcccttctttcaggtaactgctttcaggtcctccagaatttttattaatataaaacaacatttgcattatcctatcaatattgtagtttgtgacagtaagtcaaaatatacttttcactgggcaaaggacatgaacagacacttttcaaaagaagacatttatgtgtccaacaaacgtgaaaaaaagctcaacctcactggtcattagagaaatgcaaatcaaaactacaatgagataccatctcatgcgagtcaaagtgatgattattaaaaagtcacgaagtaacagatgctggcaaggctgtggagaaataggaacacttttacactgttggtgggagtgagtgtaaatttgttcaaccattgtggaagacagtgtggtgattcctcaaagacctggaaccagaaataccatttgacccagcaattccattacgggctgtatacccaaagtaatataaatcattctattataaagatacacgcatgcttatgttcattgcagcactattcacaatagcatatatatggaatcaacccaagtgcccatcagtgatagactggataaagaaaatgtggtacatatacaccatggaattctatgcaggcataaaaaggaacgagattatgtactttgcaggaagaacatgggtgaaactggaagccattatcctcagcaaactaacacaggaacagaaaaccaaagactgcattttcacacttataagtgggagctgaacaatgagaacatatggacacagggagtggagcaacacacactggggcctgttgggggcacaaggggagggagagcattaggataaatagcgaatgaatccggggcttaatacataggtgttgagttgataggtgcagcaaaccaccatggcacacgtttacctgtgtaacaaacctgcacatcctgcacatatatcccggaatttaaaataaaataaaataaaaatttaggtatatatatatatatatatatgtatacacacacacacacactttttacttggtgtatctaggaaatatacaaaagcttaacaataaactacccaagaatcaataaaaactaaaagttaaatataaaaaatgcctttccattgcataaaaatgtaatttcaccagcccaatgtatgtatcacttgaaaaaatgtcgttgcaaaatgcaatctcttttgtgctttatactgttgattttaaaatttaaagtcaggagagcaaagcacatataaattggttccttcttttatttctcaagaagtcactctttctttttcattaccatctgctctgactgctattacaatttttatcccaaaaggtgatgctgacagtgtaaaggtggtataattaacaaaattcttctctcatgacatttctcacagaaaactggaagcaagaaaatataattgcaccagcagatatgtttcaaaaccaagtaaagagcttatgaaaaataagaactcttaaatgcaagcactacagattgcctagatcaagacaatatccatgaattgaataggttttccagataataaattgatagaatgcagcacatatctccatttcttaagagagaaaaattttgtgtcaacatgtagatgcacagcatggtctgacattgggactgaattattctcagttaatcaatagcacgcatgtgaagtagccattcacagactcggctgctcactggcatgacctggacgacatttccctttacagattccttgacccactcccaagggtttggattcaatagggtttgggttgctctgggacctgtagttctttaaagccctcttgatgactgattaacaccaaggagaagattgacaaaaatctgtaatagcggaagcatttactacaagtaaaactccgtgtttaaacttgggggaaaggagtttatccttacgtagcttattatctagcacagtgattctcagctgagaataaatttgcctcctggggggcatttggcaatgtctggagactttttttttttttgagctggagtctggctctgtcgcccaggctggagtgcggtggcgcgatctcggctccctgcaagctccacctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgagcccggccgtctggagacattttaggttgtcactattgtggggtggagggtgggggtggggaggcggtcctactggcatctaatggtagagaccagggatgctgctgaacatcccacagtgcacagggccgtcctccaccaccaagaattacctggctcaaaaggtcaataccggcaagagaaaccctgatcccaatagggggaataagaaaatacattaaactatataatgaatggtgtagagatttaaaagttattgcaaagatatagatagatgctatcacaattcggagcagggtgagttagggccagcagagaaaggatcttaggctctggaatgaagtctatgcctcttcctacagccttactacttaagtgttcaacactagcggaacacttgcagtttcgagcatttgtgcatatggtaattaagctaaataaagttcctgttctccttgaaggtcacattctagttggaagaatcaggcagaacatccaaagtttaaaaaatggaaaaaacaagtgttggcaagcatgtggaggaagtaaatggaacacccatttctagtgagagtgacattggttcaaccactttaggaaactggctagcagtatctaccaaagctgatctacatgccctgtgattcaacacttctacccctaggtgtttgtttaacagcagtgcatgtgtatctgtgccaaaagacatgtacaagaatgctcatagtagtagcatgtgtaacagtccaaaactaggtacaattaaaatgtccattaggccgggcgtggtggctcacgcctgtaatcccaacactttgggaggccaagccggctggatcatgaggtcaggagatcgagaccagtcgggtcaacatagtgaaacaccatctctactaaaaatacaaaaaaattagctgagtgtggtggtgggtgcctgtaatcccagccactcaggaggctgaggcaggagaattgggtgaacccaggaggcagaggttgcagtgagccgagatcatgccgttgcactccagcctgggtggcagtgtgaaactctgtctcaaaaaaaaaaaaaaaaaaaactctattaataaaatgaatttttaaaaccaaggtgtatttttgtgtatacaatggaatactatatgcaattcagctgaatgtagtactgctacacaaaaatatgtagatttatctcacaaatgtaacattgagtgaaagatgtcagatatgaaaattatatatggtatgatcccattatataaaaattatatagagataaaattaatgtattatgaatcaaaacagttgttgtatcggaggaagattatgagtggggtctttctggaagtcatctgggtgctgtaatattcaatttcttgatctgagtagcagatctggtaatccatattgtctttgcttttttctgaataccacattttgataaaaatatttacttaatagagcaatgacaagtgctatgaagaaaagtaaagctgggtaagggacttagagagtggcaggtcagtgtcatagatattatttatagcagagatccacaagctttttctgtaaagggccagatagtaaatattctaggctttatgagcctacaatctgtttcacaatcattcaactctgcggttgtactgcaaaagcagaaatagacaataagtaaatgagtgaatgtgactatgttccagtgaaagtttatttgtggacactgaaaattgaatttcctaattttcatgtgttgcaaactactatttttgctttcgattttttccccagtcacttgaaattataaaaaatatccttagctcacaggccataaaaaaacaggcattgggtgaatttgacctgtgggccatagtctgcaacctctgaggtagaggctagtgggagaaagcctgcccaaggaggtaactttgcacagtcctaagcaaattgagatagcaagtaatgtattgatccagggaaggcgttttctctggggaggggagaggaagtaggaaggccatacggtggaagcttgctgagtgtgttcaaggaacagcttctgtggctagagaaaaatgagtaaatggcgacactggcagcaacaagccatggcccgagaggctcagagagagatgctctaaaacggagagctggtggcgatgaggaaggtgaaacagagggaagaaatcctggagcaaggatgcaagccagaagtctgaatctctcagagaagaccggagacagaactagcatgtggaatggggtggagaggaggaggaggcagggaggcagtcaagtgtctttccgtgcccaagctgcacaccacgcacaccaccaccaccgcacagacacacctcagagttatttagttcaagcattgtaagactggataaaggtgtatttctttctgtctctttttttctttactttctttcctcccttttttgtttttttcccagagaattcacatcaaacagcattatttataatgatgatgtccttctaggtaaactcagattttccaggtgaaagagaatggcaaccaacagtggcagcgattttttaaatgcgacatgttggccgggtgcggtggctcacgcctgtaatcccagcagtttgggaggccgaggcgggcggatcacctgaggtcgggagttcgagaccagcctgaccaacatggagaaaccccatctctactaaaaagacaaaattatctgggcgtggtggcgggcgcctgtaatcccagctacttgggaggccgaggcaggcgaatcacttgaacccgggaggcggaggttgcggtgagccgagatcgcgccactgcactcgagcctgggcaacaagagcgaaactccgtctcaaaaaaaaaaaaaaaagagacatgtcttcaggcttattgatgtatctgcccctggctggaagatttctcgaagctccaacataaagtaggacctaatgtctggcactgcggttgaaggaatgatttgcctactgggtgttttacttagcaacaactcagctttttatggaattccagttctccaatgtttgttctctgatgtattgttgcctcttttataacagtcattaaacactgaaaatgtctgatgcggcaaaacttaatggacacttactggttataatggaatgaagagtgaggtggaaaaaaaaagatgattacccaaagctttcataaaatttcttgttatcttttcacatcttttatacagacaatttatcttgggtaataggctatgcccttttgatctacagactagaaacacaagaattgtaatagcataatgttgtatcaggtatgccaaatacaatattttacctaatttcttgtattactttgcttcataggtcagggaaaagaaaacacatttaaagcaaccattaagataagaggacagatgcaaatttaaaatagttgaatttaggtaaacagaattaattaaacccttaatttcattagtatttacagagtgcctgccatgtgtcagacactgcctagattctaaatgactaaatgcataaatgagtctgtatagataaataaggcaggttaatataaataaatgaaattatatagtacctatctcataataactgcttaataaatgtcagcaacaaatattgttataaaactgctatgggatcttcacatttggtataattatgttaactacacgtatgaaaataagagtcattaatacgaaggcaactgtactaggggtagcatctcatggtgatgataagcatctgtgactagccaaaaagtgcttaatcaccccaaaaggcactctatgatgttggctaaataaatatcaacaacaaaaggcgtttctcaaattagttctagataagttgcatgtcacctgattctatgactatcggtcccattggtattctaatttcttttttcaaggatctttcctaaaaaatattattgatgccatcattttgacaaaaacttgttaaagtattattaaaactggcataattgaaatttatttttgtgattaagattgaaaattaaaaaggcacaaaatagtagcaaatataacttgttctcattatattgtttatgacaataaattccctggttaagcttacacatggttctctcttctaactctgttttcagttccttgtaaaagattattctttgaagctgacatttcttgtctcttatctataacaaaggttaataggtatattaaaatgcagagaaaacattcacattttctcctagaattaaagttttaaaaaagttcaagttttatataaatgtttggaaatgaattataggtagctacaggcaagacatgttgtcaaataaataccttcagataaatgttgaaaaagctatttctaatgtgaagttttaaatatgcttggaacataattggttagacactgagcagaatgaaaaatctaattatcagcaaagggaggagtctatccacaaagatgtaagaaatattttaaacttagaaatcaaaacgttctggagttttttagtcaaacttcctactgttgaacttaaatatgcagaaagtcattttatctatctaagtgagatgtggaccaagattaaaagagtattaaatactaaatatttcttccttttatcttttattaaagttaaatagaagtaagatgtgcttacggatgccaagagaaaatataatacaacagagattcctcgtgcagcaccatcagaatgtcatcacagtaggccatgtcagtctccacttaactttcacacattctgatggacaatatccataagtttgtaaaatgactgtttacaaagtatactctgttctacttttctcaatttaatgctgtgtttatctgcctgggtgttttctttttttcctctctctgtgtgtgtatacatgtgtgtgttgatagtgagcagaacatagccaggagcagcaaactgtttttggagaagaactcatttttaatttaaatgtgggctttatagacaagaataagaagctctgattgcagctaatttcagcaaattaaaaagagcctgcggggaaaactgactggtaatgatgaaatgcaatcaagtgagcaacagtatcgatcttcaaacacaaagctgagcagataataaaatacagtttgaaaaaaaccattcatttttattataggatatagcagatgctggtttaagtactagaataaaacaaaaagcctattgattattacagcttgtactgacaacattgtatatacatagctggcatcgtttgtagcagtttgctcgtgtcctcaggcagggtactaacccagaatgggcacccagccactttcttctgaacagaatctcatgcattaaatatttatgtttcagtgagtaaggaaaagagaaggaaatcaaacattcctcctgcgtgtgcgtggaacttttgtcgaactataaacacagcatgagcacaaacccttctactacgcccttcaatacttcccttgtctttgtttgattggcaaaatgtctcctagcaaggagtttctgaattaggccaaaacaaagacttgaaataaatgttatcttaactcttaaacagaaatattatttttaggattacttcttacagcagagcagaagcttgtttagtagagaaaaggatgctgtcagattctcagggtttagaagcaggactttagacagaaggtagaactatttagacagaggaagtataaagggttctaaaatgaatgggaatgaggcagggtgatttcaagaaaaaaatactgaacttatccctagagaatataagcattttcattccttccttcctttcattccttccttcctttactcattcattcaaaaaattgtatagattcccagtagaggcataaccaggctggaaccttcaaagtcagaagtctggcagggcctgggtcactgttggtgagagaccactcttctgtcttcttgacatgttcctggccttgtttccacactgtttcctgttacaacctttcatcaaaatcttttttttattatttttttattaccataggttattgggaaacaggtggtgcttggctacatgagtaagttctttagtggtgatttgtgagattctggtgcacccatcacccaagcagtatatacactgcacaaaatttgttgtctttaatcccccatccccttcccacactttccctctgaatccccaaagtccattgtgtcattcttatgccttttcatcctcatagtttagctcccacttatgagtgagaatatatgatgtttggttttccattcctgaattactattacttagaatagtagtctctaatcttattcaggtctctgtgaatgccattaattcattcctttttatggctgaataatattccattgcatatatatactacagtttacttttccactcgttgattgatgggcatttcggttggttccacgtttttgcacttgcaaattgtgctgctataaatgtgcatgtccaagtatctttttcatataatgacttcgtttcctctgggtagacagcaactagtgaaattattggatcaaatggtagttctacttttagttctttaaggaatctacacattgtttttcatagtggttgtactagtttacattcccaccagcagtgtagaagtgttccctgttcaccacatccatgccaacatctgtcatttttttgattttttgattatggccattcttgcaggagtaaggtggtatcacattgtggttttgatttgcattgccctgatcattagtacattttttcatgtgtttgttggccatttgtagatcttcttttgagaattgtctgttcatgtccttggcccactttttgatgggactgttttttcttgctaatttgtttgagttcattgtagattctggatattagtcctttgtcagatgtatagattgtgaagattttctcccattctttgggttgtctgtttattctgctgactgttctttttgctgtgcaaaagctctttagttcaattaagtcccagctatttataattatataattattataattgtttttattacatttgcttttaagttcttggtcttgaaatccttgcctaagccagtgtctagagaggtttctccaatgttatcttctagaatttttatagtttcagggcatagatttaagtccttgatccatgttcagttgatttttgtataaggtgagagatgaggatccagtttcattctcctacctgtggctagccaattatcccagcaccattttgttgaatagtgtgtcctttccccattttatgtttttgtttgctttgtcaaagatcagttggctgtaaatatttgggtttatttctgggttctctattctgttccattggtctatgtgcctattgttataccagtaccatgctgtttcagtgactatggccttatagtatagtttgaaatcaggtagtgtgatgcctccaggtttgttctttttgcttagtcttgctttgactatgtgggctctttttttggttccatatgaattttaggtttttttttctagttctgtgaagaatgatgttggtattttgatgggaattgcgttgaatttgtagattgcttttagcagtatggttattttcacaatattgattctacccatccatgagcatgggatgtgtttccatttgttggtgtcatctatgatttctttcagcagtgttttgtagttttccttgtagaggtccatcacctccttggttaggtatattcctaagtattttattgttttttgcagctattgtaaaaagggttgagttcttgatttgattctctgcttgttcgttgttggtgtatagaaaagctactgatttgcatacattaaccttgtatccagaaacttcgctaaattattttatcagttctaggagctttctggagaagtctttagggttttctaggtaaacaatcatatcatcagcagacagcgacagtttgacctcctcgttactaatttggatgccctttatttctttctcttatctgattgttctggctaggacttctagtactgtgttgaagaggagtggtgaggtgggcatccctgcttgttccagttctcagagggaatgctttcaacttttccccattcagtattctactgactgtgggtttgtcacagatggcttctttacattgaggtatgtcccttgtatgccaattttgctgacagttttaatcataaagggatgccgggttttgtcaaatgctttttctgcatctatggagataatcatgtgatttttgtctttaattctgtttatgtggtgtatcacatttgttgacttgcatgtgttaaaccacccctgcatcctagtatgaaacacacttgatcatcgtgggttatctttttgatatgttgttggattcggttagctagtcttttgttaaggaattttacatatgtgttcctcaaggatattggtcggtagttttctttttttggttatgtcctttcctggttttggtattagggtgatactgacttcacagaatgatttagggaggactccctctttctctatcttgtggaatagagtcaataggattggcaccaattcttctttgaatgtctggtagaattctgctgtgaatctgtcttgtcctggacttctttttgttggtaaattttttttttttttgagacacagtctcgctctgtcgcgcaggctgttgtacagtggcatgatcttggctcactgcaacctccacctcccaggttcaagagattctcctgcctcagcctcccgagtagctgggactacaggcatgtgccaccacacccagctaattttttgtatttttagtagatacagggtttcaccgtgttagccaggatggtcttgatatcctgacctcatgattcacccaacttggccttccaaagtgctgagattataggcatgagccaccatgcccggcttggtaatttttttattgccatttcaatcttgctgctgcttattggtctgttcaaggtatctaattcttcttgatttaagctaggcagattgtatcttttcaggaatttatctgtctcctctaggttttctggtttatgtgcctaaaggtgcttatagtagccttgaatgatcttttgtatttcagtggtgtcagttgtaatctctcctgtttcatttcttattgagcttatttggattttctctcttcttttcttggttaatcttgctaatggtctatcaattttatttatcttttcaaagaaacagctttttgtttcattgatcttttgcatttgtttgttcatttgtttcaacttcattaagttctgctctgatcttggttatttcctttcttctgctgggtttgagtttggtttgttcttgtttctctagctgcttgaggtgtgaccttagaatgtctgtttgtgctctttcagactttttgatgtaggtgtttagggctataaactttcctcttagtattgcctttgctatagcccagaggtttgggtaggttgtgtcgttattcattcagtttgaagaattttttaatttccatctcgatttcatttttgacccaatgctcactcagaagcaggttatttaatttccatgtatttgcatagtttcgaaggttccttttggagttaatttccagttttattccactgtagtctgagagagtgcttgatataatttcaattttcttaattttattgaggctcattttgtggcctatcatatggtctaccttggagaaagttctatgtgctgatgaagagaatgcatattctgtggttgttgagtagaatgttctgtaaatatctgtcaatatccattttttccagggtatagtttaaaaccattgtttcagtgttgactttctgttttttttttttttaagagggagtcttgctctgccgccctggctggagtgcagtggtgtgatctcggctcacagcaacctccacctcccagattcaagtgattcttctgcctcagcctcccaagtagctgggatcacaggaatgcaccaccaagctaatttttgcatttttaatagagacagggtttaaccatgttggccaggctggtcttcaactcctggcctcaggtgatcctcccaccttggcctcccaaaatgctgggattacaggcatgagccactgtgcctgacctgactttctatcttgatgacctgtctagtgctgtcagtggagtattgaagtcccccactattattgtgttgctgtctttatcattccttaggtctattagtaattgttttataaatttaagagcaccagtgttaggtgcatatatatttaggattatgatattttcctgttggacaaggccttttagcattatataatgtccctctttgtcttttttaactgctgttgctttaaagtttgttttgtctgatataagaatagctactcctgcttacttttggtttccatttgcatggaatatctttttccacccatttaccttaagttgatgtgtctttatctgttaagtgagtctcttgaaaggcagcagatagttggttggtgaattcttatcaattctgcaattctgcctcttttaagtggagcatttacgctatttacattaaatgctagtagtgagatgtgcggtaccattccattcattgtgctatttgttgtctgtataccttggttgttttttttttaattgtatttttgtttgataggtcccgtgagatttatgctttaaagaggttctgttttgatgtgtttccaggatttgtttcaagatttagagttccttttagcagttctcgtagtgctggcttggtagtggtgaattctctcagcatttgtttgtctgaaaaagattttatctttccttcatttatgaagtttagtttcactggatacaaaattcttggctgataattgtttttgcttaaggaggctgaagatagggccacaatcccttctagcttgtagggtttctgctgagaaatctgctgttaatctaataggttttcctttataggttacctggtgcttctgtctcacagctcttaagattctttccttcatcttaatttagataatctgatgacaacgtgcataggtgatgatctttttgtgtttaatttcccaggtgttctttgtgcttcttgtgtttggatgtctaggtgtctagcaaggatgaggaagttttccttgattattcccccaaatatgttttccaaacttttagatttctcttcttcctcaggaaggccaattattcttaggtttggtcatttaacataatcctagacttcttggaggctttgttcatattttcttcttttttctttgcctttgcaggattgggctaatttgaaagccttgtcttcaagctctgaagttctttcttctgcttgttcgagtctattgctgagattttccagagcgttttgcatttctataagtgtgtccattgtttcctgaagtttcgattcttttttatttatgctatctatttccttgaacatttctgccctcatttcttgtgtcatttctttgacttccttaaattgggccttgcctttctctggtgcctccctgattagcttaataactaatcttctgaattctttttcaggtaaatcagggatttctccttggtttgaatcgaagtgagctagtgtgattttggggggtgttaaagaaccttgttttgtcatattaccagggttggttttctggttccttctcatttgggtaggctctgtcaagagggaaggtctagagctgaaggctgttgttcagagtcttttgtcccacggggtgttcccttgatgtagtactctcccccttttcctagggatgtggctttctgggagccaagctgtagtgattgttatctcccttctgggtctagccacccagcaagtctacccggctctgggttgtctgcagagtcctgtgatgtgaaccatctgtaagtctcccagccgtgcataccagcatctgctctggtggaggtggcaggagggtgaaatggactctgtgagggtccttatctttggttgtttaatgcacgatttttgtgctgtttgggctcctgccaggaggtggcgttttcaagagcacatcagctgtggaagtatagggaggaacaggtggtggtcagggccctggaactcccaagaggatatgccctttgtcttcagctacccgggtgggtagggagggccattaggtggggacacggctaggcatgtctgagctcagactctctgtgggtgcgtcttgctgtggctgctgtaggggatgggggtgagattcccaggttaatggagtgatgttactaggaggattatggctgcctctgctgtgtcatgcagcttatcagagaagtgggggaaagccacagtcacaggcctcatccagctcccatgcaacccaaagggccaatctcactcccaccatgcccccgcaacagcaccaaatctgtttccaggcagtgggtgacagggctgagaactcgccccaggctccccacctcccagctgtgaaagcaagtagggctttcatgcttcccctactgtggagtctgactcgcgccctcccccgggttctggccaggagacttctccatcagctcaaattgttacaaagttcagctggaggtttccttctccctgtggccttctcccagtgcctctggcagccctcctcaaggcccccgtgaggcagggcagaaatggcttgctacgggacccatcgagcgagcccatagggctcttcctgctgcttcctctacccctgtatttcacttggctctctaaattgactcagctccaggtaaggtcagaatcttcttccgtgatctagaccttcagggttcccagtgaaggtgtgtatttgggggcagacaatcctgctttcccacttccgcagtttgggcactcacagtatttgaggtatctcccggctcctgcaggagcaatccacttccctcagagggtctatgggttctgtcggctttcctgatttgttcctgcagtcgctctggagcaagtgttcacagtgcaaggctccacatgctgctctgtctgtctgagtggaagctgcaatctagtcctgcctcccgtctgccaagatcctcccactttcatcaaagtcttaaaacatgccgcgtgcctgtagtcacaactactcgggaggctgaggcaggagaatcgcttgaacccgggaggcggagcttgcagtgagccaagatcacgccactgcactccagcctgggtgacagagtgagactccgtctcaaaaaaaaaaaaaaaaaaagtcttaaaacaaacatcacatcagcaaaataccgtgcatttgtagagtaggtgagccttttggaaaatgtgttcccccatctaattacattcccagcactagctgtcacaatgccaccattaaaatggggaaagacagagaatttaaaaaacaaaaacaaaccaaaaaaaacccagatttttaaaatgtgatcagttctgacactgcaactgctataaaaccaataaaaaatacaatagaaagagagcgggtttggcatgaagggctgtcttagttgtcacagatgccctctcagatgatgagcagaggtgttgccctgtccagatctgagcatacagctttctacataaaggaaacagtgggtgcaaggccctgaggctggaacgagcttggcatatttgaggaaccacaagaagactggggtagttggagaatagcaagctatgacagagtggaaggactgtgacaggagatgaggttgaagagagacaagaactagaaagggagaactcacaagtcatagcctggagtttagagttgatgctaagggccatggggagtcactgaaagtcagggatgtgtaagtaattaattgggaattttttaagtgaatatattgtccgcaaaaagtttgtgaagcagcttatatccactattcactttttacttaaataaatttacgcctatttttttttcttttttgagatggagtctcactcttgtctccccagctggagtgcaatggtgcgatctcggctcactgcaacctccgcctcccaggttcaagtgattctcctgtctcagcctctccagtagctgggattacaggtatgcaccaccacgcctggctaatttttgtactttcagtagagacggggtttcaccacattggccaggctggtctcaagcttctgacctcaggtgatccacccgccttggcctcccaaagggctgggattacaggtgtgagccaccgcacccggcctaattcacgcctattaatgtatttttcccaaatgcaaatagctctggttttcattttcttataaaatacctgagattctttcactgcgaatccttccaagtacctatgtttttataataccctatgtttctttaccacatcaattatagttacggttataaacaaattaataattggaataattatctatttttgtcttttcttacagactgtaagctcgtgtgtgcagattgagtgcttgaacactcagcacataactgagatgccagaaaatactttcattaaataattactataatcatataagctttattcacttactataatatgaatatttctcatatcaccaaacttttgcgttctacacttttgtatagttgcaatatcctgctgttgactaatgaagttcttccaagtttcaagaatgaatttttattctacataaaaatgttcctatttgcttaaatagttaacttacagggatttcttaggtccctgggctgctgtcttatctcagtgtaaataatagtgaaatggagtcttttaaagtgtctcctaatatgttgtgagttgatttatgtccctgaaaaaaggtatgttgaagtcctaacccctggcaccttagaatgtgaccttatttggaaatagggtcatcgcagatgtagttagttaagacaagctcatactggtgtgtaggggtgggcccttaatccaatatagtaacttgaatccttatttagaaagagaaggcatgtgaagagacagacacatacacagagagactccctgcaaggactgcagttatgctgcctccagccaagccactaccagaggccaggagagaggcttggaagagatcctgccccaggatcctcagagggaacatggccctgctgactccttgatcttggacttctggcacctccataactgtgagataataaattgctgttgctctaagccacctactttgtgatactttgtgacaatggtcctaggaaactaatccatcgtcagagacagctaaactacacttgctcatctgggcagaagttgtgcagatccatcttaatcataccccagagccattgctgtgatgcccacaaagctggatctcaagtcacagggacaagagataaaggggtaatttacaaaattaaacacagcctgcccagttacagttcaattttaggaaatcatattatataatactggaacatacttatacttaaaaaaaaaaggtgttgttcaaggtcaggagttcgagaccagcctggccaacatgatgaaacccccatctctactaaaaatacaaaaattatccgggcggggtgacaggtgcctgtagtcccagctactccggaggctgaggcagggaatcgcttgaactcaggaggcagaggttgcagtgagccaagatcgcaccactgcactccagcctgggtgacagagtgagactctgtctcaagacaaaaaaaaaaaggtgttgtctatctgaaattcaaatataactgggcatcctatgtttttatttgctaaatctgacaaccctaggaaggcgaccagcaggaggtaaacatgcccttgggacgtgctagggcaggcgatgtcttcacttctgagcactcaccctggcggtccacacttaacaggagttggcccagagagacggaagcaatccatgcaaatcccctctcaggctcagtgagatgcatttggaaaaggtgaaaaagatgtgcctcagagaatcagagaagcaaaaagagtgactgctagaagactgttgtaaaatgagtgggtaaagccctgttggaaatggaagaagataagaaaataaaaacaaatcctcctattgccattacttgtgctttgtgacattgtttattaaccaagtagaaatattaccttaaaataccagagattataactaagacactggaagagggatgtaagaaagaatgtttagtttctgtttactactagaagaggctcaagaaaatgttgaagtgtaacacagaaatgaaaatgtattttaaggctgagtgcggtggctcacgcctgtaatcctaccactgtgggaggccgagtagggaaggctgagtgtggtggctcacgcctgtaatcctaccactgtgggaggccgagtagggaaggctgagtgtggtggctcacgcctgtaatcccagcactttgggaggccgagtagggcagatcacctgagtcaggagtttgagaccagcctgaccaacatggcaaaaccctgtctctactaaaaatacaaaaattatctgggcctggtggcgtgcgcctgtaatcccagctatgccagaggctgaggcatgagagtcacttgaactcgggaggcggagcttgcagtgagccgagatcgtgccattgcactccagcctgggtgacagagcgagactctgtctcaaaaaaagtaaaaataaaaataaatatttgaagagggctaaacaaattacagcaaaatttcctggcattaatataagagcagatgaagatgtccactctcatttgatgtttgtgatagagaggatgatggaagggcccaaagttagataaattcaagaagctcgcaaaagaacgtgcacttctgggtgttcagacaaatggatctggcagacacaaagcccagaggctgcaggtgaactagcttgaggataatgaatagaaaatgcaaactacccccaaaaagagtgacacaaggaaaatgacgttctgaagtaagaaaggggccaaaaacaggaaagacggaagcaggtaagtttgataatgatgctgaaaaggcctaaacaggattttgacgcaagagatagaattactttcccaaattgcagggttcagcatccagaattcagttgtcaaggttgaattcaaatttgggttaggattatcccaaacaaaaatgataaggaacactcctacattattgtgggaataaatccaagggaatttacttaggctggggaaagtatgtttaaaactcagtagctcccatttcaatggcaaagacacagtaattttcctaaaacaagaggcctgctgtgcattttctagtaagaacctacaaaactgaagctggtgaataaatcatttaaatcaaggaaaggagatacgctgcaacgcttaaagcatcctagaggagtgtgactgtcaaaaataccttctgattatgtgacgtgtttaagactggagctctcacgaaggatccatttgaccactgtgcaatctaagcgtgaggagagtgtgaaggtcagtgatctttctgctaatactgaacatgtctcagactacgccaccggagacagggagttgcatcaggaaacaccaaaggaagagcaaaaggagaagctgaaaacacaagaaaaccaaatgcatttataaaaaaaaaaagaagaagaaacatcaagctgccttcttcaggtctaggagactgtgcattgaatttgcacagaagtttctagcgtgatggatgaaacctggttgccatccaaccaggaaaaagaaaaagcaacattaaatgtcgccagggccttttccctgcagtaataacacaactggcaaggatatcctgaatatagcacataaatatgttctttctgcttcttgctagcaggagatacaaacagcctcttccacgttttcatgttcatgtttattaaagtcacagacataaaatgttaaggttctaaagaatgaaaatgtcagtgttggtataaaagtatgaacaccttgcacaggttattttaggaggaaaatttgatcatggcaccatatattttcatatatattttaggattatccaccaccataaatgacatttctcagacaactgtaaatagatcactgcacattgcagtcatttgttcactgagcatgcacagccaggtgctgtggagggaacaaacatgaaaacaaacacacacaaatgtggggcccgcctgccttcaagctccaagagccagactctctaatgagccattaagcatgatcagaaacacaaaacggaaacaaaaccacaccgtaatttaagataaaaagtgattaagtgtcattagagaagcagaggtaaactgtaaccagagttctgagaagagtgtccagggacaagctgagaggccgtcagcgttgcacgaagccttgctgcctgcttcaaggacatctggtctgccggcatctgagggaagaggctgaacaaagtatttccttagcacaaacagaaaaataaatactttgagttatgtaggatattgacattggtgttcatgtacttagtaggtctcatactgttttgctgtaataaccccagtggtgaagaaaagcaaatgtatacccctagtcaatgtggggtgacggcccaagcatcctgtctcaaacaaaacatgtttttgctgtctcttttgttgttgttgtttttgagacacagtaccccaggctggagtacagtggtgttatcatagctcactgcacctcaaattcctggattcaagcaagcatcctgcctcagtctctcaagtagctaggactacaggcatgcactaccatgtctggctaattttttcattttttagtagagatgggggtcttgctatgttgctcaggctggtcttgaactcctggcctcaagtgatccttccacctcagtctcccaaagtgctgggtttacaagtgtgagccaccatgctgagtgaatgtttcacatttaatctcaaaaattcatgtaaattgttcattctactgcatatcatatcctagttcagttaaaatggaatcgttagttatcaggaaaataaaaataaaaaccataataagataccactttataaccactagtatagctataataaaaaagacagataataacaagtgttggcaaggatgtggggaggttggactcttctcatacattgcaggtgggaatgtaaaattctgcagctgctttggaaaacagtctagcaattccccaaatggtgaaatatagacttaccatatgacccagaaattccactcctaggtatctacccaagaaaaatgaaaacccatgtccacacaaaaacttgtatacaaatgctcatagcaacattattataatagccaaaagcggaaacaacccaaatatctatcaactgactaatggataaacaaaatgtgatgtattcacatgatggaatatgatttggctatgaaaacgaatgcttcaacctggatgaaccttggaaacggtaagtgaaataagtcagtcacaaaggactgtatattttatgattccattcacgtgaaatgtccggaataggtaaatctatagacagatagtagattagtggttgcctagagccagaaagaacagggaaatacagaggtgatgaacaaagagaataggtttctttttggggtgatgaaaatgctctaaaattgaatgtggtggtgattgcacggctctgaatagactaaaaatcattgaattgtacactttatatgggtaaattgtatgatgtgtgaattctatttcaatacagttgttgcaaaaaaagaaatttatatttttaaaattttgtttttagagacagggtctccaatctgtcacccagattggagtgcagtggcgatcatgacactgcagcctggaactcctggccccaagcgatcctccctccccgctcagcctctcaaagtgtgattacaggcattagccaccttgcctggcctaaaatggaatttttaaatcctatgcttaaaaaaaaaaaaaactgcaatagcacatgctaagcttgacaaaggcgactaatagaaaaatttctgaaggaaaacaggcaagtctgccatatcccctcccccgaggttattaaaagttagcagtttggaacatacttgccagcctttttctatgcttttacctactaaatgtgcacttagacgtttatgtacgtgcatttatgcaaccttgtttctaagaaaattaaataatttgctgccagcatactcataacctccccattctttctgcgaagtggctacttcctataccactggaacaaaagtcgtgtgcgtaacccaacatgagaagcgcacgatttagttcagtgttctccgtcctccacggttcgcagttgtcacctccaaggcctctgaggatgaaggactgggacaggcagaggcagagcccctgccgggaagcagagaacattaaggtggcagcctcagccctgcctctccacttgcccaggccagcgttctcagcgcacctgccgcgccacaccccccgtgccacacccccctgtgccacacaacccccgtgccacacaacccccgtgccacacggccaacacacgccacacgcccccgcgccacacgcccccgcgccacacggcccccacgcgcctgctgctgcttcctgccctggcacctgtcctccgctctcttctctctgtgccgccctcttccattgagtgctgccgcttacccagagccgaaacgtcatctgcccctgggatttccgtggctgttctgagtcccacacattcatctccctccagtcctggaggcctctaggactgcggtagggaggggaaagccgccgcgagtgggccagcttgtcagtcaccaaaccccctgcattaggactaattcttacctcatatgacttgtttccttttgcttttagagacggagtctcgctctgtcgtccacactgcagtgcagtggtgtcatcgcagctcactgtagccttgaacttctgggctcaagcgatcctcttgcctccgcctccccactagctaggactacaggcaggcaccaccacgcctggccaagattttattttattttttgtagggatggtctcactatgctgcccaggctgtgtggtccaaactcctggccttaagtgatcctcccacctcggcctttcaaggtgctggggttccaggcatgagccactgcagcttgcctgttttgaggattactcgcatacacaaagaggcatgcagacttcagcaaggtgatttttattttcaagatcacagagctaatcaatatcggaatctggattgtgacacagatcccttcctccatgtttaatacactttccactctacttctgatatgctttaaacagtattccaaaatgattgttaaagaggacattttgaacatatgtcagtaaaataattgtattacaggaagcaaataaggaggcatgattgtggcattctcagccatttttaaaaaaatagttcatgtttcctcttagcacttccattgtgtgagcagagtctgtaataacgtgctcagtctacaacatcacttcatatttttcatttcatatgagttcattttttgcaggtataagaaactatcttcaggtttcagataaaattgcaactgaacttttaaaacctaagtttttgttgagtccaggccataaaaatctatcagaaggacctaagccatttaatcatccagattatcagcacttctacaaaaaggttttaaatggcaagaagataaaatgttaagtgaggatagtaattatttgcctttatctcttgtgccaggtttcaaacctcaccatatgggtgtttgtgcaagattaaatagctattcaagtgtgtaatgaagtatagatactaaattgaaccaaaagatatagcatggaataggtcagagaagatccactctgcagaaatggactatgaaagagttgattgatagatattcatgattccaatccgacgtgtactttgagggccttttaacaaaatagagaaaattcttctttttaaattatttcctataggaaacaaaatactacgggggaagtagcaaggaaatttggggtgaaaaaatagactgccatctgcaaatatcctccagaagtagactgaatgaataacttgatttgctcaggatggcccagtgtaagcattaataattaatgtcaatctccttttactcttagaaatgtcctagtttcataaattacggtcactctatctggaatgatttttgagagctatcgtcagagtcaaaaaaacttaagcatgaaacttgcctccacaataagtcactaaatgtgctttcaagaagacacttgagaaggaaaggggttataaaaggtttagaaaatctgagctatactctaggaatgtgatagtcaacgtgtgtgtgcatatgcataacagggagagggagattgggaggccgaggccggtggatcgtttgaggtcaggagtttgagaccagcctggccaacatggtgaaaccccgtctcaactaaaaatacaaaaaattagctgagcatgatggcacgcgcctgtaatcccagctactcgggaggctgaggcaggagaatcgcttgagcctgggaggcagaggttgtcacgagctgagatcgcaccgctcaactccagcctggatgacagagtgagactctgtctcaagaaaaaaaaaaaagagagagagagggagagagagatggagagataagcaacagtttaggtcatctgatgcaggatctgttcacccttcactcagaactcaaacaatggggaatggtaaatgtatcaagattcatgtaaaactggaataaaatcaatatattttagaagcaagatgtgaatttttcaggaaacacagaaaagcaaataggatgaatgctttcgtttgtaaaaatttccaagatatactattagatagcaaaagcatacagcaaaacataaagtgtgattctattttttgaagacatattaaatatttgacatgctttagaaaatgtctgagggactacataccaaacagttaataatagtgttgtaaatgggtaattgtttctatctgggttaaatgtgattacatgcttactgcttcccctctgtgtgtgtgtgtgtgtgtgtgtgtgtatgtgtgggtatgtatgtgtgtgtgtatgtgtgtgtgtgtgtgtgtgtaagtgtgtctctccgcctcagtcacaacagaggtttcttcttcagtgtgaaccctgacatgagaaaacacgcagagcccagcagagattcagctgcctagcagccgcgtgcagtgtgaagaagaaatcaacagagggtttcggttacagcacaaagtgactaatacaagcggtcataggtgaagggcaagattcctaaaaagcgtttttccgcatttatttctatgatgaaagactttcttatagccagtactaatgatgaagctgtgcaacaacaatgaaaaaaattcaagcttctcatttattcccttcttaccccctcctcattcacagccacaaaggaagtactaccaccaccaaaccaccaaaaggcaaagggtagacaatgattttctgaggtttctttcacctctaagttatatatatatttttttgagacggagtctcgctgtcgtccaggctggagtgcaggggcgcgatctcggctcactgcaagctccgcctcccaggttcacgccattctcctgcctcagcctcccgagtagctgggactacaggcacgcgccaccacgcccggctaatttttgtatttttagtagagacggggtttcaccgtgttagccaggatggtctcgatctcctgacctcgtgatccgcccgcctcggcctcccaaagtgctgggattacaggcgtgagccaccgcgcccggcctctaagttataatttttattgtaaaaaatagatgcatatttagatatgtgtgactttgggggttgtgttttaaatagcagctgattttgttttagtctatattagcatctcaggttcttttttaaaatctaagcaaatcaaaatgacttttcagaccaaatgtgtaagttttaatccatcctaatttcatgatgaactaaaaagcacaactgggtcatagtggaatcaggtcattcaatataaattactacataactaattcagttgcaactcaattgaaaaggtaaatagtcatgacaaccaagctaaacaattcttctaaggtagtttatggaaacataggcaaggcttcttttcatgaattttaaaacatccttcctttgtagagatggtgaaatatgtgccctccttttcccctagtttctcctcagataacctcattcaacctcatggttttaaataccttctctctgtggctgctgatgaccaaatttttaatctagccctgaaacactcttcaaacattcagacttcttgaaatcaaaacgctttcttgaaatatctcataggaaccttgaatcaatctcaaccaggaggaactgcctgactttctccagcatttcctacttcaggaaatgccattgttaaagacatgttcgctgaataacctcaagggttgagaattcaagtgaaatactaaaattcagtctgctgccattttaagtagccataaaaaattaggtcccctatataaagaaatacatcaagttcaaaaatctttaaaattaaatggaaaagatattgacatgtcttaggatcccatcaaggtttgagttttataacctgtattctggataacctcgtttcactgagatggtaaatctttttcagtaggctatctttccacatgaggaagattaagaactacgtgaaaatgtttaagagaatcaaagccaagatataatattttgtattaaaaagaatccctctctacttggtactttatgttataatgtttaagatcatttgaggaattacaatgacagccttttaactttaatttatgtacaaattaataatctgtttagattaatggcttctgttattctctgtatcacagtaacacaaatgcacatctccacatacaattttttctcaaagttttatacaatcaactgcctatttgacatctccactggaatgtctaaacagaaaccttacgtgttaggtgtccaaaacccagtcctgactttccccctaaacctgcagccttccccatttcagttgatgacaagttcattcttctctattcctgagaccaaactccctggaagtcatattagactctgcttttctcactccccacatccaatccattatggaatcctagttacctgaagtttgcacatatcccacatctgacctcattcacttccaccaaagtgacttctgcctcctttttgccctaaagactgttctaaacatagcagtcagagtgatccaggtaagacctaaatcagatgctgtctctcagcatcactcagaataaaagacaaagtccacacaaggcctgaggagctttccctccccattaccagtttaacttaatctgccgctgccctgcccctcaatctcctcggacaaagttggcacgctctctgcactggctttgcactggctcttctcactgtccaggacttcctttccccagatcaacttggcaaattccttcacctgcttcacattgtcacttaaatgcaccgtcccaataagactcaacctgtccatcctgtttaaaattacaactcattttaaattcccaattgctctgatcatgttctattgttttccttcttccatagcaggtatgtgcgtatcacctaattatcacatcatttactgatttgttacacttatcatttttatttattggaaacaaatgctttctatttgactgtattaataagttccgggaggaaaggggtatttgtggatgcttcccaagtgcttagatcagtgcctgacacatagtggccactcaatacatatctattattgctgacttgcgactttcagtaaacatcacactaagttaacaacaatatcatatattaacacatgaggaatattccaaaaaatacagattttccgcctctcagaccagattgctgcttacttggtgttttgtttgtttgttttgtgttttttgtttgtttgtttgtttgtttgagacggagtttcgcccttgttgtccaggctggagtgcagtggcctgatcttggctcactgtaatctctgactcctgggttcaagcaattctcctgcctcagcctcccgaatagctgggattacaagcgcacaccaccacacccagttaattttttgtatttttagtagagacgggatttcactatgttggccaggcccagttaattttttgtatttttagtagagacgcggtttcaccgtgttggccaggctggtctccaactcctgacctcagtaatccacccgcctcggcctcccggagtgctgggattccaggagtgagccaccacgcccggccctccttgggatttttaaggtagtgcattacggtccatctcactcacctaccagcttcttcaaaacatcttcaagaaacaaattcccattttggttgaagattgcactttgacacacgcatttaagtataacagtatattctatagtaatttgagaagtcctgttggggttaaaaagcaaattctttatgtctccaatgtactttctccactatgatcagtggcttctcaagagtaactccttgaataagtcacacatttctgccagtttaataccagtcttggcttctctctgcctcaggatgcagccaatactcctgaatgtggctaagaaagtccttcataagcacgtttctgccattcctttagaatcctcttttgacacaattccctctcagcagaaacataaactctacctgaacctaccattttctgcctttaggttttaaatatgctactctctttgcctacatcacctcattcgctaatgcctactcaaccacttgatcacattccaagcttttagttttcttccttcccaaagacttccttaatccttcaagaactggataaagggttccctgagttctcataacttctcataatgacccgcatctttgcactgttccctccagtgagctaacacagtgttgggatgagggaggcgctaaagagacacttgccgaatgaacgagtgaattttctgaagaagcagccagtgaatcggagccggcaatttctctctcaacaatgctctctgctgtgccattcaacgaggccacaatgccattgtgtgacaatggtatgatgacactgcttgggccataacagaataattctccagataacatatgcacttgttatgcagctagatgcttttatgattgcttttggaggtgatgtggcaaataaattttttacttttataggactgctgacatctcacagaaatttttgacaaatattcaactcagatatgattttggttctactttatggatttcctgatcctttatatactacattttatttctttatgagcttactctgtttcatttttagccctcaaattcaatgaccaagataatgtaacagcatgagcacagaatatgacctctgctcagaagaattccatttccatgtaatatatgtacagggcttggtgaaggatgaagctgctcttcagcctccctctagttatcaactaacacagcaatttctgatgctttattatttttttcctgaatggctttttctgtagtacccattcatgccttctgatctaattagtataattagccttggacacataagaaacaaagcaacaaataaaaaagcccataaaattccatttcaataccctgcctttcatagactttatggaactaagtattcagctgtcttcatagctcataacctttaatcctaacatcaatctcagtgttctattcaattacaactgctgtctattgagaagtagcaaaggttttgaagagtttgtgggaacgtggaagttgccccattcattttcattagtaaactcaggagacacaaatttcactaaaattgctgacactgttcctgctgtgtctggatgatttattattagacttcatatttcttccaaaatatggtttaaggaactcaagaaaatcatgcgattgttttacctgaaatatgatgtaattttatcacctgtgcactaaagttgctgactgcaacttggacagaatagcacaaaaggctttgcatggctggagggaaaggaaataaagagtgagacccataaccagcacagagtacagcacggttagttcctatgacagagacaacagaggagaaggtgtatgttgtatttgtttttctgagacaggatcttgtatgttgcccaggctggaatgcattggcatgatcacagctcactgaagcttcaacctcctgaactcaagtgatcctcccgcctcagcctcccaagtagctgggactataggcatgcaccaccatgcctggctaatatttttttaaattttatttgttgtacagatgtggtctcacgatgttgcccaggctggtctcgaactcctggcctcaagcagttctcccacttcggcctcccgaagtgctaggattacaagagtgagctgccacacccggccaaagtgcacattttaaaaaggcaacttgctgcacctagaaaaatagaaaacaattgttatttaaaaaccaagtcatgaccttttgaggcaatatcccagcgctaaacggcaaatgttatcacttgtaaaagcaattaagaaaattgttaggctgtggtgacagtgtcactgaggagcttttaagagttattttcctaagaacaatatgcaagaccttgcacacctagcccagcttacttgtcacggcttataacccgaatgccatcccactgtccacacttaaggaacacagtgctggcccagcatccccattcccgggtgcactttaggaccaccttgggagctgttaaaaattatggctgggtgcagtggctcacacctgtaatcccagcacttcgggaggccgaggcaggaggatcacctgaagtcaggagttgaagaccagcctggccaacatggtgaaacctcatctctactaataatacaaaaattagccgggcatggtggtgcatgcctgtaatcccagctactcaggaggctgaggcaggagaatctcttgaacccaggaggcggaggttgcagtgagccaagatcacgccactgcactccagcctgggtgatagagcaagactccatctcaaaaaaataaaaaataaaaataaaataattatgcctaggacccagcccagaccgactgagtcagaatctcggcggggagcattccgggtgattctaaggtctgggctctgcggggagcattccgggtgattctaacgtgtgggctgtgctgagaaccacggctttcaccacatcgagcgactgaccttgctccagtcaaagaatcttttccccccttttgctcatgtcactccctcaatctgcttttatgcagttttggctttgtctctccaggcttcacttaaatgctgctttcctaaagcaatctccatattcttccagcttttcctaaaatccactcttggatcagctagatcagctgagaatcggaaaccggcgctgaactgtactagtatcctacagaagcttcttgacctctccgcatccaggcttccacatgccaccaccagcctatttgttcttacaatacatgacccagtcacattcgtcctgttgaggactctcactaactcagaaggtattttcaagcatgtggagtacattacaattttctcttcatggcaaatttccaggagtaatttcttctgattcttaaaggagtgacatttgtctcgagcaataaggattttttgttatcttgtggatgttaggaagcatgtaactaatccgttttctctttatgagtttgctgctacaaagtttaaagccaatctgtgacccactggtggaagatgtggtcattatctgcatgatttcaaatgatttctggctttcttttctatttccaacccacatttttcattatttgctgatggcaagtttaatttgtgctatcttgttgtgcttcccctactaatttattttaccttacattgtttattgaacaatatggtgcaaaagttaaattaaaagcaaatttctcttgagttgtttccaatatttgtgtcaaaattatcccctaatctgtgcttctatagtcttttcttttttcccagatcgcaaccctaatgttattctactttgcttcgtagttagctgtatctcctctttccaattctaagtatcttggaagataatgaacatatatcttatgaattttgctaaaatccataaaaaataaatagaaattggttaataagtgtttatcattgcttgctgctaagaatacagagctaataatacttgctttgaattccaagttcattatgcaccaactggagaccttaagcaactgaatctccaagcctcttttttctaattatgaaagaggaaaaatcgaaaatactgtttacctcacaagattgttaagatgccgaaataatttttgttaagttactttttaatggcgaaatacaacccacatgactagtaaagaaaaggtctagaaagcctcatctgtgacttccttatatacacatgtatacacacatgcgcacacacactgagtctcagacactaggggaaagcttcggcccatgggtaaagaggtaggcagaaatgagattcccgcgaggtcttcctagccaggacgaaagcttccagatcacaatctaagaacagtgggataccactgaaggattttaagcagatgtgtagtgaaattgcatatttcagtcttggaaagtgactctggcttttgtgctctagaaagcatatggatacggggaacgtgacagtgaaggaagcagggatatctgctaagcagctactgcaatagcaaatgggaaagcaagatcagcttaaggcaccctgacatcatgaggtagccacactgagatccaaagctatgttctttcttttttattattattatactttaagttctagggtacatgtgcacaacgtgcagctttgttacatatgtatacatgtgccatgttggtttgctacacccattaactcatcatttacattaggtatatctcctaatgctctccctctcctctcccctctccccataacaggccccagtgtgtgatgttccccaccctgtgtccaagtgttctcattgttcaattcccacctatgagtgagaacatgcggtgtttggttttctgtccttgcaatagtttgctcagaatgatggtttccagtttcatccatgtccctacaaaggacatgacctcatcctttttcatggctgcatagtattccatggtgtatatgtgtcacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatgctatttctagttctagatccttgaggattcgccacactgtcttccacaatggttgtactagtttacagtcccaccaacagtgtaaaagtgttcctatttctccacatcctctccagcacctgtggtttcctgactttttaatgatcaccattctaactggtgtgagatggtatctcattgtggttttgatttgcatttctctgatggccagtgatggtgagcattttttcatatgtctgttggctgcataaatgtcttcttttgcgaagtgtctgttcatatcctttgcctacttgttgatggggttgattttttcttgtaaatttgtttaagttctttttagattctggatattagtcctttgtctgatgggtagattgtaaaaattttctcccattctgtaggctgcctgctcactctgatggtagtttcttttgctgtgcagaagctctttagtttaattagatcccatttgtcgattttggcttttggtgttttagacatgaagtccttgccatgcctatgtcctgagtggtattgcctaggttttcttctagggtttttatggttttaggtctaacatttaagtctttactccatcttgaaataatttttgtataagctgtaaggaagggatccagtttcagctttctacatatggctagccagttttcccagcaccatttattaaataaggaatcctttccccatttcttgtttttgtcaggtttgtcaaagatcagatggttgtagatgtgtggtgttatttctgaggcctctgttctgttccattggtctatctctctgttttggtaccagtaccaggctgttttggttactgtagccttgtagcatagtttgaagtcaggtagcgtgatgcctccagctttgttcttttggcttaggattgtcttggcaatgtgggctcttttttggttccgtatgaactttaaagtagtttttttcaattctgtgaagaaagtcattggtagcttgatggggatggcattgaatctataaattaccttgggcactatggccattttcacgatattgagtcttcctatccaagagcatggaatgttcttctatttgtttgtgtcctcttttatttcgttgagcagtggtttgtagttctccttgaagaagtccttcacatcccttgtaagttggattcctaggtattttattctctttatagcgattgtgaatgggagtttactcatgatttggctccctgtctgttattggtgtataggaatgcttgtgatttttgcacattgattttgtatcctgagactttgctgaagttgcttatcagcttaaggagattttgggctgagacgatggggttttctaaatatacaatcatgtcagctgcaaacagggacaatttgacttcctctttttctaattgaataccctttatttctttctcctgcctgattgccctggccagaacttccaacactatgttgaataggagtggtgagagagggcatccctatgttgtgccagttttcaaagggaatgcttccagtttttgcccattcagtatgatattagctgtgggtttgtcataaatagttcttattattttgagatacatcccatcaatacctaatttattgagagtttttagcatgaagggctgttgaattttgtcaaaggccttttctgcatctattgagataatcatgtggtttttgtctttgggggcagtctgtccgttctcagatctcaaactctgtgctgggagaaccactactctcttcaaagctgtcagacagggatgtttgacgttctttcattttaaagttattatataatcatggattcatttgtctctttggaagcatcttctctgtataagtaattaaaatattttcaagcaaagtactttcacagttctgcaggctgtgcaggaagcatggaagcttctgtttctggggaggcctcaggaaccttccaatcatggtggaaggcaaagggggagcaagaaatctcacatggtgggagcagaagcaagagagaggtgggagagggaggtgctacacacgtttaaacaaccagatctctggcgaattcactcactaccatgaagacagtatgaagaggatggtgctaaaccattcgtgaagaatctgcccccatgatccagtctcctctcacgtggctccacctccaacattggggattacaagtcaacataagatttgggtggggacacagatccaaagcatatcattctgctcctggccctcccaaatctcatgtccttttcacatttcaaaacacaatcatgcctttgtgataatccccagagtcttaactcattctagcattaactcaaaagtccaaagtctcctctgagacaagactagtccctcccatgcatgagtctgtaaaatcaaaaacaagttagctacttccaagatacaatggaggtacaggcattgggtaaatactcccattccagtaggaagaaattggccaaaagaaagaagccacaggccccatgcaagtctgaaacccaacagtcattaactcttacagctccaaaatcgtctcctttgattctatccctcacatccagggcacactgatgctaggggtgggctcccaaggctttgggcatttaacttctaaagctccatatctaaaattaaagatgaatggataactttttactatattagtttttattcttaatgtatttctctttttgtgttttgttttgttttgtttgagacaggatctcgctctgtcaccatggatggagtgcaatgacatgatctcagctgtctgcaccctccacctcccgggctcaagcaatcttcctgcctcagcctgtcccaagtagctgggacacagggcacaccaccatgcccagctaattttttgtattttttgtagagacagggtttcaccatcttgcccaggctgggctcaaaccgttaggatcaagcaatccacctgccttggcctcccaaagtgctgagattacaagcgtgccatctctcctggccctaatttctctttataaaatcagattttgttggaagtatcctgtttgctaaaaccttgatatctgatgcacttagcatagaaatcaggctggaaaaacgaatttgtaatagatatctaaaactaaaaaatgtaagagtcagaagcttaaatttttacctctttttggacggatgtttttctaaaataaacattttcctgccttttcaagtaaaaacattgacaataataaaaatgtcccttaatcatcctgaatcattagatattagttttattcttcatgtaattgactcagtggtgtttaggactagtggtctctaacttcaacaagtgtgggatggtccatggcgtgaaaagagggatagggtttgtctgaccctctctagtggggatgacccacggcctttgctgatgcctgaagcctacagcaaggcaatgtgtacaaacagtggcttcaccttccagaacattttctttctctctgttcttagtagttttgacttgtccacaccattcaagctaagtgtcctttataacaataaagttgaaactagcaaaaacgtccaactctgtgtggttcattaaatactatactgttgtgagcaaggatgtaatttttgtcagggatgggcttcccccatgccccctctaagattacataatacccaaaattacataagattacacctaagattacataatacccaaaagaaagggtagccctaaaatagtgatgctgaggagatactagttacatgaaaaatgatcacaaaaacaataagaactcacatgacagatttttcacttttaaaaatgtattttacataatagtttgatataaatacattctatgggagaataatatatatatttatatcaaatatttaacgtctagatttttttaagttaaaataacctccttgagcacccagttacactttctttccttccatatcttctttcgattccacttccctgaccatatgtgagcactgtttgtgctttccaaacattttcctagacatcagcacacacacacacacacacacacacacacacagttcaaatataaaatgctgctttttccaaaaatgtgatcatatcctattaaatgacctgccttttttccacttatctgtgaaaactttttatgtcaatacatatatatatgcattatatatatgcattttatacacacacacacacacacacacacacatatatatctgcctcggtctttttaattgctgtggtgtattacatatcatgtgtaccataattttttttttgagatagagtctcgctctgtcacccaagctggagtgcagtggcatgatctcagctcattgcagcctcttcctcaagttcaagtgattctcctgcctcagcctcccaagtagctgggattacaggcttctgccaccatgcccagctaatttttatttttagtagagatggggtttcgccacgccggccaggctggtctcgaactcttgacctcaagtgatctgcctgcctcggcctcccaaagtgctgggattacaggagtgagccaccgcccccagccttcagacagtatatatttttgttaaatccaattcttcactgttaaagaatactattttacattaatctttgtatatacatgtgactataatgaatatcctttgtacataatatgtgctctttctccctactcatacgtaaaattactgggtgaaaggttacattatatttaaatctgacatatacttgcaaatgccccaccaaaaaagccctgaaatttgaattcccactatcagtttttgaaagttcctattctcttacctcttcctccatgctgaatattatcagtctttttcatttgtcctcatctcatgaataaaaattacatttgtcttaatttaatctgccttattaactagttttatgtgatactaagtataattttctgtcattacatgttttctatcagatttgttatcttttattgatctttatgtgcttgatattatcatagagattaatgctgtattgtaaataattttcccatgatttttcattgtactttttcatgtgggtttttgacatagatgctttagatttttatatagacatatctgtcatttttttctttatgaattcttagcctatgtttagcatagatttttccaatgttgagattaaaaatattttctattctcatgaaatttcctttaacattgttataattttgtaatctatttttatctctataattcatctgtagtttttctggtttgaggtgggaatctacccttaattttttgtttgtgtcaattgataaccagtagtctcaatcataacctttccttattgacttgaaatataatgcgtaacagctgccaaaatgtataggtctataccaattttcttctagactttctattgtcttcctttcatttatttattaatttttgtaccaatgctgcagtattttaattatgtttgtcttgcagcatattctaatctctggtaggacctttccttttactatttaatttttttacttttacctcccacctcaacgtcctgagtagctgagactacaggcatatgccacaacacctggctagttttgtttgtttgtttcgagctcctgtaaaaataataactattatttattggaaaatctctacacctcagggactatgtgaagcatttttacatgaactattttatttaatcctcataatggccctctgagaaagtgtaatgagttgaatgatggccactcagaggatatgtccatgtcctaactgctagaacctgtggacgtgacttttgttgggaaaagagtctgatgatgcaattaaggatttcaagatcatatcatcctggattatccaggtggatcttaaatccaatgacagttgtccttataagagaaagtcagaaggagatttgatgcagaggtgattgtgtatttagaaaccccatcgtctcaacccaaaatctccttaagctgataagcaacttcagcaaagtctcaggatacaaaatcaatgtgcaaaaatcacaagcattcctatacaccaataacagacagggagccaaatcatgagtaaactcccattcacaatcgctataaagagaataaaatacctaggaatccaacttacaagggatgtgaaggacttcttcaaggagcactacaaaccactgctcaacgaaataaaagaggacacaaacaaatagaagaacattccatgctcttggataggaagactcaatatcgtgaaaatggccatagtgcccaaggtaatttatagattcaatgccatccccatcaagctaccaatgactttcttcacagaattgaaaaaaactactttaaagttcatacggaaccaaaaaagagcccacattgccaagacaatcctaagccaaaagaacaaagctggaggcatcacgctacctgacttcaaactatgctacaaggctacagtaaccaaaacagcctggtactggtaccaaaacagagagatagaccaatggaacagaacagaggcctcagaaataacaccacacatctacaaccatctgatctttgacaaacctgacaaaaacaagaaatggggaaaggattccttatttaataaatggtgctgggaaaactggctagccatatgtagaaagctgaaactggatcccttccttacagcttatacaaaaattatttcaagatggagtaaagacttaaatgttagacctaaaaccataaaaaccctagaagaaaacctaggcaataccactcaggacataggcatggcaaggacttcatgtctaaaacaccaaaagccaaaatcgacaaatgggatctaattaaactaaagagcttctgcacagcaaaagaaactaccatcagagtgagcaggcagcctacagaatgggagaaaatttttacaatctacccatcagacaaaggactaatatccagaatctaaaaagaacttaaacaaatttacaagaaaaaatcaaccccatcaacaagtaggcaaaggatatgaacagacacttcgcaaaagaagacatttatgcagccaacagacatatgaaaaaatgctcaccatcactggccatcagagaaatgcaaatcaaaaccacaatgagataccatctcacaccagttagaatggtgatcattaaaaagtcaggaaaccacaggtgctggagaggatgtggagaaataggaacacttttacactgttggtgggactgtaaactagtacaaccattgtggaagacagtgtggcgaatcctcaaggatctagaactagaaatagcatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtgacacatatacaccatggaatactatgcagccatgaaaaaggatgaggtcatgtcctttgtagggacatggatgaaactggaaaccatcattctgagcaaactattgcaaggacagaaaaccaaacaccgcatgttctcactcataggtgggaattgaacaatgagaacacttggacacagggtggggaacatcacataccagggcctgtcatgtggtggggggtggggggaaggatagcattaggagatatacctaatgtaaatgacgagttaatgggtgcagcacaccaatatggcacatgtatacatatgtaacaaagctgcacgttgtgcacatgtaccctagaacttaaagtataataattaagaaaagacttagaaaaaaagaaaacgtgctacatatatgccatggaatactatgcagccataaaaaaagatgagttcatgtcctttgcagggacatggatgaagctggaaaccatcattctcagcaaactatcacaaggacagaaaaccaaacatcacatgttcttactcataggtgggaactgaacaatgagaacacttggacacagagtggggaacatcaaacaccggggcctgtcgtcgggtggagggagaggagagggatagcattaggagaaatacctaatgtaaatgacaagttaatgggtgcagcaaatcaacatggcacacgtatacctatgtaacaaacctgcacgttgtgcatatgtaccctagaacttaaagtataataataatttttaaaaattaaattaaaaattttctattcagtaatatagacactagataaaagacacaaactatcttttaatgaatggctggtctttggaaattgtaagggaaagttccaggggcctacagaaaaaatagtgagctgaaacaagacagtgcctccaaactagaagacttcaggaagggtatatgattttgtagtctgggctcaaatagtttaaggtagaactttctatccaggaacttgttggaactggacaaaccttgtgacatgtgtttcgggactggtggagaaagcaaggcaaggtcttttagtattgatgaacacaatgttttggtgagaatcaagctgtttttcctaataagcaaaggatttttttctgacaaacaaattatttgcccacataaattgatttgaaataatttcctaaagcaagtagtgaagttatttattggtttgcagacttatctttctggggaatgaatttcccagagaaaacggtaaagttttattaacagagaaaataagaaaattgtttgctcttccatcacatttaaaataatatatatttaggcccagatgtagtgcctaacacctgtaatcccaatagtttgggaggtgaggagttcaagaccagtgtgagcaacatagtgagacccccatctctaaaacaaacaaataaaaacaagaatacatatctaaactggtgggaataaaaataatgagaatacatatctaaactggtgggatgcagccaaaagcagactttaaaggcagactcatgcactcaaacgcagcgacgaggccaggtgcagtggctcacgcctgtaatcccagcactttggaaggccaaggcagaaggattgcttgagtccagaagttcgagaccagcctgggcaagagagtgagaccctgtctccacaaaaaaaaattaaaaaataaaaataaagctagccgggtattgtggcatgtgcctgtggtcccagctactcgggaggttgaggtgggaggattgcttgagcccacaaggttgcggctgaaatgagccaagtttgcaccactgcactccagcctcggtgacagagcaagaccctgtctcaaaagaagccaacaagccaggtgtggtgcttcacgtctgtaatcccagcactttgggaggcaaaggagggtggctcacttgagctcacatgtttgagaccagcctggacaataccgtgaaaccccatctctacaaaaaatacaaaacttagccaggcatggtggcgtgtgcctgtagttccagctactcaggaggctgaggtcagaggatggcttgagcctgggaggcagaagctgcagtgagccaagatggtgcaaatgcactccagcctgagtgacagagccagaccttgtctcaaaaaaagcaaacacaggaacaaatacagagatgagaaaagaatcagagactgtaagtaaattactttaaatgtccaaatttagaagttaagtgaagaagaagaaataacctaaagagagtaaaagaaagaagataacactaaaatcagaaattaataaaatataaagccaagatataattagcagagacagtggggcaacactaattccttgagaagactaataaaataaaattgtttttaactttattaatattagtaagggggtagcgaaacaacaaaaagaaatataatgtctgggtagtcccatgaccattaggaaatgtggaatttttgagaaacttatcacaatgaaaaaattagactcaaaaggctttttgttttgttttgttttttgtttttttactgtggtaaaatacgtaagaaaagttaccatttggctgggtgcggtggccgggtacaggatcacacctataatcccagcactttgggaggctgaggcaggcggatcatctgaggtcaggagtttgagaccagcctgaccaacatggagaaaccctgtctctactaaaaatacaaaattagccgggcgtggtggcacatgcctgtaatcccagctactcgggaggctgaggcaggagaatcgcttgaacccgggaagcagaggttgtagtgagccgagattgtgccattgcactccagcctgggtgacaagagcgaaactccatctcaaaaaagaaaagttataattgaatcctttttaagtgtacatttctgtggcattagacacattcgcattgttgtgcaagtataccaccatccagaacttttccagctctcccaactgaaactctgtacccattaaacaccaactcccaacctcccgtctcccagcctctgacaacccctattctactctctctatgaatctcactactctaggaactttttatgaatggactcctgcaacatctgtgcttttgtgactggcctatttcacttagcataatgtcttcaaggtatatccattgtgttgtggcatgtctcaaaatgttctttcctttaaagggtgagtgatattccattatctgtatattctatattttgtatatccatgcacctgtcagtgggcacttgggcagctttcaccttttggctattgtgaataatgctattatgaacatgggtgtacaaatatttgtttgggtccctgctttcactttttttggatgtatactcggagtggaattgctggatcatgtggttattctgtgtttaactttttaaggaatggccatatagttttccacagtagctgtaccatcgtacattcctaccaacagtgcacagggattccaatgtctccacttcctttgaacacttgttattttctgggttttgatagtagctatcctaatgggtatagagtggtatctcactgtagttttgatgtgcacttccctaatttagtaatgttgaacatccttgcacgtgcctattgattatttgtgtatcttcactgaagaaatgtcaatgtgtgttctttacctatttttaattaggctgtttgatatttgtgttgttgagatgtgggagttctttatctattctgtatagctatcaatctcttattagttatatgactgacaacgcccagagagctttaaaggcaagttctaccaacttttaattgcaatcttacacaaattagttcaaagaataaaaaaaatggttaccctgaaactcattttataaaggatgtatccatcagggtttaaccagagaaacaaaatgagtaggagatgtacacttagaggttgattgcagggaactgacttacatgattgtgggcgctggcaaggcacatcggaagtccacagcacaggccatcagaaagaggagggtgggattttaggggtgaactgaaattgctgtccataggcagaatttatgttttctcagggaagcctcagttccgctcctgaggtctttcagctgattgaatcagtctcacccaggataatctagaatagtgagacaataaatattttacaataatcttcttaagtaatgtcgactgattgtagaattcggtcacagccacagaataccttcacagcatcacctgatttagtgtttgatggaataaccgggtaccagcgactggccaagtggatatgtgaaactgatcatcgcaaaagtcaaacaacctatgcaaaggccagaaaatgacagtttcaaaaactagcagccaattttagtcactaattcagattagaaatccccccgcaaaactacacataacaataacaaaaaaggccgggcgcagtggctcacgcctgtaatcccagcactttgggaggcagaggcgggcggattgcctgagctcaggagttcgacaccagcctgagcaacattgtgaaaccccgtctctactaaaatacacaacaattagccaggcatggcggcatgcgcctgtggtcccagctactcaggaggctgaggcaggaagaattgcttgaacctgggaggcgaaggttgcggtgagccgagatcacaccactgcactccagcctgggtgacagagcgagactccatctccaaaaaaagaaaaaaaaaaaaaaaaaaagtaacaaactagatccagcaatatgtgaaatggaaaaaaacaagtccaaaatataaatatttatcttgtatgaaattctagaactaaaaaacatttgaccccttatctctttaaattgtacttcaaaaaatatataataggggctgtctttataatagagtaatatgtttattgtatctgttttgaagatatactctgaataatcccttgttccacagttcaaatctgaggtaacactgaagacagaaaacaatggtgacattatccccactcccttaaggccagccctgcaatgatccggcattggaaatgctgctgctttacttcactaaatgatactttgttttgcaatttactgtgaattacatagcttaatctacgcaataacaatcctgaaaaaagaaatgtttctggtttatttctggaatttaaatgaaactggtgcttttatattcatatttgtgttaatgttttctagcatcaaagtacaaatccatttatcctttttaataatactcataaacatgaatatctgaactaaaaccttcacctataaaattagacaaatgggggaaaatattgtaaaagcaataatagttaaagagatattgaatttggctgggtgcggtggctgacgcctgtaatcccagcactttgagaggccgaggcgggtgaatcacaaggtcaggagttcgagaccagcctgaccaacatggtgaaaccccgtctctactaaaaatacaaaagttgattgggcatggtggcgccttcctgtaatcccagctactcaggaggttgaggcaggagaattgcttgaactgggacccgggaagcggaggttgcagtgagccaagatcgcgccactgcatcccagcctgggctacggagcaaaacttcatctcaaaaaaaaaaaaaaaagatattgaatttaaataggatttgtcttctcaataactaagtttattattgccaaagtggtattttagttgaagaattagaataagaagaattcaaactaaatagggcaataattgtctagaatactgaaagagaaaagtgcttattcaacaaatatttatggaatgatttttcttagtgttaaggacaacagattacagacaaataagatataattctctttttaaagatctcacgagtctaataataatctaaagaccagcatataaacatacaatcatattactatgtaataaatggtataaaaatatgcacagggtgttataaaaacatgatcatgtgggaagaagataaatcagtagcaactcctgaaggaaatgataccaaatctgtatcttgaggagaaatcacccgctagctcagtgggaaagtgggagacgttccacacaaaaggaacggtttgaaaatgagaggaaagtggacgctggagaaaattttccaaaaacattttatctctgtagaattgggtatgtgtggcgttttccaggcaaagtgtttaatcaaatggattttctgaagattgttaaactttctgtttatgttatgctaacaaagaatgcagtttcccaactgttccacaatatactacttactgagagggtgtctctccttatttctctcgtggaactagtacaaggttaaacctaccattttctgtagtgggcacccagtaagttgtctcactcccctgggaactgcactcccttcccctcccattctaatgcggctcacaggtgctactgtgttctttgaaaacccaaaaccctggccagaattcaaagacagcagtatgggcaactgactgtagccgggctaatcacaatacttcagtccttgtcgactggatttgcgatgggaacttaggctaaactgtatcaagaaagcccttttccagatttgtttgtttggaacccaaaaaaatcaagcaaatgcctttctcgtgtctgaagctctacagttttcctgtgagcataaacacagctacatagagagaatgaacttacagagacagaaacagaagaaaagaatgccaggatcagcttcatcccacaagacggaagtctattccagcaggaaacatctggagtcttcccttaaacctcccttttttaaatgttgtgagttttctttctttagctttattcattcaactagcaagcaaaacctctgaacatccagtttcaaaggtttctgccaaatgccctggctgtttagcttttctttcccttccctcattctgtctagctacaatcctcttgacaaacagagaagaaaggactggggtcacacgggagtagatgttcatttattacaagggtaataatgaaatgaatgatgagaataattataacttacatgcccatactcagaaatgatatgagctaaaaaaaaaaagtgaaattgtcagaatatgttctgtatgaacagttacccttccggttcttggggaactagcagtcacccggtgactagcctttggttgctcagagaacaatattgtaattctgtaatgaattctgtaattataatattgttctctgagcaagcaaaggggagactaaatgtgtatggtctccttggaagcatctcaacttctaatcatttaaaaattttacttcctcactgagaatgtaacctgtttgtttcccagtctttcgaagtgttaactgtctatctgctatgagccagttaatataatacatgtcaaatttaatgtgctaaccttgtactcaatataggagagacaattaaggttctccagcagcagtaagacattctctgagacagcaacagcccagtcaatgtcagctttcaagctggtgctggcctgatgctggctaaccacctgagagaaagctcgccaaggagaggtccacagtgggaggcaggtcatatcagatagcctataagcttttctcctactttcagataaagactcaaatatttattgattggcatatattttataaatatatatatagctagagagagagagagaatgttactacacaagggaacaatttatcaaaaagctgtcctgaaatcttcaaattatgcaaaggagctggattaactttgctggagcctaggatcaatcccacccaggtgacgtgtcctacactcagtgagaaatttttatgataatcttgtttcgatcattataattactggaaccttaataacaatattcaagtagtattcatctcttattacaatgcatgactggggtgctttaattggggcaaaaagacttgagaattctgaacactgtctctgtattgacggttatgtacagcttcttgcatgccatcttccacaataaatagactggatttaaagttatttataatctcaacttatagttccttcattctaagaagctagtaacaatacttagctactctagttataacaaaataaccttcatgctggtcaattctatatgctcttttttccatctttgcttcctttctatattattcaggactccttagacagcgcaggatagaaatatacattaaaccagttcaagcaatagaatggaagttggttggtttgcaggactaaaaggaatactgatgaagctcacaaaactggaagaagccctgccaaaaatcgaggcttggaaggcagagttcagtatggccaggagctgttatctggtgcatccacctcacatctctgcttggctttatgtagattgactttttccaatgacaggaaaagcgagtgctggtgacaacaaatttacagtctcccagctaagcaacacagaagaaagatgcccggaaaagccctggctggccctggttggcctgaacgcccaccccgtaggccgataattgaggtcggtgggatgcagtcatattcctcactaggctattttgttgggggcaaaatgctctggggataagactggggaaagatgcatatcgtacagggaaactagaagcaatacatgaggccaggtgcagtggtgcgtgcctgtaatcccagcacttcaggaggccaaggtgggaggctcgcctgagcccaagagttcaaggctagcctagctggctgtggtggcatgcacctgtggtcccagctactcaagtagctgaggtgggaggatcgcttgagctctccaggttgaggctgcagtgagctgagatggcacctctgcactccagcctggatggtagagtgagaccctctctcaaaaaaaggaagaaaaagaaaagaagcaatgcatgagggcagtttaagagctatcatcttggccctataatactgctcaaaatacaatctttgtgcacagaggtttgatccattggcttctgtggctttattgcctccaacatatctttaccatcgtgtctgccattggatatagattgctgcaattttctgtcccatcaaaacaaatgctggtttcgctgcaccctttccacagaaatgaatatcactggaaacttgaaatggtgtatgagagattctacaaccctttgccactttcggctgctcattagaaatgaaaaggggcctcttttatgcagtactctggcacatcaggtataataccgtgaatgttcttccagcacgagtagcttaggacattaatgcttaaacacatcatgctcagtatcttgtgggtaatattcaagtttaatgtaacatctcatttgtggctgtctaattgcatgacattttccatttctttcctcagttaatactgtgatacagagtgtcttctttttatgggacaatctctcctctaaactcatgaacaatgtgcttattgtttgtgttaagataatgcttttccctcccagctgtaacattccgattgttttattctacctcggaaggcctaagatgacctcttcgcgtgcagatctcagtccttcgctgtctgcggacctgcctaccctttgctgccttatgagagacttgaccttcaacgcctcgttagcattatgggtctctagtccaccaccagcatctaatccccaatagcttatctttgccattctatgacctagtagctgaactttctcactgtggctgccctaacagagctaaactcttgacaaacccataaagcaattgatttttttgtttggttttgtttcttagtggttctctgcttgaaataaagacatttaagggtattcatctttctctgtccaaaagcctagccactccgataatctcattttaaggccaggcacagtggctcatgcctgtaatcccagcactttgggagactgaggtgggagaatcacttgaggccaggattttgagaccagccagggtaacgtagcaagagtctgtctccagaaaaattaaaaattagctgggcactgtggtgcacacctgaagtcccagctaccctggaggctgaggagggaggatcccttgaaccaggaagttgaagctacagtgagctatgatggcaccactacactctaagcagagtgagaccttgtctcttaaaaaaagaaaaaatgaaaaagaaaaaaaaagaattttattttaaacacccttgttacaacatatcaacatatttttgtattttgtggtttttaacctccttttgttgccgcctactaatagatttaaaaagttctggtactgtgatcaaaattccttagagaagaagaaataaaccaacgctgtttacttgtaaatccactttgcaaagggagaatgagaggatacactttaaggacttagaagaaaaaggcaataattatgtttgttttacatcagcatttaaatcaaaatgaaaatgttgctttcataaaaaatgaaagcaataatgttttaattaacgggaataccaattcttctaaaaataaatatttttctgtaattactgttaatttttttttctttaataactttcttagctcagaaaggagcacagttatatgctggatggtttataagcacagctttaaaatgtcatgattttttgcagcactgtaacctacaaaaaaaaaaataataaattgtattgacaaggttttcatgcttaaacctacattttattgtaccattatccctgaacaaattgaggcacaatatttcattagactggacagatacattattgaacatacaagagaatattaaaggccattcaatagttttagcaaagaggatcagtattaggttttgtaagtttgtgtaaaagaataccttctatatcatggctatatcttttatattaggttagttttttgttttgagacagtcttgctctgtcacccaggctggagttcagtggcgccatctcggttcactgcagcctctcccacctggattcaggcgattctcccgcctcagcctcccgagtagctgggattacaggttcccaccgtcacatccagctaatttttgtatttttagtggagatgaggtttcaccatgttggccaggctcgtctcgaactcctgacctcaggtgatttgcccaccttggcctcccgaagtgctgagattacaggcgtgagccactgcacccagccttaggttcatttttaaaacacctaaaatgaatttattttaaaggaatgtattttaaaggtatttttttataaggactttaatatttagagtcattatatttagaaaagaagaggttcatactcatatttacaaaatacatctcagaaatggattctgagacagttctaacaactgttctatgaagttatatattacttattataatagatggcatacaatttagtgacagtaaaatatctgggattgaaattccacccaaacactcccccattttctgccattagagatgttcatttgtcacagagaatctaaaggtttataggacttttataagaggaaaaactgaatatttcatgtaaatattaatcataactaactggagtggctatattagtatcagacaaagtagacttcagaataggtaatattaccagggataaaaagggacattacatgatgataaaaagggtcaattcatcaagacaaggtagcaaccctaaatatatgtcaactaattatagagcttccaaataaataaagcaaaaattgataaaaatgaaagaagtcagcaaatgcagttgttactggagacttcagcactcatctcagtaattgatagagcagacagaaaatcagtaaggatatagatttgaatggcagtaacttgaccaacctgacctaaggtgtctgggtagaaggttccactcaatgtcaaaatacacatacttttcaaacgcacatggaacatgcaccaagatagatgagcagtgcctctccaactgtggtcgggtatttaaacctaaatgttcaatactgatatgaaaagtatttgttcactggacaacagcaaccgatgatggatatccttggattccagttgtttctaccaatcttgacctttactcctttgcttccaagtggtcttacaagtaaagcaaatctcagacatgcttggttgctccgacagatatctaatagcaagtaagcagtaagacagccatatagcctcttaaccactctcagtcctcagatgccctgacaagcacatcaaacaaaaggttcactccaaggcagatgcaatgatattttgttgataggatcagaaaacttcctgaggttcaatagtcatccattgagggtgggatcacaggattgaagggagcccgaccccaagggactacttggatgtgggtcttaaacaggttcttataactcctttcttcaagggtagtagagcctgtaaaacctctctttcccatcacatgtctagaagtttgctaatttcaccaatgaaatcatttttcctctattccttgtgctaattcacaatgcctgtggtttagatttagacatcaatatttgaagtcttgctgagtctacctctcaagtgtagattgccaattgaggcagttcaaatgctaatcagccatctataaggtgtagattaaagttaattcacactgacacatatgccacactctatactaattatcaatacattccatcagatgaatcagcagtatataaatcagtatgctaaaatatattaaaataatttaaatcaatttaccaaaaaaaaaaaaaaaatctcagagcagtcaaacaaatttatgttagcaaaaggaaatcagaaatcatgagattttcaacaaaccaacattggggtaaaaaattttcttttcacattttttttttttaccatttcttaataattattctctaactaccactctagtttttctaataacaaagagcaaattggctgtctgtacgcaatagaacttacctttttttcttttattctttttttttttttttttgagacagattctctctctgtcgcccagactggagtgcagtggtacaatctcgcctcactgcaacctccacctcctgggttcaagcgatcctcctgcctcagactcccaagcagctgggattacaggctcacaccaccacacctggctaatttttgtatttttagtagagacagggttttgtcatgttggccaggctggtctcgaactcttgacctcagatgatctaccagcctcggcctcccaaagtgctaggattacaggcgtgagccactgcgcccatcctagagctcacctttttttaaaacatgtattacaatgctgtgtttgataaaggcaataaaaatgtttaaatcaacatttgtttgacagtagaatttcaattatcttaattttaggagtataggaaaaacattctcattgcaccatgtacaaaaaacatcctattaacataggacatattgttagatgcaatagggttttatcaatttttttttatttaaatcatggacggttacatcattaaattgtattcactggattgaggcgttgaagaacttgtaacctcccacatcccaattttaacacctgctctttgctcttcattttgtgtatgccaaggttagttcatcattcaacttccacagcgacttatctatttataatgcttggcaaattttccaaggatttcctctagtggtacagtaaaatatgctatcacaggcctaatttttctttgaaggcttctattttatcttaaaaccccgtgtgacttttgtatgtaaatacacaatgtcttcttcgccagaaccaccgggttggttgccgtctgagctgtgcctcctcgtcaccgccaccgctatgcctggaggtcggcttcttggggacgtggctcccaactttgaggccaataccaccgccggccgcgtccgtttccaggactttctgggaaactcactgggcattctcttctcccaccctcgggactttaccccagtgtgcaccacagagcttggcagagctgcaaaactggcaccggaatttgccaagaggaatgttaagttgattgccctttcttttttctttctttttctttttctttttttgagacggagtcttgctctgtcgcccaggctggagtgcagtggtgcactcttggctcactgcaatctcggctcactgcaatctctgcatcctgggtttaagcaattctcctgcctcagactcctgagtagctaggactacaggtgtgcgacaccacgcccagctaatttttgtatctttagtagagatggggtttcaccatgttggtcaggctggttttgaactcctgacctcgtgatctgcccacctcagcctcccaaagtgctgggattacaggtgtgagccaccacacctagcggattaccctttcgatagaccgtgttgaggaccgtcttgcctggagcaaggatatcaatgcttacaatggtgaagaatccacagaaaagttaccttttcgcatcatccatgataagaatcgggaccttttcatcctgttgggcatgctggatccagcggagaaggatgaaaaggacatgcctgtgacagctcgtgtggtgtttgttattggtcctgataagaagccgaagctgtctatcatctacctggctaccactggcaggaactttgatgagattctcagggtagtcacctctctccagctgacagcagaaaagagggttgccaccccagttgattggaaggtggggatagtgtcatggtccttccagtgattcctgaagaggaggccaaaaaacttttcctgaaaggagtcttcaccaaggagctcccatctggcaagaaatacctccgccccacaccccagccttaagtctcttggagaagttggtgctgtgagccagaggacatccgctgccaatcatgttttcctgctgcaattccatgaaaacatcctggtgtcatcacaccaaggtttttaggttgctatactactggcttattaaatgaaaactggcactaaaagtttcttgggattctttacactctgtcttcaccagcattcaattctgttcatacatcagcactctctactggttctctttgaaatatgttctgtatttaaaactcaaatcttgttggatctctgcagggcttgtgaccaatgaggtcatatttgttgatggttgagaaagcttgcttccctccatcagagaatgactatccctccatcagagaatgactatcaatttttttaactgtcctattacatcctgtcttcagtcacccattttgaagagtggcagaacttgaggttcaactcctctgtaaatatccaagtataaaacccaggaacttagagtaacccagatgttctttaatactgtttggatcatagccgggggaaaaaaaactttttaattctgtacctttctagtagataactgaagaacaagggaagagacctttaaatattttgctataaaaaaatttttttgtggccaggcgcagtggctcacacctgtaatcccagcactttgggaggcagaggggggtggatcacgaggtcaggagatccagaccatcctggttaaaacggtgaaaccccgtctctactaaaaatacaaaaaattagccgggcgtggtggtgggcgcctgtagtcccagctactcaggaggctgaggcaggcgaatggtgtgaacccgggaggcggagcttgcagtgagccgagatcgcgccactgcactccaacctgagcaacagagtgagacttcatctcaaaaaaaaaaaaaaaaaaaattgtgataagtttctgtcaaaatggggagactgcagaaaaggcttcccttggcttccaaggaggtgtagcaggggtgagcaatcctagtgccatgtgcctttcacacagggtttgcctttatcagtctgctttctgatgacgtgtacatgaaagagtacaccatgagacaggaagagagaatgactgaaaatgttttattgtagaactcttcttgcagtaggttttgctatgttctggattttactttttagggaacaacaaataaaatcctttgttaaaactgaaaaaaaatacacaatgtatcaatgtctattttgacgtaaatgttaatatttaaaattgcggttgcctaaatcactttcagtttctgtatgtgttacccaaactaatttggaatcaggaacttagaggatacttctaaaaaagacatgagaggtcattgtgaaggatgagaaatgttccatgaactcactggtttttactggtagccctaaggggccgtatcattctgtttctcaatgcctgtctcagtaagaagcagaggaattttgtaaataaatatttgctccatcaatagaagcaggattaattctatatggaacaacccagtgcatgcaaggatctgtggagtttcctttattcctaaaaagccagtctgcgggcactgtctcccaggtttagacctggaagttttagaaagctatgaagtctcccactgtagaaaatagaactgtttaatgcaatctgttgctcttttgtgataaattgccttcttggaagcaaagcaagagacacctggatgagggactacaaaagctgcagaagacaatgtaacgttagttgcccttgggaagaaaactagatgacttgaggtcaagggtaaaagacttccttttaccattgaccttgtttcattttactgtttgtaccatttacatgtattatcccttttagaaaacagattcataataattttaaaataagttattttgtgacttcagaaaagagcagcaaataacatttttgtctcatttatcataatttaagccttgagggtctcacccaggcagctctgatggagctcaaagtccagctaaacaaagcttctatgcctgacactgcttcacaattgagcgtccacacagtcagtccttgcagcagaaatgagagaatgtatacaaatggaaaggttggggtcaagggacccacagccttgaacaagctccctttcgtgagacagagaggggacagaatatataagtatttactcatatatgcagaaacagtccttggaaattatggatgcctaagacctacagtaactgacattatattcacagcactgggttgcatttaataagtggaaaccaagcataatttgcttttcaacttacttatattcattgaaggattatccaaattagcaaaaggagcatccagtactaaattaaatctattaatgcctaccacaacacacacgtatttgtttgagatagaggttaggccgtgatactctaacttctaggtagaggctttgcagtattcttttcttcccttgtagaaatggaggatgagttattataggacattcatcagaatcagttctagagccttcaaacagaaactcaaaaactataagtgaccttttaatagtagaagaaaagtaggacaatattctctctctcctcacactcctctaagtgagcaagaactttcaaactgtggccacttgtatcccctgaagtaggcctcttcatgtgatcagttgttttgtggggtggagggttgtattcatacacttgctcagattagctctatgcaacaaagctagtgaaactcattgcgttgatcttagacatccatccacctgccggctctgttgactaacccatgtggctgtaggttggtgttacggatttgtaaattaggcaatcctaagacatgggtgctaataagacgtagttgaacttgggctgccttcccgtgctggtattgagaaagcgctgtagccaagactcaggttcgcgacgtttacgcccacgaagactcgggttcgccatgtttaccctcacgcatctacaacagtcctggatttttatggatcactgttcgcaatgtttacactcacgcatccacaacagtcctccatttttacggatcgcctggattttattaaaatgcagattctgattcagcaggtcgagggcagggtctgcatttccaacaagatgatgctgacacagctgggccatgacccacacttttagcagggctgagcccctcagatggtgtctggctgcagagactttcatacattttgaaatttcaggcatgagattttgaaaatttgaatacatgtaactatactacctatccaaaaaatagcaaaagttatacaagtgaaataatttttgttgaaaccccagtattctctaagagtcaggcagctgagtgaaaacatgggtaagatgagcagtaacaggccctctgtaggaatcttgcctttgagttggaagctttttatcatgctcatcaagaaagtttcctctcctagcacctctgcccagccgccccgtctgggaggtgtacccaacagagacagcgaccatcgagagcgggccatgatgacaatggcggttttgtcaaatagaaaagggggaaatgtggggaaaagaaagagagatcagattgttgctgtgtcagtgtagaaagaagtagacataggagactccattttgttctgtactaagaaaaattcttctgccttgggatgctgttaatctataaccttacccccaaccctgtgctctctgaaacatgcgctgcgtccactcagggttaaatggattaagggcggtgccagatgtgctttgttaaacagatgcttgaaggcagcatgctcgttaagagtcatcaccactccctactctcaagtacccagggacacaaacactgcggaaggccgcagggtcctctgcctaggaataccagagacctttgttcacgtgtttatctgctgacctttcctccactattatcctatgaccctgccacatccccctctccgagaaacacccaagaatgatcaataaatactaaaaaaaaaaaagttagtgtaaaataaagtagtagctttccaatatacaaacaatcaaatgatagatataatgatgtaacaaaagatgtacataacagtgattaaaatattcttaggaatatatttaacaataaaaaaaaaaaagaaagtttcctctcctgaacctcggctacaccgctcttcacagaccaaattgaagcttcactgagaatggcttcagaggatttcctgaacacaataatcatttttttctattttagatgttttgcttccagaaggcaaaaaaaaggactaaatgaacctccgagcagagcctatatgatgattttgcaggaatattaagatgggcccccccccactattattcttagcaaactaaagcaggaacagaaaaccaaatagcacatattctcacttataagtgagacctaattgataagaacatgtggacacaaagaggggaacacacacacactggggactctgagggtggagagtgggaggagggagaggataaggaaaaataacagaatctccgcttagttcctgggtgatgaaataatctgtacaacaaaccccgtgacataagtttacctatgtaacaaatctgcacatctaccctaaatctaaaataaaagtttaaaaaattagaaaaagaaaaatagccaggcatggtggcgtgcacctgtagtccagctactcaggaggctgaggtgggaggatctcttgagcccaggaggtcaaggttgcagtgagccatgattgtgccactgcactccagcctgggtgacagagtgagaaattacctctaaaaaaaaaaaaaacgagaaggtgggcctccccgtggcatgtattagaaaaagtgcgccctctggatggatgaggcccctggatagatggtgctgaaacaggtcagggacactggtctcattgtccaaggtgttatccaagctcgttgtctcacaaccaaaagaattaaggagcgtggacacagagtgaggttggagcaaaagtttaatgagcaaaaaaaccaagctctccactgtgcaaaggggagcctgagtgggctgccgtttttacagttgagtccaaaagcttttagaagaaactcctctcatctatgtagctgtttgagtaacttctcttatgtgaaaagctgtctgtaaaccccaccccttatccacgtagttgcggatatgactctaggcaagcacaatgcaccgcttctcttgtccgtgtaactgtgggtttgttttagggaagccccctcctctctgtgcaagttcccacggagcccaccgtgtacttgtctgaaaagaaggggaaacttttccctgggagctggttaatcacacgaagaacaaaaggcttctgtgccggaccttgcgtgcttgcctgtgcaggtgcagcctcagttttccccaggctgctctatttttgcctgtagctgcgatttttcaggcaggctgcttctccaaggaccagccttaactgtttacctaactgatttttcctttgcttctccctcagtgctttacacgaagaaaaagatgcccttcctcacaagtgtacctggcccacagctcaaagagcagagcttgggttggatttgtgaagggcaccatttgaccaccaccggggcagcccatctaaaactctcccagtcagctcatactaataaggaaatcttgtagaaaatggacagtaaattagaggcaagtgttcacaggaagcagtcttcttatttgcttttctaatccctctggtggcaagagagcctgagtgccgggagttcagggaggcggagaggctgacagtggcgcaacatggggctccattttccctgactctgccttggaagtctgccgcttggtgtctggtctttatacctgatacagtgtttgccttgtgttatggctgagttatatcccctcacccaaatttacatgcagaagtcttaatctgctgggcatactggctcacgcctgtaatcccagcactttgggatgccaaggtgggaggacggctcaaggccaggagtttgagaccagcctgagaagcatagtgagacctcgtctctacaaaaaaaagaaaattaaatttctaattcccagtgactcagaatgtgtctgcatctggcaataagatctttaaagaagtaattaagttaaagttaggttattagggtggtccctcatccaatctgactggcatccttatacgaagaggaaacagggacacagatacacacagacagaggactgagtggagacacaaggagaattcggccatctacaggccaaagagagaggctggagaaggagccaaccctactgacaccctgtcctcagtcttccagctccagcattgtgaggagatgccattgtgtgatgtaagcctcccagtatgtggtaatttgttatggcagcaggggggactgaaacaccttgccgctagaccttgataatttataagaaaagtcagaggtaaatgcttgtgagattatcgggaaaggatgcaccatgattagacccacaaaaggtcctctccactcccccacttcccctccccagtgcaagtccacccaggttgacagcgtgggcttgagtggaaagtcggcagcagcaacggaggcttgaagctggccttcctaacttgagactctccatgttttgattcaaagccaggaggattcaatgaccgcagtcattgcagggtctgaatagccaagaaatgcttggcttcatacaaagcactatatacggacctgtgtcaggcgaactgttgaaacagaagagacactgggagaaggcttttcccatttctccaaccactgcttcagaaaatctctgatatgcagagagtgattatttctccttggtctttctgggatgtttgaaggagaagtgaccactcctcatgcatttttcattctatagccatttaagtctattgctgccaggaaaatgagggaccgactaaatgacttctaattaaaaatataggaaagcttcaagtgacttcatgaagaggtcatggcaatatagtgcattagtaaatcaccgcaactccccagatctaggcaaataagcatagatctatttattcttgaatttttttttcaggatatgagtcctctgcccaaatccaaaggcctacttgaacacagtttcagttcctttcttctttcccagataacatcagtgaaacaatttatgttcttcctcaacaagaagaaagccaaactcttctgatactatttcaacaacccttattgctccactcacagcctccctcaggtgaagttttttctccctttctccaaacctttgccttccttctgcctcctttgtggctaaaattaacgtactgcctagaaccagacctgtcaccttctgactcacattctcccataaaggtactgaaaagccttaagaagattcatgaagcatcattagacaattaaaactgtcaatatgaaaaaaaaatgtggccagacacggtggctcatgcctgcaatcctagctctttgggaagccaaggcaggtggatcaccagagatcaggagttcgagaccagcctggccaacgtggcaaaaccccatctccactaaaaatacaaaaattagccgggcagggtggctcactataatccactgagagaatagctttgctgtcctcctttctctatggaatgccaaacacctgtgctatcttagactagtcacaggacttgaaactagcccaattgtcttatagaactgatgcttacggtttcttttgaatccacatagaaattgaccttcccagtcttaaaatttgagacagtcccatttgtcttttctgagttcctttctcaggaaaccaaccatcaggcttcctagatagtatcaaggagctgaaactcaccagatcactgcctcttgacaatgagatgccagacccctcacccatcatgactacctaaacggccaccggcttcctgttgaccaactctctctacttatcctttcctaactcctgttctcccacacagggttacatttcttccttgctatataacctccagctttggttggtcagggagacggatctgaggctgatctcccatctcctctgctgcagcacctgattaaagcttctttcttggagatactcatcgtctcagtcattggctttctgtacagcgaacagcaggacctacactgaagccctggcgttttggtaacagattcaatgatgtctcttcaaccaagttgcttattttcaccatgcagtaaaaataagtaccataggctgggcgcggtggctcacgcctgtaatcccagcactttgggaggccgaggtgggcggatcacaaggtcaggagattgagaccatcctggctaacacggtgaaaccccatctctactaaaaataaaaaaattagccaggcgtggtggcgggtgcctgtagtcccagctacttgggaggctgaggcaggagaatggagtgaacccgggaggcggagcttgcagtgagccgagatcacgccactgcactccagcctgggcgacagggggagactctgtctcaaaaaataaataaacaaataaataaaaataagtaccatataagccttgtttagataacttgtttcctttaacccactctttatgggttaaaggacaccccccactctcagcttcaatctttgccccataccactctcattatccactcttactaacagccatttgtttcactttattggattcagcttctctatccatagacatggtttctactgcatggctcctgaaacttaaatgtgcatatgaattacttgggtattttattaaaattttaatttacttcagtaattctggagtgaaggctgaaattctgcattcctgtcaagctcccaggtaatgtcagtgttgctgatctgaaattgtacattggtttaaaatagtctattgtaaccctttgtagggttttcaggttccaaacacaggctctgggagttaaattatactagtaacttatatatcacttctgccaaataaatagccaaatcaatccatcaatgaatatttgttgaatacctactccaaagtcccctgtaaaatattttcttcttagtttggtagatagtttcgaaagcatttaccatttcaagtgtttgtttgtttgtttttgcaacagagtctcactctattgcccagactggagtgcagtggaatgatctcggcttactgcaacctctgcctcctgggttcaagagattctcttgcagcctcagcctcccgagtatctgggataacaggcgtgtgccaccacgcctggctaatttttgtgtttttagtagagatggggtttcaccatgttggccatggctggtctcgaactcctgaccttaggtgatctgcctgccttagcctcccaaagtgctgggattacaggtttgagccactgcacccagccaccatttcaagttctaaaagacttatctctaaacctttcataggcagtcagtattcttcccctttctccttatctcctcatcaccaaggtttttttgttttttgtttttgttcttttgcaacagagtcccaatctgtcacccaagttggagtgcagtggtgcagtcttggctcactgcagcctccacctctcaggctcaagcaatgctcccacctcagcttcccaagtagctgggactactgacacgcaccaccacacccagccaatttttgtatttctagtagaaatggggtttcaccatgttggccaggctagtctcaaactcctggcctcaagtgttctgcccacctcagcctcccaaagtgctgggattacaggtgtgagccaccacccctggcctaccaagttttaatataagatttataattcaattgtctgaagatgggcttcagagccaaagaacatttccagtgttctcaagctacattcattcattcattcaataaatatttactaagcacacactacatacttggcactgtttcatgtactgtttactgataagcatagaacacaagacaagcaaggtccctgaagctacaaagctcagaccccaaaagggtaggaaatgaacaataaaaacataaaaaataaataatttcagagagtcaaaagtaaatgacaaaaataaaacagcataattcaatgggactaagaagcactactttggatagggtaactggggaaagcctccctggagtgatctcatcagagctgagatgtaaatgacaagaaggtgccagcctcagaaaggtctgaaagaagaggttctaatgatctaatagtcatgatttgctctgtagactgctttcctgagagttgcagttgtgtgttccgtgttccctgggtctcactgagcgtgtctgaaaaggccactttgcaaatacagtggtgcacaattacctcctgtttttgtcatcatttttagctctttccaaaaaaagattgatggagactgcctgcatgaggattggcttatcggggatacagggcagacagtcagtatagatttccatgatccgggagaaaattatctgtagaacattacaactaatcatttattcctggaaaggagggaatattttctttgataagcacttactgagcacttataacatgagaataaatgtttatatgtgtataaacagatgaaatatgggtctgtagagatgaatatgacatggattttgttgtcaaggagcttacaaataaacacaaagtaaaatggaaaaagtgagaaactggaagtacagggtaacgaaaataatcactttgaaggaagggtgactgatcttggccaagagaatctgtaaatgttcccatgagcagtctgtatttgaactaaggcttgaaataggaaacagaggagccatatccatagacagtacgaaaggccatagaaccgggtaagacacttagggaggaagtggaggaaagaagaggctcaagggctctgcccctgcacaacctggttaatagccttgaaggtgataatgcacaagaaatgcagatttcaaccatgtcagaggacgcacaggtccagcaagatgaacaacaaaacctgacctttggtttgaacattgtggaggtggtgtggtggctgggagcacagatgtttccgcgaaggggagaaagaaaaggtttatcaaagtggattcaagagaaatatgcaaggagaactgaaaattggcaccacagcccagggcttctcaaactttaaagtcactgtgaatcctggagatcctgctggagtgcagtttctgatttataggtcctgggtggaaactgagagtctgaatttctaccacaatggcgggtgacattgatgtcactgatggatcacaatttgaatagcaaaggaagagagtatttcaggagttttatattaaaaggagcaatgaaaaggactgggtgagcaaagtaactagaggaggatgtgggaccaaggatattatttttaagattcatgctatcgcagcattgtatgccaatggggatgattcagcgttcagagggggaaagtcaaaatggggagcgggataactgaacatcgtccttgagtagcgtggagaaaggggcacgcagcgatcagtgaaggggcagctctggagggaagcccagccagttcgtgcatgttaccaggggcagcagaaagctcctgcgcatagaggcaggtgagctggacgctgcacaggggttctcttctgttgttatttctcaatgcagtaaggcacttagctgctaggactgggaagaggaagaggcagcagtatgaaagaatcatgaggaagtaaattgactagggcagtggtcctcaaccccatgagacccatgaccctttttgttttgtttttgtttttgttttttgggacggagtttcgctcttattgcccaggctggagtgcaatgacgcgatctcggctcactgcaacctccgcctcccgggttcaagcgattctcctgccccagcctcccgagtagctgggattataggcatgagccaccacacccatctaattttgtatttttagtagagacgaggtttctccatgttggtcaggctggtctcaaactcccgacctcaggtgatctgcccacctcggcctcccaaagtgctgggactacaggtgtgagccaccgcgcccggcccatgaccctttttataacacatgcttttaacaaccttgctaccattgtgaaaataaaataatagtttatgtaacctacctacacacacatttttgaatcaacataattccttcaccgtaatgtaaagaaagaaaagaaaaatcgttcaggcgtgagtgtactgttgtgttaggaaggcgaaagcatctccacaagcactgtgagtgcttctagaaggcagcgagaatatctgaggcttggtgagacgctttcatcgccatgactaagggtccacccgcagttaccggttatgatttcatgggagactctcagttgtacattttgttcagctgcttggatgcaagctcagaggtggcagagttgcatttaatcaggctggcagctttactggggagtaaatggactgaaaatggtgcaaggaagcttaaggtccaggtctacaatctctatgtgcaattccaaaatccaaaagagctttgaaaatacaagttggttgttggtggttatccaaaactcatttggcagtgaaactcagcctgaatagacacaaagctatttagagcctttactgatcccacttatttgagatactacataacagtagaactgattatctttctacaatttttttaaaatctgaatttggaaacatctgtgcccttagagcttgggataaagcattataaactgtacatgtaagggaattaataaaatgacgggccaggtaagccaaggcaggtcagataggaaataaagacttgagcagttaagacacagtgaaaaaaattgggccaccggattccgggtccctgtatggcagattgtggggtggaagtgctagaagtgagacaggaagcctgggagatacagagctggatgctttcaactgagaatccgaatggggtacagttacagataatgacgagtgcagaccctacagtagctgaggatgtcaaggtgaggacgtcaagaataatccatcgcccagggatggcggcccatgcctgtaatcccaacactttgggaggccaaggtgggtgagtcacctgaggtcaaggagtttgagaccagcctggccaacatggtaaaaccccgtctctactaaaaatacaaaaattagctgggcatggtggtgcacatctgtaatcccagctactcgggaagctgaggcaggagaatcgcttgaaccctggaggcggaggttgcagtgagccaagatcacaccactgcactccagcctgggcaacagagactccaccaaaaaacaaaaaacaaaaaaaaaaaacaaaacaaaaaacaaaaaaaaaaacacacaaaaaacaaaaaaacccagaacaatctatcagaagaaggatccatgtggatgtgagattagcactgggcatttaacatgtgactgcctcaaaagggagtggtggccagtgtcgtctgagagcttcagctgccgacgagctgcctgctgacaggtgtaggaagcagaaaggtcgagcgtgaacaatgggaacaacacttacccatgggggtgacatctaaagagaaagcagcctccacccgaccctgcttcaggggaagccacgtcctcgggtcggttaggaccaaaagatgaagaatttagggatgcaaaatattttgctgataactgccaaggggatcagaagacacagaggaagaatttgggggattctgcagggttttgagcctgggtcatcccaggaaatgtacagagccatgtgaggatgagactccagtgtgggaggatgacctgggggtgtctgcctcgccacctgccatgactgggataaaatggagtaactggctcagtcctaatgatacgtaacagcagcatttttgcaaaaagagctagacctgctcataagattgagtagttcagaggtcagttaactctttctgggccagataataagtattttagattttgtgtcacaattcctcaactctaccattgtagcaaaaaagcagatatggccaggcgtggtgctcacgcctgtaatcctagcactttgagaggccaaggtgggtggatcacgaggtgaggaatccaagaccagccttgccaacatggtgaaacaccatgtctactaaaaaatacaaaaaaaaaaattagccaggcgcagtggtgggcacctgtaatcccagctactcaggaggctgaggcagaatagcttgaacctgggaggcggaggttgcagtgagacgagattgtgccactgcactccagcctgggtgacagagcaagactccatctagaagaaaacaaaaaaaagcagatatatctcacagataaaggaatgggcatggctctgttcaataacatcttatttacggttactgaacttttaattttatataatttttaatgttatgaaatattatttttcttttgattttttgttcaaacatttaaaaatgtaaaaacttttcatagctcatggcaggccaactttggaacatctgccatagattgaagacctctggcatagtttaatatttagcgggaaaagcggaaaaagagattggaaccagattagtgtggttgtcaaaaaaaaagctaaagtgtttggacggggggtgtgggtacgtatgctttagaatccattaaaaattgttaacggaggcaaaagatacgatctcattagtgttttaggaaaataggtggttgcaataaaaatgatggattggaaagataagaaattagatgtgaagagtcagcttagagaccttggcacttctatagggggacatatcaatgcctagagacccctttgcttgagaaagcataagccattgaatgttattagaaataattaaagtggtaacattgaaaagatactaaatatacaattttactttctctccgaacacactgtaagtaggaaaaagcatattaacaaaaacagcaatctaatgtcctgaaatagacctgtgaaaaggcttgcaggtaaaagaaacacaaggaagacacagagacaggaaggaaaagaatatttaggcacattaaagagatttaacccacaggactaggactcacacagtaagaatatgatgctggtaaagaaatggggcttcacacaggggaagagttcagaaaaaggactgagggttgtggtccaagatggaaccagagaatttgagaattcttttctatgacaatttcaaaaatcactttcccttcttgaaatgtatgattgacctttctgggtgaaaccctacgggctgggggaaggagaatcacctcctaggggttatacccgggaaggcacaggggagacgcattccaagtcctgaagagctcctggattgggccagcaagacatacttttagcatccttccatgacagtggtttcttgactcttttttttttcttgactctttcttaagaaaagaataaaggtacacccagaaccccattggatacctactccttgtttgcattcattagagaaaggactctcagcagtggtgaagctttatcagtaccctgcagaaaatccactgaaaccaaggtccctgcctcttagttcacgataggcacagtcctccaagcctgtttgcgcctctcttgcattctgatttactgcttgctcctcacttacctcctcctttgtcctttgctgttcaaagactgcacttgtaaattgggtaattcgagtttgatcctgggctgccctctcttctacctatactcatccccaacattagggctactaataccatctgtagtgaaaagggtcacgaagaaaataagccaaggggatatgatagagattgactgagtcaactcaggcacattggccccgatgtcacacttaagctgagatcagaatgcttggaataatctgggacatagaatttcagacagaagaaagacaaatgcaaaaaccctgttgccagttagaaagatggatgtagctggagaaaattctgacatagttcattactgcttcactgcatcactttcctggggatgggacagcacggcatgcctgaagagctgaggggctgcactggtttctttatatcgactacatcacctaagtcaacctgttctaaggcacatttggtggattctttcagctaaaaaaaaaaaaaaaagaagaagataaaatatttaagttccaaatcaaatatggtttgagtccctgatgctcacatatttactcatattgatccatttccaattacacacataaacacatttttcaaacctttctgaccattacaaaatgctggtcactacccactaattggttccaacttataatgaaaatcatagatttaaatcctaaaattaaaagaaaactatacataactgtgtgtcccacaactgcttattttatacctttttctttgcccaaataaggtggaacctgtattatttacaggctgatatcatttgttctcatcatttcagacataatataaaacaataaccagttctacaatttccctatttagactatatagaccttgtaaaacctggaggctccaatgtgcctcaatgatattttcctggacagatgtgcattttaaagtattggtttaaaatccacattatggatacaaaagacatctaaaggctgatgatatgatataaaatacatccctaaaagccaagtaattccatgtaggaagggataatattgaagtttctgaaagaaaggctttcttacaagcggtgattcttgatttgagtcttgtaaaaggtataaacttggaatgggagggtggtaaattttatagaaagggtgatattagcgaggatatcgcaaggcgtaaattatactttctaggctagaactggaatgagattgtggagttcatatctgtgcattagctgtgtcctaaatgcaaaatggcctcctggatcaaatcctagaagaaataaaaagtacatgagtggaaaagcatgatgaagaccaaataaagtctggagcttggttgacaggattgcaccattgttgattctgtattttgataaatgtacattggttgtgtaggatgttaacattagcggaaactgggtgaagtatatatggaaactcaatgtactatctttgcaactcctctataaatccaaaggtatgtcaaaataaaaagaaaaaaagaccacaccgtctgaggttgactcaaaagattttgagggaaaatttgagtgatggtctaaaacaaaatggagcaagctcagaaaatttactccagataagcccaattttagtaggtttcttagcagaaaggcaaggggtgtttggggaaagggaggttatgggaatagttgtcttagtctgttcagcctgctataaaaaaaaatttgagtaattcatatttatttattatctttttgagatgaagtttccatcttatcacccacgctggagtgcgatagcacaatctcagctcactgcaacctccgcctcccgggttcaagcgattctcctgcctcagcatcctgagtagctgggaatacaggtgcctgccaccactcccggctaatcttttgtatttttacaaaagattgtctctttagtagagacaaggtttcaccatgttggccaggctggtctcaaactcctgacctcaggcgatccacctgcctgggcctcccaaagtgctgagattacaggcgtgagccactgcccccggccaagtaatttttaaacaacagaaatgtatggctcataattctggaggctgagaagtccaagatcaaggtgccagcagatttggtgtctgccgagggcccactcctcacagacggtgccttctgtgtgtcctcataagatggaggggaaaagggctcccccacgcctcctttataaggacaccaactccattcaccagggcggagccctcaggacttaactacttaccagaggcctcttgataccatcacatcggggcaggtttcaatgcatggcttttggagggacacaaacatgtaaaccatagcaacagtccattcttaaaaagaagaaaaaatctggccaggcgcagtggctcatgcctgtaatcccagcactttggaaggccaaggcgggtggatcacctgaggtcaggagttcgagaccagcctgaccaacatggagaaaccccgtctctactaaaaatacaaaattagccaggcatggtggcaccgcgcttataatcccagcttactcgggaagctgaggcaggagaatcacttgaacctgggaggcagaggttgcagtgagccgtgatggcaccactgtacttcatcctgggcaacaagagcgaaactctgtctttaaaaaaaagaaggaaaaatcttatgaaactgccaaacataacattaacaaatcactgtcaaagtctgaggagaatctggggtctaaaaaatagccttaggccctatacttagacccactgctaaattctcacagataatcaaatgagaccatatttatatggttatagctttcatgtaaagagcacaaaagtttttgaaaatatacaacaggacgataagtctcattcttctcagtgtgaagtaccaaaaggcttccatgtagattttagattctacttagattgttttttgaaaagcagagttaaatatgccttttaaaaatcatactctactaagatatcaaattccaagtggaaacatacattactgactggtgggttattctttttttcacagaaactctaaaaatatgtttaacaagctctttaggccagttatggtggctcacgcctgtaatcctagcactttgggaggccgaggcaggtggatcacaaggtcaggagatcaagaccatcctggctaacatggtgaaaccccgtctctactaaaaatacaaaaacttagccgggcgtggtggcgggcgcctgttagtgccagctactcgggaggctgaggcaggagaatcgcttgatcgcttgaatccaggaggcagggaggcggaggttgcggtgagccgagattgtgccattgcactccagcctgggagacagagccagagtccatccaaaacaaaaaacaaaaaacaaaaaaacaaaaaacaagctctttaaacaactgactgaacttggcaaattaactttatctttacattttgtatcaggatagcaagatttgggttctaaactctgctctgtaaactaatacctatagggctttgaataaggcatttgtcactactgacttcacatttcctcatctataaaatggataataacaatccctaaggtgctatcaagatcaaacaagcatgtaaaaaggcattacaaatcatagccaataataacatggagagatttcttaaatgaaaaatacaactacagagtttgcaaaataccttaatgtaaaatactatattagaccacagtgacgcatatcaaaggagcaagatgggttcttttgttgttgtttttgtttcatttatttttttatttttttattttttatttttttatttttattttttttttattgatcattcttggatgtttctcgcagagggggatttggcagggtcacaggacaatagtggagggaaggtcagcagataagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttagtgcagaacaaaatggagtctcctatgtctacttctttctacacagacacagcaaccatccgatttctcaatcttttccccacctttcccccccttctattccacaaaaccgccatggtcatcatggcctgttctcaatgagctgctgggcacacctcccagacggggtggtggccgggcagaggggctcctcacttcccagtaggggcggccgggcagagacactcctcacttcccagatgggatggcggccgggcagaggctgcaatctcggctctttgggaggccaaggcaggcggctgggaggtggaggttgtagcgagccgagatcacgccactgcactccagcctgggcaccattgagcactgagtgaaggagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcacgcctgcaatcgcaggcactcggcaggctgaggcaggagaatcaggcagggaggctgcagtgagccaagatggcagcagtacagtccagcttcggctcggcatcagagggagaccgtggaaagagagggagagggagaccgtggggagagggagagggagaccgtggggagagggagaccgtggggagagggagaccgtggggagagggagacggagagggagaccgtggggagagggagaccgtggggagagggagagagggagagggatttttgtttcatttttttcgtttgtctttggagatggagtctcgccctgtcgcccaggctgcagtgcagcggcacaatttcggctcactgcaacccttgcctcctgggttcaagcaattctcctgcctcagccttccgagtagctgggactacagacgcccgccaccacgactgactttttttttttctttttttttttttaattttattagagacagggggtttcaccatgttgcccaggctggtctccaactcctgagcttaggcaatgtgctggcctcggcctccaaaagtgctaggattacaggcatgagccaccacgcccagccaacacttgggttctaatctgagtttagaaacttattcctgtataaagtttctttgtgcctcggggttattttaaaacgcaaatgaaattataataacagtaataataactattttagaaatttgatttcagataaaatgagactgtgcgtgtattcaatttatattagctaaatcaaatagaaataagctgaagctctaataatgaaataatgttttacaagtttaaggttaataagcatttatagataaggcatgttttcttacaatattccgttcccagggctcctggactgaagatcgaagttcttcccatggcctacggggtcccagagtctgggcctgcatagcctctccacactcgcctccactcatctcaggtccttccataactattccctctcctgtcagggaggctctgccgtccacgctgattcctgcagatcagggaaacctcccctaacttcccggctctcctatgtggctcccacagcaccacgcacctctccttcattgtgctaataatagctgcattgtgacacttacaatcatgattatttggctggtatcctctgactgtctttatttacaatgtggatattttgttctctataaattgttgcgttgattttgattcttttacatgccaggttaaaatattactaatactgattactgagggtgttttgtttacaagtgagttactcacctcaatctagttcttaccctcctgttctgacctggccattccgcattcaaaccccaggaggccaggaatacgtatccaccagggcctagaacctccgcctgtgtaggggagaaactcaaatctgtatagagtgaattaatgcatatctatagtttttgcattttaagggttttaaggaaaatattgatttgtaacacagataaaatggtcgaaatacaagtgttttaagtgaccatgatgttactggcagaagaatcactatgactaaaattccagcaatggacaacactttttctatgcataacctctttgtggtcaatttcaagacagcccacttctgtttcacggtttaattggttctcgagctcatttaggagaaattcaatttcctttgagctgagttcatatcacaacagatgagttcattcgttttggtttcttcttcaggcccatggaaaggaaagctaaacgataatgggagcaaaaataatctatggaagaggtggagtgtgaaatgtaaaattagattttctaaacatgctgtctctaatgcccaaacagagccacacccaagcgatcaaatggaatcagtggtaggggaggcgattataaatcaatctagtttatgggatgcactgtgtgaatggttaagggagtgataaagggtggtttccgacaacccaaagaaaggatcctcggcttgagctaagtgtgtgtgtttccatctagtgaggaaaggggctttcaatgacattgccacttaaaggcttacaaagaaggttctggtcaacattcttcggttcattgaagtatttcttatcgaaacccaaatgttaacatttttatctccaagggaaacaaaaaaaaaggctggtggaattcccctgtagtttctaaagaggccacagcaaggcgccatagagacagaaggagggaagttgagggaagtccttctgactggtaaatcggctttctgaccctcgtctgcaaataatacattctaaggtaaggaactaaggaagctttattgaaatcggatttcaaatggagaggtcctgctatgcctactggaggagatcagggaataataaatatttccttcattgaaaattatatcctattggccaggcgcagtggctcacgcctgtaatcccaacactttgggaggccgagacaggcggatcacctgaggtcggaccagcctgccaacatggagaaaccctgtctctactaaaaatactaaattagccgtgcgtggtggtgcatgcctgtaatcccagctactggggaggctgaggcaggagaatcacttgaaccaaataggcggaggttgcagtgaggtgagacggtgccactgcactccagcctgggggacagagaaagactccgtctcaaaaaagaaaaaaaaagagaaagaaaagaaaggaaggaaggaaggaaggaaggaaggaaggaaggaaggaaggaaggaaggaaggaaaattatattttattggccaacctcaaaattgaagcttattcagaaacagatttaaaaaaagaaaaaagtggagaactgctcccagatatatatgcagaaaagcttcaagtcaacatttaggaggtttttaaatatcgatctgggtttcgttctaatggtctgggtgtacttatacgacctattacatttcactagactgtagccaatagtgagcgttgactgaccattgctttcaaagtgagttgtgttgcctttagcaatacagtcacattaatggccagaaaaagaaaaaagaaaacaaacactgggggtgtttgaaacaactgggggtagggtggggtgggaaaggtgtgggggtttgcgttcgagtcaacctctatttcggggggtaaaaactgcctcctccgcttgatttttttcctcgatctgcaaaagcgtaaatgttttgttttgttctattgagatggagcctcgctctatcacccaggctggagcttagtggcgcgatctcggctcactgcaacctccgcatcccgggttcaagcgattctcctgcctcagcctcctgagtagctgggattacaggcgagcaccaccatgcctggctaatttttgtatttttcggtagagacggggtttcgccatgttggccaggctggtctcgaacgcttgacctcatgtgatccccccgtctcggcctcccaaagtgctgggacgacaggcgtgagccaccgcgtccggcctaaaagggtaaatgtgattacacccacgcgtatttgttcaacagacatttattgagcgctcaccacgtgccaacgccgggcgtctgggctctggaggcgctgccacgtggcggatgcgcagtgcccggcggccgggctgaggggtgaacgcgggggtcagggggccccgggctgagggtttgcgtgcgggccgggtgcctgggggccccgggctgagggtgagcgcgccgcccaggtgccaggcggctccgggcagagagtgaacgcgcgggccaggtggctccagggcggcgccccagggcggggccggccacgccctccctaaccctggcggagctgatgggtggctgtagcctgattagaccgcgtcagtccggagggtgggtcttgggagggggcgcagggcagtccacgtttccactgcagtttctcctttgttttacgtttgggaggaggtggcattggaaatagcagagtgcttcgcggtaacaggggtgagtcttgtttcatggaacttttttcaaatggggagaagggggttgtgttgctcactacttggaatgtgtcggtcaaaggggttagatagtcagggaggggaagcgtgttctcatcctgggaccaggccggagccggcctcgccgggagacttgtagccctcgccctgcggtgacccgtggctggccactggcctcaaatgttgaaaacgggcagatgggcaagtaatacactctcaagaaagcaagtgtctggcggtgatttcctaaattgcattttttattttatttcaaaacttcatgtaaatatgtttccttacaatatctggctaagtcttttctatattaacatgcttacattgtgatcaagacaccagtctcttccctttcttttcctctcctcttatctctggagatggcaatacccccaactcaaattactctagcaaaaaacctaggagactctttcttttcttttttctttttttttggagacagtctcgctctgttgccaggctggagtgcaatggcgcgatctcggctcactgcaacctccgtctcccgggttcaagggattctcctgcctcagcctcccaagtagctgagattacaggcgcccttcactgcgcccggctaatttttgtattttagtagagacggggtttcaccatgttggtcaggctggtctcgaactcgtgacctcagatgatccgcccgcctcagcctcccaaagtgctgagattacaggcgtgagccaccgcgccgggcgagactcattcttgattcctgtttcccttccgctcttcatccaatccaccggcgagctgcagggcgagggggtggttctttctcctgttttcccgctctccctgcatttcatctcctctgccgccatctgctccaaacccctggcagcccttcgcgggattcccaaatctaatagatttttctgttctccccaaatccattctccatgcagctgtccggcccatcttctaacctaaaaaaacttgctgtttgcttgttggaagccctgtaatggtttccttgggacctgggatgaaatgcaaatggtcccggggctcaccgtcagccccgcgcctgggcctcgccccagcccccaccttcctgcccgccatagctgtagggagcatggagcatggagcgtggagcgtggagcatggagcatggagcgtggagcatggagcatggcctgcagcccccggggagcgccggcagcctggaaccagcaggcttcgctcgtctcttcccacccccgtgcacttttcctcctgcccacatctggctccgatggccccctccttgggggccttttccagacattcatgatgaaggtggcgtcctcggttacttcccctctcatattcttttttttttttttttttttttgagacagagttttgctcttgtcgcttgggctggagtgcagtggcacgatctcggctcactgcaacctccgcctcctaggttcaagcgattctcctgcctcggcctcccgagtagctgggactacaggcgcccgccaccacgcccgactaattttttttatttttaatagggtttcaccatgttggccaggatggtctcgatctcctgacctcgtgatccgcccgcctcggcctcccaaagtggtgggattacaagcgtgagccaccgctcccggtcccaccccgccccgaccttttttttaatagcatttttctcaatctgacattttttgtttatttgccctttactgtctgtcccacaccaaactttgtgttaacgaggaactttgcatctttttccctaagttcagcacctagaacgaatactaaatgtatatgaagatttcgtccacatccgcttttaccagtatgttttccatgtacagtcaagttccatataaggccgtttcagtcagtgagcaaccccacgtactatggtggtcccataagattataaaagagctgaaaaatccccatggcctagtgacatcttcatgatcctgaatttgtgtaggcctaggctcatgtgtgtgtttgtctcttcgtttttaacgtaaaagtttttaaacagacaaaattttacagaataagaatataaagaaaaaatatttttgtacaggtgaaaaaatgtttgtgttttaagctaagtgttattacaaaagagtcaggaagtttgcacatttttaagtttataaagttaaaaagagtctgggcgcggtggctcacgcctgtaatcccagcattttgagagcctgaggcaggcggatcgcctgaggtcgggagttggagaccagcctgaccaacgtggagaaacctcatttctactaaaaatacgaaattagctgggcgtggtgacacatgcctgtaatcccagctactcaggaggctgacgcgggagaatcggctgaacctgggaggcggaggttgctgtgagcggagatcacgctgttgcactccagcctgggcaacaagagggaaactctgtctcaaaaaaaaaagtaaataaataaatgaatttaaaaagttacagtaagctaaggttaatttattattcaggaaagacaaatttttaaataagttctaaaatttgcctaagtgtacagtgcttataaagcctacagttgtgtacagtggcgtcccaggccttcattcactcaacactcactcactcactcatccagagccactaccagtactgtgagctccattatgggaatgtgcctacacaggtgtaccattttttatcttttgtacagtatttcttctgtttggatatgtttatatgcaaatacttactgttgtgttacagttgcctacagtactcagaactgtaacatgctgtggagatttatagcctaggagccatgggccctactgtgtaacctgggtgagttgcaggctgtgccattcgggtctgcgtagctacactctgtgatgttcacaggatgacacagcaacctaaagatacatttctcagaacatattcctgtcttcgagtgatgcatgactagttatttctgctaacagaaattggcttgccatataaatagttttcttttagtaaattaataaattaccatttcaatgttatatgtcatcctcacaagcttgtatactgctatgagaaatagcataatgctcggagatctgacaaataagaatttagcttagaaaggtaaggaccatacttgaaccttagtaaattcataaagaaaacacctctcttaggagatgcctttcttttttttctgtcacccaggttggagtgcaatggtgtgatctcagctcactgcaacccctgcctcccaggctccagcgatcctcccacctcagcctcctgaatagctgaccaccagcacactaggcaaacccaccccactcacggcctcccttgggaattcagacctaaccatcgctgagctgaagtgtaggtgtggtctgattagactcattttttcttttttgtagagatggggtttcaccgttttgccgaggctggtcaccaactcctgggctcaagggatccacccacctcagcctcccaaagtgctgggattgcaggcatgagccaccatgcctggccttaggaaattcctttctatgtaacaccctgcatcattaatagccagcttttttgaaacttctacattaaattgtctaaactctcaaataaattcctagtaaagtaattatatagggttgttaaatcagagatcaacagcacaatgactaatgcatactcatgatttcatctcactagacaaatgtactgaggctggagcctgtgtgaacagaacagaagaggccttcactctagtagtgctcacagtccagcaggtaagacagacttgaagcaagggacaccagagctctgatcagtgtgaaatagggagctaggagaacgtttagctttgggactcaactgagctgaagaatccagggaagcctgcctgaagaggtgatgtttgcgcatttgaagtatggatgggaagcaagcctctgtgtgtgtgttggaggataggtggtattttagtgagaaaaaagaacatttgtaatggactgatctgatgctttactggagaaagtttattatggctgaatagtgaaatacaagagctatagatggcaggaggtgagcttggagggaaaagcagcagtcaattaaattgcagttacaggttgagtattttttatccaaagtgcttgggaccagaagtattatggacatcagatttttttgaatgtttgagtatttgcaaaatacccaatatgagcatcccgagtccgaaaattcaaaatccaaaatggtccaatgagaatttcctttaagtgtcatgatggcactcaaaaaggtttcatactttaagcatttcaggtcctagattttcagatttgggatgcacaagctgttttttaaatggactaattggggagagcagctctgtgtttaatcctagtaattaccctccaaaggtgctaatattgtgcttcataaatattttgagatctccctggttaatttcacctctatatttttgttttctttttttttcttttttttccgagaaagtcgctctgttgtccaggctggagtgcagtggcacaatcttggctcactgcctccgcctcccaggctcaagtgatctcctgccagtagctgggattgcaggtgtacgccaccacatccagttaatttcttgtatttttagtagacagggttccgccatattggccaggctggtcttaaactcctgatctcaggtgatccgccagccttgtgctcacaaagggctggcattacaggcacgagccactgcacccagccctaatttcacctttttaaaggacacaggcctggcgcagtggctcacgcctgtaatcccagtactttgagaagccgaggagagcagatcacctgaggtcaggagttcgagaccagcctggccaacatgatgaaatcccgtatctactaaaaaataacacaaattagctgggtgtggtggcggggcgggggggcgcctgcctgtaatcccagctacttggggcctgaggcaggagaatcacttgaaccccagaggcggaggttgcagtgagctgagattgcgccattgtactccagcctgggcaacaagagcgaaactccatctcaaaataaaataaaaggacacaaaaaataacattagtagcatataacatatatgtattacatatttttaaatacattttaagaaatcttaaacttttcccctacagttggaacacattttgtttttattatatgtatttgttttttaccaaaagtaaatgacatgcttctgttgaggtgttttttttttaatgtggttattttaattttcatccaacaacttttacctttgcctcttttttaaaggcatataatttttcttcctacagaaagacatcaggacaataaatagggagatcttttctcaggcacacaattgtaacattaagtaagagacttttatagtcaaagcaataacatattcatgctataacttttataacgtcattgctgttaaatgtttaaggaaatgataggaaagtcttcagggccaagctaccccgtgcctttattttggcatggattcctaaaagtgggagcaccattaatttcatgtgtcttattctctggatccccattttttagaacaatgagtgggcacacgatggcccatgggccagtctccctgttttactggaacacagccaccctcattcctttatgtgttatctgactgcttctgtgccgtgctacaacggcaaagttgaatagtttcaacagacaccacaggacccacaaagctaaaatctggccctttgcagaaatagtttaccaccccagtctagaaagaacctggcgtgtagcaggatgcaacatatacttgtagaatgaataaaaaggtaataaaataacacgagctcacatagcggccagcatttgctgtgcaccataatccgtgctaagcactttgcatgcgttatttaatttgaatttcataacagtattacataagaaaacaatagggccaggcatggtggctcacgcctgtaatcccagcactttgggaggccgaggcaggcggatcacgaagtcgggagctccagaccagcctgaccaacatggtgaaaccccatttctactaaaactagaaaaagtagccaggcgtggtggcgtgcgcctgtaatcccagctacttgggaggctgaggcaggagaattgcttgaacccgggaggtggaggttgcaatgagctaagattgcaccactgcactccagcctgggcgacagagtgagactccgtctccaaaaaaaaagaagaaaaagaaaagacagtattttgctccctcaccgccttcaggcttttaaccaactgccacttaccaccctagtgaaggtttgcccgagtgccctatttaatattgcaggcttctgtttcctaccagcccctttgcttactctttcacacttagtcaccttctaacgtggcatacattgcttattttctatgctcatgagtatgtctactccatggaggcatagatgtttgtatgcctgtttactgatggatcacaaactgtgtagcctaaaatagagctagcacatagtcccacccaacacgtgtcaggtgagcaattagatatagagggttccaataacttgtggggacacccagataagatctgtttatgactcatgtcttacacagagctcattcttggtctcttggttagtttatcagagaagacaaatgtattattggaaaatgtgtcttaggtcattttttgacagtggctctaatactggaatctattttaactaaaggttattatcataaagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaatatgccaagtctgtattttaaaaaatcaaagtctacattgaaaagagataccatttatttgttcttaaaacttagcaaaattcaacagactgatgttcggtataggtgagatatggcgggaagttgggcttacgtgtggttggataagggataaactgtcacagccagtttggaaataaattttgtaattgtgctatattcgtttttgagctgccgtagcagtactcccaagctaggtaacttagcagaaatgtattgtctcggttccagaggctagaggtccaaaacccaggtgttggcagggttggttccttctgaggctgggagggaaggactggcccaggcctccctttttggctttaagtgactgtctcgtgttcacatggcattcaccctgtatccccacatcccttcactctgcctgtgtccgaacagggacaccagtcatgtgggattatcacccgtgctgatgacctcatgttaacttgacaaactctgaagaccctaccttcaaataaagtcacattctgaggtactgaggttatttgtactaatgtacaaagggatctgttcaagaatgttaactgaatagtatttttaatagtgataaacccataacgtaaatgttcattaaggggatatgggctgcataattcatgccacttttgttcaacagcaaatgtgcaagtctccttcagggagagggtcacagctggaggcaagccacaaagaggaagtttcttgttactaacagatgagacgggatctggtgtattttcttgctgtggaaggaaattcagagaaagtagttacatacggataaagggagaaattgtctgaaggtagctgatctaatgtaggggttaactcatttttatcattattaagtgaatccctgattggaatcatctcataatggccaaaaatatgctgccatcaaacttgaaatgcttatttgattttaagatttaagacatctctggaggtagtgctaagtgtaccattaatttaatggcttttcaggaaataacaataccacactaagtaaatatatcaaacttaagattaatcttgatttctaaaatgccaaagtctaaaatatgtctttaaaacaagtaaaaaaaatcaaaggcttacattttgacgtcagtatgagctaattgctactatggactatggaaattacttcttaatttggtctagaatttctagtatcatttttacaggaatgtgggtactgagtgaggaacactgggtacataatccatttgtaagtggaatttcctccaaatcaaacacctgagtatagaacttgagatgggaatttggtatttgatcaagatgacaaagcatattctcagctagttttgctttcgtagcactgtgtttgatttgctcttctgtgggtttctacttcagagatgaattagcacagagcacctctgaagaccaggcaaaaggcaggactgaatagcagccctcaaggccagaggaagtcaggggcagggtttaggctgcaagctggagagccgagatgcagggcaccgagagggatggatggagatgcttcttcctgaaccatgagcatttctaaaaggtagatcagcctttacatagcgggagccagtctccatccctcttgctgttctcagatggctgttcctgttcagctcttttctagagctgaagggtccgaaactccctgttaacaactctaaagcttaaatgtgtaagaaacagcaatctgagaaaatgcttgtgtatctggatcccaaggcttagttaaatcctgactgaggaatagggtgctacttagctagcttcctagctgttcttgtttttgcttttcttccaaaaaggaaccctaaaactgctaagaatgtaagaggatgcatgtggatgcaatgtggatgtaagatgcatgtggatgcaatggaaacaaaaaaaaaaaaaaaggaaaaggaggttagctaatgaggatatatgaggatatgtcacctgaaatcctttgtttatggttcaggaagaaatgtacatagactctccacatttgtgttttaagtaagaacgaacacaagataacctgaacacatacccagagaaaactgaaaaaaagtctcagttcatctagcttttcacctttccaggcactggcatttgacagaccccaaatcctgataaatgaataaaatgtttttcggttttcaagctggcatttggcttcatggcccataaacaacaaacagaatcttacatgtgtagggttttttacattttttatcatgtttgtttaagatgtatgtgctgggccaggcgcagtggctcatgcctgtaatgccagcactttgggaggccaaggtgggcggatcacctgaggtcaggagtgcaagaccagcatggccagcatggcaaaactctatctctactaaaaatacaaagattagcctggtgtggtggtgcgcacctgtaatcccagctacatgggaggctgaggcaggagaatctcttgaacctgggagggtgaggttgcagtgagcagagatggtgccactgcactccagcctgggggacagtgtgagactcttgtctcaaaaaaaaaaaaggtgtgctgttttgatatgcatatagtgaaatgattactgtcaggaaaattaacccatggcctggcgcggtggctcacgcctgtaatcccagcactttgggaggccgaggtgggcagatcacgaggtcaggagatagagaccatcctggctaacacagtgaaaccccgtctctactaaaaatacaaaaaattagccgggcgtggtggctggtgcctgtagtcccaactactggggaggctgaggcaggagaatggcgtgaacccgggagacggagcttgcagcgagctgagatggcgccactgtactccagcctgggcaacagagcgagactccgtctcaaaaaaaaaaaaaaaagaaagaaagaaaagaaaattaacccattgtcccctttttcagttatcttttgtgtgtgtagtaagcacctaaaatctactttcagcaaatttttggtaatgaatactacattattaactgcttcttcatgctgtgcgttaggtttctagacccatgctatctaactgcaagcatagacccttgtctgttgctccctatttctccctcctctacctctgcattcctggtcactaccatttctgcgctgtttctatgtatttgccttttttgtttgtttgtttagtttccacatatcagtgagattatgtagtgtttttctttccatgtttggtttatttttccagtttatgttgtagcaaaggcagttatctccttttttaagtctgaataatattccgttgtacgtatgtgcaccacgatttccttattcatctgttgatggacatgtggattgtttcatttcttggccgtggtgaatgatgctgcaatgaagatggacgtgcagatagcttcgtgcggtggtgatttcatttcctttggctatatgcccagaaagggaattgctggcccatatggtagtcgtacttttagtgttttgaggaattcccatcctgctttccacaatggctgtactaacttactttcccaccaacagtctgcaagaattcacttttctccacatctttgtcaacacttgctgtttcttgtctctttgatagtggccattctgacaggtgtgagggagtgtttcactgtggtttggtttgcatttctctgacaatgagtgccgttgaacacctgttcatatatttgtgtgtcttttgcgctatgtctgttcaagtcctttgcctttttttttctttctttttttttttttttttttttttgagagacgaggtcttgctatgttgttcaggctagtcttgaactcctgacctcaagcgatcctcctgtctccgcctcccagagtactgggattacaggtgtaagccaccatgcctgaccctttcaccatttttttaatcaagttgtttttttggggggtgagttgtgtgggcaccttgtatttttttaatattaactcctatcaggtaaatgatttgcaaatattttctcccaacccataggctgccttttcattttgtggatgttttctttgccattcagaagctttctagtttgatgtagccccacttgctaatttttgcttggagttggtttttgtgtgtatggtgtaagataatggtccagtttcattttgcttgtgaatatctagttttcccaataccatttattgaagagagtgccttttccccattgtgtctttttgtttttcttgatgaaaattcttatatatgcttttgggttaatttctgggttctctgttctgttcctttcatctgtgtgtctgtttttatgctagtattgtaatattttgattactgtagctttgtaatataatttgaaataagggaatgtaatgcttctaactttatttttctttctcaaaatgttttttggctattcagggtcttccgtggttctaagcaaattatagaattgcatcttctgtccaggcatggtggctaacacctgtaatctcaatactttgagaggctgagccaggaggattgcttgagcccaggacttcaaggttacaatgagctgtgatcctgccgatgctctccagcctgggcaatagggtgagaccccttctcttaaggaaaaaaaaaaagaaaaattaaataaaaagattcttttttcattagccgggcatggtggcaggtgcctgtaatcccagctacttgggaggctgaggcaggagaattgcttgaactcgggaggcggaggttgcagtgagctgagatcgcgccactgcaccatttctgtggaaaatgacattggtattttgataggaattgcatggaatctgtagattgctttaggcgatacagacattttaacaatattcttccaacccgtgaacataggatatctttccatttatttgtgtcttcagttttttcagcaatgtttacactttctggcatttgtatctttcacttcctctgttccatttattcttaagtattttattcttttggattcattctaaacgggactgttttcttggtttctttttctgatagacagtaactgctgtaaagaacgacagctgattaaaaaactgaaaatcttaaggcagagtccactgctttcttggtatcactaatacaggcaataggaggcacttagtaaattatggaatgaataaatgtaaaaatggagcttaatatgctttaaaagtaccttaataaaattatcaaaattaaattaaaaatataacccaaaatggccaataaggaaactgttactgttttgttttgttttttttttttttttgagacggagtctcgctctgtcaccaggctggagtgcagtggtgcaatcttggctcactgcaacctccgcctcccaggttcaagcgattctcccgcctcagcttcctgagtagctggaactataggcgcatgccaccacgcctggctaactttttgtattttcagtagagacggggttttactgtgttagccaggatggtctcgatctcctgatctcgtgatctgcccgcctcggcctcccaaagtgctgggattacaggcgtgagccaccatgcccagccgtgttacttatttttatataaaatatgaatactctgaaataaaggtaagcaactttaatagactaacatattctcactaaaagaaaaaaatgtgtctgtgtgtgcatatacatataacacatgcacacatctattcctgttttccaaaagtaatctccactaagagttcttcaattattttgtttgatcatcttcattaatagtgaaaataatcttaaatctcattatcattcctttctgccttccttctctgtaagaggcaggggactgagggtttgttcatcttccagcatcttgaataatgaagaactaaccagtatgaagaattattaccaagactgtattcgatggtgatatcacttacattcctacttgttcaaatcagttgttttataccgtgcgatatgtgcacagctctcccagtgatatctgactcctgtatttcaccacagctacaatatacatttgtggacataggatttacagaattctatctgaaagcaaatttgtcaggttgttatattgttgacaaatactcttgtttctcagatcattttttgctggctatatgcacgtgcaggaatctgtatgtgcttgtgttttaattacctaatgcactggctctgactgaataaattgcatgattacctcctacactggacacagaacagtgcaagtcatattaaaaagccattatatttgcaactctgagcaagagactataattaaaaggcagttggatgaaattagctttgagagtacaagagtttaagcaagatttggtaaatgaacattaatggttaacatgtggtttttattaggtcttttgcttcttctctccataaccccggagttgaatttcttagatgtcagtggaccagacatgtgagaacacctgtacaaagctatactttaccatgtggctaaaattatattcataaaacaagccaacataacttttgtgactttagtaaatcaaaggtattagactagaatgatcccctgggcattaataaactattcttaatgctcctaagattttagttatatgtcattaaaagcatactgtgtgctccatgcaacttaaaatgtttgtcataaaatacacatatacacgtcaaagaagtaataaaacttgagggcattttaattattctcaccgttaaatataaaaaagttaaagttgtatgcagtatgtgtaatagcatcccattcttatctgtttgcagactgttgaggactccgcatggtagtgatatttttgtagaggggaaagctttatggagtatgtgtatgtactcaataggtcttacacttaggcagattaaagatgcctgcaaattctggccgggggcggtggctcacgcctgtaatcccagcactttgggaggctgaggcagggggatcacaaggtcaggagatcgagaccatcctggttaacacagtgaaaccccgtctctactaaaaatacaaaaaattagccgggcgtggtggtgggcgcctgtagtcccagctactcgggagactgaggcaggagaatggcgggaacccgggaggcggagcttgcagggagccgagatcgcgccaccgcactccagcctgggcgacagagcgagactccgtctcaaaaaaaaaaaaaaaaaaaaaaatgcctgcaaattctttgctacttctcccagtgagagtaggggtctatttccttccccttgagtttgggctggtctgtgactgctttgatcagtacagtacagtataatgtaaatggtgctgcaatggttatgccaattccaggcttagtttgtaagaggccttgctgtcttggaaacctactgctagtttgctgctgccttggaaaccaactgccgtttaagaagcatgactaccccaagaccaccctcctgggcacaatccaagccagccacaggcagaggccctgtaggataagaaatcatgtggagagagaagctaaggagcaatgaggtgctgggcttgcaagtgaagaaggcgactggaaaagccatctagcctggatcaccccaggtgacgccacaggagttggtccctttccaagtttctaacccacaaaatgatgcacagtacaaaaagattgccttaagccgcttaatttcgggttagtttgttatgcagcaatgaattacatacaccccacttcaggcttgtttttgaattttatggtccctgctttacatgtgtgtgtatacgtgcatacatatatatacgtatagagagattgtcatatgactatatacatacgtacatatatacatatagaaatagataagattttgtcgtatatctagttagtgcccaagttcaaaaggaagtctttatatttctaggtttatatactagatttattttcagccatatgacaatgaaatagtgagttccctcttccttaaacattaaagactgattctatttggtggggtatctaaggaaactgcagctgcctttagtttactaaaactcagtctctaaagattggtggagggagaatctccacttgggaggaacagtttttcttcacggaaccagttctgaggctgggcctggtggctcatgcctgtaatcccagctctttgggaggccaagatgggaggattgcttgaggccaggagtttgagaccaacctggacaaaacagcaagaccccgtctctacaaaaaaaattaaaaattagccaggcatagtcccagctactcaggaggctaaggcgggaggactgtgcaaactcagaagttcgaggcggcactgagctatgatcacaccactgcaggccagcctggatgacagagccggaccctgtctcaagaaccggtcctgccacctgggtgggtcaccttcttggaggaatatcattaattgctgtcaccacaagcactgtccttaaagggccatgctgcacttcacactctgacccaagcctgagcacctagctctttctttatttcttagtaaaactgagatgaggttggaacatgtaaaggcctctattaacggcaagaaaataataccgcttggattctcaggccacaggcttaagagaggtgcacctgtttcaagatctagagttaagaggctccaatggttcatttctatctgagacctggtttaggtttctggctgggatctaccttactcagtattctaccttacccggtatgtctcactgacctcttcatgaaagtttatctccacgcattgtgtgacttcacatttcacttaacacgctaacaacgtaaacggctcaacagccccaaaacgtagataagaaatgaatacattctttatgaactttttctgtaaatctgctggcgggattaaagtattagatagagtatttaactagaagacccctctaaagttacccaagatgggaatagagaatgaacaagagagagaactttgcccctggcaaggggcagttttgcaggctttgtaacccatcgtaaagggttagaactttgccttgtagtcaataaaggaagcatagaagggattaataagcaagtaagtgacatgatcaaattcactctttagaaaattcatttagggtgcagagttaaagatggattgggagaaggaaaagatgaagctgttgccataatctagaggtgaggtgacatgtctttctggacttagtttccagcacaggcacagagcacagtaagtgattatagatgtttgaatatatgcttgactagacaaagctaaaaggatttccaagcagtagtaaacatagaaaagtgacagatgcactaaacttaaagtcagtgacacacaacaatcaaaaggtaaatacacccatttaaaatgggcatagggcttgagtagacatttcaccaaagaagacagaaaaacaaccaataagcacgtgaaaagatactcaacattattcatcactagggaaatgcaaatcaaaaccaccctcagataccatttcacactctcaaggctgcctataatcaaaacaagaagtattagccagatgtggagaaatttgagccttcattcgctgctggtgagaacgtaaaacagtttaatagttccttagaatattaagcatcgttacataaaccagcagtttcactcccaggtgtataccaaagagaaatgaaaaaaatctgtccacataaaaacttatatatgaatgatcataatagcataatacataatagccagaaagaagaaaaaatccaactgctcgccaactaatgaataaacaaaatgtagtgtgtccatacaatgaaaatttcagccataagaaggtagcactaatacgtgtgataacctggataagccttgaagacatgctaagtgagagaagccagacacaaaagtacccatattgtaaagtagcatttatgtgaaatgttcagaacagacagacccaaaggaactcaaacccaaagagttccccaaagaggttagcagttgccggggcgagggcgtggaggcggtagggagtggccgctcatggtactttttgtggcatgttaagaatgtgctgaaattaggtagtgtcagtgattgcagaactctgggaatgcagtaaaaaccgctgagttgtatactttgaaagggccaattttatgacatgggaattgtatctcaataaagctgttatttaaaaaaaccatttatgcaaacttttatagacttcttaactattttacagtcactttcatcagaagtaataacgcaaaaattcaaacacccaggaggttacacattctgtgttaagaacacagactttgaaatcaagcagactgagtggaaacccagttccatcccgtagaaactgtgtgacgttggacaaatgacgtaacttctctgaacctttaatcatctctaaaatgtaaataatacctatcagacatgttataaaggtgaaatgagacaacagagaaaaaagtcctaagctaaagtacggacatgaattattatccagggtattgttattctttactgtgccaagacaatgacccagccccctgaaggtattacagttttatagcacattctaggtggttgacataaattgccatgtttatgtttccttagtgagcacatatattaacgtttgaaaagtatgttgaggccaagcacagtggctcaaacctataatcccaacactttgggaggcggaggcaggagcatggcttgaagccaggagttcaagaccagcctgggcaatataacaacaccccggttctacaaaaataaaaaaagtagccgggtatgggggcacacgcttgtagtcccagctacttcggaggctggtagaaggatctctttagcccaggaatttgtggctatggtgagctttgattgtgccactgccatccctgcctgggcaacagagtgagccctatctcttaaaaaacaggtggggcgcggtgcctcatgcctgtaatcccagcacttttggaggccgaggtgggcggatcacgaggtcaagagttcgagaccagcctgaccaacatggtgaaaccccatctctaataaaaatacaaaaattagctgggcatggtggtgggcacctgtaatcccagctactcaggaggctgaggcaggagaatcgcttgaacccgggaggtggaggttacagtgagcagagatcatgccattgcactccagcctgggcgacagagcgagactgtctcaaaaaaaaaaaaaaaaaaaaagaaaaagaaaagaaaggaaaggaaggaaggaaggaagagtgcagatgctgggaggcgccttgcactaaggcggctttcatactgtgcgtaggagcttcggtttctcacatttagaacctaaagccattgaaggtagagctctaatattttgtattattttttaaattgctcataagaactgagctcattttcaagaaatacctcaacctataaagcataaataaaaggcataagcaccaaaaattcacgagctctaaggaaccattctggtgaatgcattcttcaaaaaagtagtgcgtttaatcagaggagcagtaagttcaggtttgcatgctgtatctgacacctttgtgtggcccgtggatataagcagatgtgaagcagaaaagagggaaagactggagaattgttggtttggaaataagaaatatggaaagcctggaaaaagcacagttgtcgggataaggaggagagaggaggaaggacatgtttgggttaagtgatcaagctggggccgtacgcggagtgagggagggaggaggaggagcagacaggcaggaggatcctgaggtattcagcttgctggagtgaatggattgagatgcggttgaaggagatgggaactgggaatgcaggaagagaagccagaaggggagactgcatgacagttcggctgaagataagaattattctgaaatggcagttgtgcatgttggaaaaataaatcaccatggaaatgagcctgatcaaatttgactagggaaactgagagttgtacagaactctcattccaaaatgttatcaagtccttaagataatttaactctgtgttgcaaaataggtagacataaacagagaggaaaacagtattttcatacagaacaatgaagaggaagtactagatttaattggacacacgcttctcacatttaaagatggggaggagataatggtgtccctttgtgtccttcccaaagaaatatggggaactgataatgcctcacataagtcttaaaggaagaaaatgtagagcatgcacttttgcagatcactctctcattaacaaacaagctcagaagaaatgtggtctcaatgaaatgcttcctttcttggagcttaaatacggtcaaatctaaatatctaagaaatcaggaagtttgacatctttaaccactaaagattaagacaaattttttacatgtaaagttttatctggatatagggacttcctgatcaaggaaatagttgaaaggaataaaaaaaaacaactgagtcacagaacattccatcaatgaattattgtccaggtttgttcagaagtggtgacactaatattattttgctcaaagtaaataaactgcattgctgactacataaagagagagaagttgtacctttttgcttacctctgttttcccgatgcctagtgtaagttgtctagcacgtagtaagcagacagaaactaactacatatgtggaatgaatgtacgtgggaaagatcaattctgaaacgtgtatagacgagaagtaacaaatattcttaaaatagtacaagaactcatcattcattcatcaaattcgttttaatataaattctttattgaaatattagagacagaaaataagtcataaatgctcttatattccccttacctgcttccaaactttaccttccctaccgcaaaagataatctttctactaacctctaacgccatatttgctgttgatggcatctgagaagtctccagttttcagctattactaacagtgctgtgatgaatattttgtttttttggttttattttgttttagaggaggggtctcactgtcactcagacttggatgcagtggcatgattatggctcacggaagcctggatctcctgggcttaagtgatcctcccactttagccgcccaagtagctggtactacaagcacacaccaccacacccagctaatttgaaaaaattttttagagatggggtctctctcgccatgttgcccaggcacatcctgaattcctgagctcaaatgatcatcctgcctcagcctcaaaacgtgctgggatcacaggtgtgagtcaccatgcccagcctcttctgtatataactagaattgcccgttctttggatgtatatatgatcagctttaaaggatatttttgaacagttttccaaagcaagagaggaaattcctctaaagcattttcttaagtgatgaataggagctttctaatgcattctttgccgttttcacagtgtggacattgacattcatggtgcaaaagcaatgatggataaaccagttggtgccttagaacgaatcaagccagtggcaccaaactgtcttagtagtcattacatactagtagtcactgccatgtatcaaagcaaacaagagccagttttattttttgaatgtcttgatgatgtcggtttaaaaataaataaatagaaattttaaaacttgaaatgttttaatgaagcactaaaaagagtcagttttactacatctcagcccttgagttcacattattatgaagtattttttaatattttctctggtgaaacggacatacgcataaagcgtatctgttgcatgcccaagtacccaagtacaacaaatgtatcaaagaatagaatctatgaaattggtggacttgagagctgacttagctgatttttttcatggaacataaattttactcgaaagaatgacgaagatgctgggtatggttattcagattggggtgtctctcaaaaatatacagacatactcttagaaacaagtgaaatgggcctgtgatctcaaagaaaaaactgtttttggtcagggatagaatttgagttttcacaagaaaactagaaattttaaaaattttaaaaacttgaatctatcactgtgaacttcgcagcttgcccgtactttaaaattttctgataagattatcatgttgttttatgaatataatttttcaacattatctactgaaatatgtcaacatttggaagatctgaataactcagtgaaccaatattttcaatgtatcatattacaaaattatacatgaggagagatccattaaaagtgcaagagataggccaggtgtggtggctcacacctgtaatcccagcactttaggaggccgaggtggttggatcatgaggtgaatagatcgagaccatcctggctaacacggtgaaaacccatctctactaaaaatataaaaaattagtcaggcgtggtggcgagcgcctgtagtcccagttactcaggaggctgaggcaggagaatcgcttgaacccaggaggtggaggttgtggtgagccgagttcatgccactgcactctagcctggcaacagagcgagactccatctcaaaaaaaaaaagacctacacctgtaaaggtttggtgtagattcaaagagtatccacaggtatctgaaacagctattaaaatactgtatgaggctggcttttcttcatatacttcactcagtcaacatatcaaaacggattgaatacagaagcagatatgagaatccggctgtcttctgtaaatcctaagtgacagttccattgtcataaaagaggacacatagaataatttttccagaaactccaaggtcaaaatctatattttaaatgtgcctaatgtacttctaaagtaagagttcttactttgattagttaaatcagaaaaaatttttattcatattcaaaatagtataaatatataaaaatgttaaaggcatagccaattattgatcacagaagtgacatgatacagtcgtttgttacaaatctgagtgattatttacaaatctttagagttgttgtctgataggactcagtacggcagttggagtgtagctgaaagtaggataaagcaggtggatatgtgcagatgatagaaatatggagatggtagaatcaataataaaaatatcacaaaacaagctccgtgatcctactttagctgttaaacttttgttgttgttgttgttactgagacggagtctcactctgtcgcccagctgttctcagctcactgcaaccttcacctctggggttcgagtgattctcctgcctcagcctcccaagtagctgggactacagggggggcaccaccacgtccagctaattttctgctaaactttttgaaatgagaggcccatggtaaagtagatatcaacataaggcttgttgagtgactgattaattctagattattattctcatttattggcacaaaaacaattacacattgctttctatttggctcctctggtgcccttaccaccactgcacagttcctacatatgccgtgattcttaacctttggagcttgagtaattacccctaaatccctctcttaaaaatcttgggggccaggcacagtggctcacacctataatcccagcactttgggaggccgaggaaggtggatcacctgaggtcgggagttcgagacaggcctgaccaacatggagaaacctcgtctctactgaaaatacaaaattagccaggcttggtggtgcatgcctataatcccagctactcaggaggctgaggcaagagaattgcttaaacccgggaggcggaggttgcgggttcaagcaacctcaagcctgggcaacaagagcgaaactctgtctcaaaaaaagagaaaagaaagttccttggccttttcttgtgtttcttgaccttgacattttttgaggagtccaggccagttattttgtagaatgtgtcagtttgggtttgtgcgatgtttccttgggattagattcaggttgtgcatttttggcagaaatacaactatagtgatgttgtcaccttcaccatgcatcgaatcaaagggacatgatggcgatggcttccaaggtgatgttctctttgagcacttggtaaggtggtgtctgcttaatttctcgacaggcaagttactgtttttcctttgttattgataagcaacttctgggggatacttggagactacgcatatatcctgttctttatcatgctttcacccaatagtacccactgatgaacatattgtgtatacatgaaataataataaactattatcactgatagaaggaacatattgtgtatacatgtaataataatgaactattatgacttcttaaagcaggttgttcattgtttcctgagtataaataaatcagaaatgaatggctttaattttctgtaaaatatgtttacttagaaaataatagaaaatgtcctttacaaaatgagttctagggttttattgaacaaaatgtgtttgcaaaacactgtggggtgaaaagagtatgaccccttacttccccatcataacgctcctggctgacactcccgtaataaaagacaggttaacaagagaaaagcataacatatttatttgatcaaagtttttttttacgtgacaaaggaaccttcagaaatgaagccccagaggtccccagaaaactgtctgtttttatgcttaggctgggtgattaggggacatctttgtagaaatgtgagtgaacaaaaggggaagctctaatgctaacagactgagtgcagacacccagcaaggcctgtctgttcagattcttctcagcctctccctgcagcatgcagcatcccttcctcctgggtatggggcagggcccttctggaatgcgggtttatgacctccgtgcaggcaaaatagaccagatagtttctttatggccaactcttacacagaaaggcaggggaagattggagtaatttttttttaggttttaaggctagctttcagggagaatggttctggtttctatggacttgccttggggaagagggattttagtttccttgtttgtttgtttgtgttttgagatggagtctcactctgttgcccaggctggagtgcagtggcacaatctcagctcactccaacttctgcctcccaggcttaagtggatcttctgcctcaacctcccgaataactgggattacaggcatgcgccaccacagccggctaatttttgtatttttagtagataccaggttttgccatgttggacaggctggtctcgaactcctgacctcagatgatccacccgcctcggcttcccacagtgttgggattacagacatgagccaccgcacccggccctagtttcctagtttctatggtcggccttgggggagaaagtttagcaggaggaggaaggcgaggagaaggtcagaaactttgcttctgaggccctccaaggccctcccaggccctttgctccaagtcctcagcaagccagaggacgtcttctgagcccaacaacagtttaaggcattccaaaattagaagagcaatcaggcacccaaccatactaaaagcgtgtttatattttcgcatattttccaatccattgaacaaacaagcaaacaaacaaaagaactggtgtgtagagtgaaaggagcgttagtgtgtataatatctgtggacagaatagtcgtctgaactgaatctacagcaaaactacaaagctgtgatattgtgactccgagaaagtgcagatttcatattccagtaagatttattgaatgcccgttgcctgctaagcatttcatacataagcatattcacacacagcaccttattttgttatcataactctatagggcaatggtattatgctattcttccactcaagagaacttttcagaggttcatttacttaacaaatcataactgccacatcccaggtgctttgttaagctctgggaatgcaacctggaagaagacagatctggttcctctcactttctaagcccagttataacatgctgggcccatgattttactcaacagtaaaatcgaggtttacgctgtgtgctaagagaggcatccaaaccaaacgtgtggactcaggggaggctttgctgatggaacttctaattaggctgggaaatgaaagacgacaggaagctgggtgaggaggggggatggtggtggagggaggacccaaatattccaggcagagggaacgttgtctcaaaaaaataaaaatagaaataaaaaaggcttctgttgggcacgatggttcaagcctgtaatcccggcactttgagagggtgacgtgggcggatcaggaagtcaggatatcgagaccatcctggccaacatggcaaaaccccccatctctactaaaactacgtggtggcacatgcctgcaatcccagttacttgggaggctgaggcaggagaatcgcttgaacccaggaggcagagtttgcagtgagccgagatcacgccactgcactccagcctggtgacagagcaagactccatctcaaaaaaaaaaaaagaaaaagaaaaagcgcctcaggctgtcccagcattttcattcaaaaaggagctttgagagacagccaggtggctagtgacgggctagcagaggcagagagggctgcaccttttctaccacagtttaacattgctcagagattgcgtgtctaacctcaggaaggttttgacatagtttacactgattttactttgttcacttcaggatggaaaggatggcagagtctctgctgcatccaggatagtatgaatcattaaaatgctgaaaccactttcagcagtgtattctagtcctggccggaagtcactaacctagctgaaacatcaaatattatggtaatttggtctgagaataaataatagattatgttaatacagacagggatgagataatgagaaacaggctacttaagaagcatattgagtggtttatttgtgaatcaaaaagaagcaaggaaattgcattaaaagaaaaactgaccctggagtcactcttttaggtgaccttaatattccataaattataagttaagataaatgaaacaaaagctctatattatgaagagtgaaattattttgtaattctgacagaaaactaagtattctaacattttactgaagaaaagcctgttgatcattctcatttcccgccacagaacacgtataccctttgccaacacttactgagcagttactatgtgcggttactaaggtctaatgttttgttttgtttttttttgagacagggtctcactctgttgcccagactagagtgcagtggcgtgacctccgctcactacagcctcaacctcccaggcttaaacaatcctcctgcctctgcctcccaagtagctgggaccgcaggcacgccatcacacctggctaatttttctacctgtttagcaacagggcctcactatgttacctaggctggtcttggactcctaggctcaagcgatccacctgcctcagcctccccaagtgcagggattacaggtgtgagccaccatgcccagcctaactctttacatccacgcatatactaccttaaacatctttgccatgcgagaatgtagataccacttgtatagattgggaaactgaggcacatgatggttgaataatttgccagaggaaacagagctggcaggctgaagggcttcagaccaaaacttctctgacctcatttggtagcaaaacatatgcaaagctttctacaatctttacataccccattaagtatgaatacttatacattctcctgcagaaatatgtataatcataatatactgccccaaatccctcttaggagaactgatagatggtgtgtggattgtctcctgtctctaaaaaacactctgaggccaggtgcgggggctcacgcctgtaatcccagcactttgggaggccaaggagggcggatcacgaggtcaagagatggagaccagcctggccaacatggtgaaaccctgtctccactaaaaatacaaaagttagctgggcgtggtgacacacacctgtagtcccacctactcaagtgaggcaggagaatcacttgaacctgggaggcagaggttgcagtgagctgagattgcaccactgcactccagcctgagcaatacagcaagactccgtctcaaacaaaacaaaacagaaaaacactgtgaattctaaatatctgacctcaggggttttggaaaaggcattttggtcctttgcaatttatacaccaacaaataatgaattaatatagtaacataataatttatttagtataccctttaaatttaatacttgcattttccagatatcaatataaagaaattggcaaacctcaaataaaattcaattggcgtgttttagagacagttatgctgctcttgtgggccgctgcctgaaatccaggtggctgcctgctggtagtctggagtgtagtgtctccagaatgtaaagcactgaacaaagcaaggacatcatgagacatcctgtttgaatattttgtctgcaatttagtgaactgtgtgatcctcagcaaattaccaggtgactctgtaacactgtgataacagtttatgtgtccaggttattgtgactattgaataagatgatgtgggtctttacacctggcctcttcatgggcatgtcgtaaattgtagcaattattaagctagataattatacatagggataatacttttctatcaaagcaaataataggcactagctaaatgtctccatgaaagctaagtatgataaaatacacaggaagcatctccaacatgaaaagtacccttagtgctttgtaagataacagttcccacagtcatagagcttaccttttggaaaggcggaagttgaaaaatgacttttttttttttttcagacgaagcttcgctcttgtcccccagactggagtgtgattttgcaatctcagctcactgcaacctccgcctcctgggttcgagcgattctcttgcctcagcctcccgagtagctgagattacaggcacctgccaccacgcctggctaatttttttgtatttttagtagagatggggtttcaccatgttagccaggctggtctcgaactcctgacctcgtggtctgcctgcctcggcctctcaaagtgctgggattacaggcgtgagccactgtgcccggccgagaaatgattttattatgtagctttgaaatgagttcaaacacgtaatttgctacatgagtgacttaacgttttcctgtgataaaaacatggagtgtaatcttccccacgagaatgctgggtcacactttatcaggccacatatgtgttgctggcttcaacctctagaccccaaacacagaaaatgtgagattttgacaggcacattgagagttcaggctgtggcaagaatactgtctgccaaccttcaggcaagtctctgaagccgtacccaccaacactggcaccactggctggcatcaggggccttgtgtcatggtggatctatgctgcattgctgaaattcactctccaaagaacctctcctagaaagggacacctcctagaaagagacacctcacacttgcattcaactgtacggctacagaggccttctgccatcctaactgaccaactagactttaataaaattagaactcacttactctgtggttaatggacctccctcctccatggagtggattccctgtgagagctgttctcattattctcccccttttgagcactgaaataaacaacaacaaaagctacaaaaaaaaacctctttacatggcaataaactgtgattcatgaaattatactttgttcatctcatttcaatcataaaaaacactttaaaaagcaagtttagccgggcgcagtggctcacacctgtaatcccagcactgcactttgggaggccgaagcaggtggatcacctgaggtcaagagttcgagaccagcctgagcaaggcggtgaaacactgtctctactaaaactacaaacttagctgggcatggtggcgggtgcctgtaatcccagctacacgggaagctgaggcagcagactcgcttgaacccgggaggcagaggttgcagtcagcagagattgtaccattgcactgcagcccgggtgacaagagtgaaactccatctcaaaacaaacaaacaaacaaacaaataaataaaaaataaaacgcaagtttaaatgaatatgagaagatggtaagtgctatgcagagaaaaagaaaaagcagaactggcttggaataggtgttgagggagcgggcagcatgagtgacaaaggtgacaggtggtaaatataggcctcaatacaaaagtgaagtcggatctgagactggaaggaagtgaggacctagtgagtatcagtagaaagtgttccaggcaaggactgtccagggcaaaggccctaaggcaagaattgccggctatgttgattcaccatcaaaagcatgcccagagccctgagccaggtgggggaattgggggagatagtagagtagatgggttcagagacctgggagtgtggagatccagagaaccacacaagacagtaccggcacttctgacagtttctttgttatgtacctgtgcttccatttgaaatcgtccggcccaggggtcagcaaactttttctataaagggccagatcatgagtatttttttttttttgagacggagttttgctcttgttgcccaggctggagtgcaatgacgggatctcggctcaccgcaacctccaactcccggattcaagccattctcctgcctcagcctctggaatagctgggattacaggcatgcgccaccatgcctggctaattttgtatttttagtagagacaggatttattcatgttggtctggctggtctcgaactcaggacctcaggtgatccacctgcctcggcctcccaaagtgctgggattacaggcatgagccactgcgctcggcgatcatgagtatttttaaacgttatggttcatatgatctctgttgcagctactgaactcagctactatagtgtgaaagccataggcagttatgtaagtgaatgagcatgattctgtttcaggaaaactttatttacaaaaacaggcacggggccatgctttatctgccagccatagtttaccgacccctgctttggcctaacttataaacacaaggaatttttctctctgttttcttctagacattttataatcgtatttattccttttttatatatgaagagatttattctgagccaaaacatgagtggccagttgcccatgtcacagccctcgggagatcctaaggacatgggcccctattttttcatttgggtctgtggttcattttgaggttatttgtgtgagtgttagctaatgcttgagtttatatagaaaatatgtcttatttatatttaacatatttctggcctatggatatctaattgttcagcactatttgttgaatgattatgttttccctttaccttgacacttcagtcaaaaatcaattgagtggggcacagtggctcacatctgtaatcccagcactttgagagaccaaggcagacggatcacttgaggtcaggagttcgagaccggcctggtcaacatggtgaaaccctgtctctactaaaaatacaaaaactagccaggcgtggtggcacgcacctgtagtcctagctgctcaggaggctgaggcaggagaatcgcttgaatctgggaagcagaggttccactgaggttgcaggttgcactccagcctgggcgacagagtctccaaaaaacaaaaaagtcaactaaacgtgtgcacctgtgtgtgtgcgcacctgtgtgtttgcgcacctgtgtgtgtgtgcctgtgtgtgtgtgtgcgcacctgtgtgtgtgcctgtgtgcgcgcctgtgtgtgtgcctgtgtgtgtgcctgtgtgtgcgcctgcatgtgtgtgcacctgtgtgtgtgcctgtgtgtgtgcacctgtgtgtgcatgcctgtgtgtacgtgtgcacctgtatgtgtgtgcctgtgtgtacccgcctgtgtgcgtgtgcacctatgtgtgtgcgcctgtgtgtgtgcgcacctgtgtatgtgtgcctgtgtgtgcacctgtgtatgtgcccgtgtgtgcctgtgtgtgtacacctttgtgtgtgcctctgtgtgtgtttacgtgtgtgcgcctgtgtgtgtgcatgtctgtgcctgtgtgtgcctgtgtgtgtgcctgtgtgtgtgtgcgcctttgtgtgtgcctctatgtgtgtttacgtgtgtgtgtgcctgtgtgtgcgcctgtgtgtgtgcgcctttgtgtgtgcctctgtgtgtgtttacgtgtgtgtgtgcgcctgtgtgtgtgtgcatgtgtgtgtatttgtctctctattttggactctctattttgctctattgatttctatgttgattcttacacaaatacaacactgtcttgattactgtatctttatggtaagtctttttttttttcggagtctcacactgtcgcctgggctggagtgcaatggcacgatctcggctcaccgcaacctccgtctcccaggttcaagcgattctcctgcctcagccacccaagtagctgggattacaggcgcccaccaccacgcccagctaattttttgtatttttactggagatgggatttcactatgttggccaggctggtctcaaactcctgaccgcgtgatccacctgcctcggcctcccaaagtactgggattaaaggcatgagccaccttgcccagcctatggtaaatcttgacattaggtaatctaagtcttttaactttgttcttatttaaaattgttttggctattctgtgtcccttcatttacatatatgttttaggggcagcttaccaatttctacaaaaaaacactgttgggatattgatgtggattatattgaatctatagatcaatttgagaagggtttagttcttaacaaggatctattagataggataacaaatgtacaaaccataaaagaaaaaaatgatgaattgcacttcaccataattaaaaaggcacaactccaaaatggcaaaccataatctggaagaaaatatatgcaaaacataaatctaataaaggacttgtatccaaaatacataaagcgcttttataactcaataataaaaaaaatcaacctaattaaaaactgggcaaaggatttgaatagacaattcacaaatgaatatatataaatggcaaacaagtacatataaaagcatactcaacatcattagttattgggaaaatgcaaattaaaattacagcgagataccactacgtagccactacaatggctgaattttaagcggctgacaatgccaagctttgtcaagagtatgagacaactggaactctcacaaattgctagagggaatgcaaaatgaaaagtatgcagtttcttaaaaagtttaccctctcctcctgtatggcccagcaaacctgctgctaggtactcaaccaactgaaatgaaaacatgttcacacaaagacatgccctgtgatgttcattgcagctttattccaaattgccaagaactggaaacaacccaaatgtccatcagctggcgaatggataaacacattaccctatgtacatacaatgcaatactcctgagccctcaaaaggaataattcactactacatataacaacctaaacaaatctcacatgcatttgctaagtgaatgaagccatacacaaaagggcacatactatgtgattccatttaaataaaaatggattgcagaaaagcaagcctacagttagagaaagcagatcagtggctgccagagaccatgaaagtggtggttgtgacaggaggattaactaggaagggcatgaggagagttggagggagatggaagatggacctgttctacactgtgacttattgttaaatgatgcttacatgtgtggaagccgttgaatcacaataagcaggcaagctttgatggaggcttgaaccagggtgatagggaaagggaactcacaatgagtcatagacacaaatgttaaaataaaactagtaaacatctagaaaaaaaaaacgaaagaaaaggctgggtgcggtggctcatgcctgtaataccaacattttgggaggccaaggtgggcagatcacttgaggtcaggagtgcgagaccagcctggccaacatggtgaaaccccatctctactaaaaatacaaaaattagccgagcctggttgcgcacacctgtaatcccagctactcaggaggctgaggcaggagaatctcttgaacctgagaggcaggggttgcagtgagccccactgcactccagcctgggtgacaagagcgacactctgtctcaaaaaaaaaagaaaaaagaaatcagaaagaaaaaaacctttctgtttataagttaggccaaagcaggggattggcaaactacatccagcaggtgaaacgtggcctccgccctgtttttcctaaataaagttttaccgaaacactggccttgcttactcacttgcataatgcctatggctttcttgctgcaggactgagctgagcaggtgaaaagggctcagattctctgttttgaaggtagagtcacaggatctgaaggctcgggtgtagaacatgagttttgaggatgatgtgccaccctcctcgcttcctgcggaaaggacggccgtggctgagcgcggtgggtgcgggccttgatcccggactgcggtgtgttgtcaggtttctccaccgtaagatcctttttccacaccgcgctcctgggaagaaagtcagaaagtgcagcccttccttaggcaagcgggagtttcgctccggctctatccaccctgtttttaaaactgaacatcgtacacattcgaaaacaactacaaattctctttcattagctaattttattttattggttcctcttgaagttagatgatgttatacattcatgatcccagcccagagctcctgattcagcctagccagggtgaaacccaccggattaacaaatgcctcgtgtgattcagatgcaaatagcccatcagcccacttcagaaagctcctctctaatcacttactaatgataattactctgaactaggacctctttacggaggctgaagctgtttttctcttggttaaggtattgtcattagtttcctgtcagagtcggggtcacctctctgcccttgtcggcctgcccaacagtcacacaagttgaacgaattcggcaaccacctcattactattcattgcccatgcggatattcaaacgcagcacacagctctatcgcggctccactccacgaaaagtcccaagtatatacaaataattgtataaagtactaaaaatgcactttaaatgagttccacatctccaagacacagacaaaccaaggctattgtcaagagtccttctagaaatgtgccttcaaaagacacaaaaggaaacaacgggagacattcaacgaggacagtggtttcctccgacgaggggaatggaaagcctggcgctgggagagctgcgctcttgaccctcctttccctctaactcgcccagccatctagggaaatgcacttcgtttttgcgcttcaacctcttatctgtaaaacattaataataggccgggcgcgggggctcacgcctgtaatcccagcagtttgggaggccgaggcgggtggattgcctgaggtcaggagttcgagaccagtctggtcaacatggtgaaaccccgtctctactacaaatacaaaaattagccgggcatggtggtgcgcgcctgtaatcccagctactggggaggctgaggcaggagaatcgcttgaacccaggaggcggaggttgcagtgagccgagatcgcggcaccgcactccagcctgagccacagagtgaaactcagtctcaaaaaaaaataataataatagcacctgcctggttttactttgcgtagatttaggataaaattagacactgcgtgcatctgagaaatacagttgtcacacagatgtgaagttttctgttttttgtttttttctaaagcagtcttgtttcaataaaaccttatttacaacaacggattttctttatttctttacaaatactcatgggatcaaataattcaatttttaatttttaatatcatcatgattctatgcccagatctaggttaaggaaacaaagttgaagaaacaaattgcctctgatgtcccagcagataatgaagtagatcaagatatacgacacacaaaattatacacaaaacctgtagattctaggagtattcctatcaagttctatttagttgcttaaaataattaccttagcattctaaaaatctgtaaacaatatggcatttctgaatatttaacattggccttttcaaaatgaagttcaattaccatttcccctgagaagctgtaagcctgagagggtctcgtctcctgacactacggttttcaatcctggctcggccgcttactggctggtgattgtgggtgagtttctatgctcttcagttttctcatcagtaaaataaagataagaacagcaccaactttgtgggttatctgtgagtagttagtgtccacatgtgcagaagtctttagaacagtgctatatgtgtttaatattgttatttttattactatcggttttaagggattaagcagctgttgaaaccaatgagactacttttttttctttttctttttcttttctttttcttttctttttctttctttcttttttttttttttttttttttttttttgtttgagacggagtttcgctcttgttgcccaggctggagtgcaatggcgcgatctcagctcaccgcaacctccgcctcccgggttcaagccattctcctgcctcagcctcccgagtagctgggattacaggcgtgcaccaccaagcccggctaattttgtatttttaggagagacggggtgtctccacgttgaagctggtctcgaactcctgacctcaggtgatccgcccacctcggcctcccaaagtgctgggattacaggtgtgagccaccgcgcccggcaagactactctttaatacacgcacacacacacaaacacaaaacctggaaaaatgtgctcaaatagtttgttagtactttatataacaactgaaaattctttggatttaatcaaaatggcatatttgaagtaaaaacacctatacctactctctcaagcctcttaggtagaaaatatttgatagaaaggaaattaattggattaccaaaggacagtaggtgaccccaattacttttgcttttaattataaaaaaagtctgagccataaaattggaaaactcttcctgtaatgaaaaatgtagagaagtagtttcacaattttacattttcttttttttttttttcttttgagatggaatctcacgctgtagcccagactggagtgcattggggcgatcttggctcactacaaactccaactcctggagttcaagcgattttcctgcctcagcctcccaaatagctgggactacaggcacctgccaccatgcccggctgattttttacttatttatttatttatttttatttttaatagaggtggggtttcaacatgttggccaggctggtctcaaactcctgacctcaggtaatctgcccgcctcagccttcctaagtgctgggactacaggagtgagccattgcgcccagcacaattttttttttttttagactgagtctcactctgtcgtccaggctggagtgcagtggcaagatcgtggctcattgcagcctgcatctcccgggttcaagcgattctcctgcctcagtctcccgagcagctgggattacaggcacgcaccaccatgcccggctttttgtgtttttagtagagatggggtttcaccatgttggccaggctggtctcaaactcctgacctcagatgatccacccgcctcggcctcccaaagtggttggattatcggtgtgagccaccgagtctggcacaattttacattttctctttaactgacacaaaaggtcttcctcttatgtgacagtatattacgatggtatgatataccatcctattgactaatatttaaaattgcaaatcacttatcgaaatccagatttttaaagattaggtttaaatctgaatgcttcacaaagatcacttggctgccccggaagagctgagttccccccgcgctcagaggccgaagaggtctttgcgattatgggagctttcttaccactgtgggcacagagtctcatggcacctacacaaagggcctgctcctgtatttttttgtggtttcccattccattcagcacagacaaagggacccgttgaaaggcacacaggtggattctcttaaaagacatttacggatattaaaattttaaagtttatctgagcaaaaagctattcataaattgggcagctccagacggcaagcagttgggctccaccaaggaggggagtcgaggggactacttttataagatgtttgtagaaagaggctggttaagcttaatttactattcacactgagcactgtttccgtttgctgacagaggaactcaagggattggggccagctcaacctaatggtctctcaattgattttttttttttttttttgagacggattctcgctctgtcgcccaggctggagtgcagtggcgcgatcttggctcactttccaggttttcttattgccctttttctttatttcggcaagagtgagggacatgcagccaacagtctccagtaattcttcactctggcttccttcagtagggacttgacattttgatgtaggtgtcttgatgctgttgtttttacatgtacattttccctcggaccaaaaaacaaacattaaatatttcctcaaaaaaaaaaagctttatttttccctgcttataaaaataaacagaggccaggtgcggtggctcatgcctgtaatcccaacactttgggaggccaaggctctgggaggatcacctggggtcaggagtttgcgaccagcctggccaacatggtgaaaccccatctctactaaaaatacaaaaattagccaggtgtggtggctcgcacctgtaatgccagctactggggaggctgaggtaggagggtcacttgaaccctggaggcggaggttgcagtgaaccgaaattgtgccactgttctctagcctgggtgacaagagcgaaactccatctgaaaaaaacaaaaacaaaaaaacccagaaatctctcaattaaaaatggatcctgaatttcatcttttaattttatatgtattctgaaatgctatcagaaacaactatgaataatggagatgagagatttcaaagaatttttacaaagaaggcaataatgatctagagcttgactctagctctgtgtaaaataaagcttgataagtagttgttatcggccgggcacggtggctcatgcctgtaatcccagcactttcggaggccacggctggcggatcatctgaggtcaagagttcaaggccggcctggccaacatggcgaaaacccatctctataaaaatacaaaaattagccgggtgtggtggcaggcacctgtaatcccaggtactcgggaggctgaggcaagagaatcgcttgaacccgggaggcagaggttgcagtgagccaagattgcgccattgcactccagcctgggcgacagagctagattctgtctcaaaaaaaaaaaaaagaattcattatctccaacatgtttactatagctggggagcaaagtgaacataaattgagtataaaaggtaattcataatgaagagctaaattgtgttgtgaagactgaggatgttacagttcaaagcactgagggctagagcagcaaagacggcttcgtttgtagtgaagtgccttcaaccactcctcaccccagttgcctgcttcgtaggcatacctcttcaggaaaatcactaatttatactctccaagaatacatgagtgtgctacaaagaaaaaaaattaatggtaaaaatatttatagaaaaaatcgtttgaagtgaattattatacattttttagatgtgatgatggcattgtgatcatgtttccgaattttccttatctattagataaataaaatagttcttcatgatatgaaatgtcgaaaattttcttcaaaatactccaaaaataagtttcctggcacaacttttaactttgccaagcgcaatgactcatgcctgtaatctcagcactttgggaggccgaggcgggccaattacttgagcccagaagtttgagatgagcctgggcaacatagtgagagactgtttttacaaaagtaaaaaatatatttaaaaaaataaaatactaggtggatgtggtggcgcatgcctgtagtctcagctactcaggaggcgaaggtgggaagattgcttgagcccagaaggtcgaggctgcaataagccctccagcctgggtgacacagcaagaccctgtctcaaaaaaaaaaaaaaaaaaaaaaaagaaaaaaaaaaaaagaaaaaaagtaaaaagaaaagataagcttaacaaaaaagaaaagaaacttttaacctttaggttgattaaatttctacgagattttctgatttttctcatgggctaatagtcatgagaggttagaggtttatgataagaattttttttttttttgagactgagtctcactctgtagccaggctggagtgcagtggcgtgatctcagctcactgcaacctccgcctcccaggttcaagcgattctcctacctcagcctcctgagtagctgggactacaggcacccaccaccacgcccggctaaatttttgtatttttagtagagatgggtttttgccatgttggccaggctggtctcaaactcctgacctcaggtgatctgctcgcgttggcctcccaaagtgctgggattaatactatcaaattgcctttttgttttgctaatatttaatactcatgataaaaagattttagactgtagcaggtttttctttttaaccctggttatattatttggcatgattcagatgttgaagtagcctcaattttaaaattctgccaggcgtgaaaaggcatccgccctctagcttactttacctggccactgcttgtatagcttacgaggtttaatcttgtcatttctggttgagagaagcagattttcacccacatgtagggttttagctatgtttgttttttctaaacagagccaactgttaattaatttctaagagtaggtaatacatgcatgcacccattacaaaagtagaaaaacaaaatgatttacaatgcaaagcaaatctccctctcataccaagcccccagctacccaggctccagcctgctcacttaactttggtcaattgagatcagtttacactccttcattgtttcataacctcttggaaagttctcgtaacaggaaaatgtggctgcattttcaattctgacctgtttctctaaatagatcacattctctaatctttctatgacttttctttctttcttttttttttttgagacagagtctcgctctgttgccaggctggagagcagtgacacgatctcagttcactgcaacctccgcctcctgggttcaagcgactctcctgcctcagcctcatgagtcactgggattacaggcacgtgccaccatgcccggctaattttttgtatttttagtagagacagggtttcaccatgttggccaggatggtcttgatcgctggacctcctgatttgcccacctcagcctcccaaagtgctgggattacaggcgtgagccaccgcatccagccaacttttcttaatttaagatggacttctatctcactgtgtaagtaaagctcaaggcatcatttattcttttaatattcacttcctctcacttctacaggatgtaaactgtctcaactctttttcttcgtttgtaagctgtgatcgtttcttaatttgttttattatttttattgccttctctgttttcctaaaatagtttctaaattttaaatgaacttttaattttagaaaagttttagatttacagcaaagatgaaaagataacacaccctcactcccaatttcctgcattgttaacgttgtacattatgatggtatatttgttacaactcaagaccaacactgacgtattattattgactaaaccccacactttatttcattttactagtcttcccttctatcctttttctgttccaggaggccatcaggatcccacattacatttagatatgtgtctccttacattcctctagtttatgacaatttctcagacttcccattttgataaccctggcagtttcaggagtactggccaggcccctatacaaagttcttccatcttggtttgatgtttttatgaatagactgaggttatgggtgattggggagaatatcacaacactgaagtagcattctttttttttttttttgagacggagtctcgctctgtcgccaggctggagtgcaatggcgccacctcagctcactgtaacctccacctcctgggttcaagtgattctcctgcctcagcctctggagtagctgtggaccaccacgcccagctagtttttgtatttttagtagagatggggtatcactatgttggccaggctggtctcgaactcctgaccttgtgatccgcctgcctcggcctcccaaagtgctgggattacaggcatgagccaccgcgcccggcctgaatatgatatgattcttaccatatcatatccgggtgcatgccatcaacctgactcttccctgatgcaattaacaccttgactgcctggctgaggactgcttgtcaggcttccccctgaaaaattaccactcctccacctcttttccatagtcttgaaacaagctgctggcatcacctacacttagggtagagaggaattcagctccacctcatcgaggggggaaatatttacatacattatttggaattccctatgggagatttgtctcttcttcactattcatatgctagattttctgtgtattacagggttctttttatacagcaattaccaaaaaaaaaaaaaaaaaaaaaaacctgcctactgcctacatataaacatttttatctgagatatttccattatacctctaaatgaagaaagtaaatgctaacagttgttaactgataatttgttcaacaaatatgcattaggtttggcgagatggtttatgtctgtaaccccagcactttgggaggcttaggtgggaggactgcttgagctcaggagtctgagaccagtctgggcaacatagaaagatccctgtctctacagagaaatttgtaggctgggcgccgtggtttacgcctgtaatcccagcactttgggaggtcgaggcaggcggatcacttgaggtcaggaatttgagaccagcctggccaacatggcgaaaccccgtctctatttaaaaaaaaaaaaaaagtagaaaaattagctgggcgtggtggcgggctcctgtaatcccagctactcgagaggctgagacaggagaatcacttgaactcgggaggcagaggtttcagtgagccaagatcgtgccactgcactccagcctgggtgacaagagcgagactccttctcaaaacaaaacaaacaaacaaacaaacaaacaaaaaagaaggaaatttgtaaaaaaaaaaaaaaattagccaggcgtggtgtcatgcacctgtagtcctagctaccaagggggctgaggcagggggatcacttaagcccaggaattcaaatctacagtgagtcactatcctgctactgcactccagcctgggtgacagaacaagaccccacctctatacatgctaccctggcaggcacttgataaacacagtgctgctgatgaggctcacgggctaatagacaatcacaatgcggtatgattggtgacctctggaatatatgtatacatgcaaaggagcctacaggacttccacacagagggcttagggtcagcaaacatctcagaaggacgggcattcggctgggcgcggtggctcacccttgtaatcccagcacttcgggaggccgaggcgggtggaacactaggtcaggagttagagaccagcctggccgacacaatgaaactccgtctctaccaaaaatacaaaaaattagcctggggtggtggcgggcgcctgtaatcccagctactggggaggctgaggcaggacaatcgcttgaacccgggaggcagaggttgtggtgagctgagattgcgccactgcactccagcctgggcgacaagagccaaactccatctcataaaaaaaagggacaggcatggggcatgccaggcaggcaattttagactgtacttgtgtagatctttacttgacgttgcagaaatgtcaactgtttatatatgtatttttaatggtagtgtatgtgatacagaagtgctgggtagagaagagcatggtccctttaaataattcggaagtggggaagggatgtgccgggtaaaggagggcgtggtccttagctagggctccgcccccacggacctaggtgaggacaggcatctctgcccaaatgttgcatttcccgcccaaatgttgcatttcccaaaaccaccctggcctgccatggccgcatcctgggcctataaaaacccaagatgctagcaaggcagtgacagaggccgccagacgttgagaggacaagtcagcagaagacgccacagccgctggcggtggagaggaggtcgagaggctcacgcgcgcagaagaaaataccggcacacggacaggccattgaccggcaggaccaggcggagtttggcccgggcagtgggaggagagccaggggaagatcatcttccttctggctccccatcgtgggagagttaacacttgacactcgttctccaagcccaggtgtgctgcgattcttcaggtacaccaaggcaagaacccgggatacagaaatccctctctccttgcgataaggaagggggcctattgagctggttaacatgagccgcctatagacaccttgtaacagacgccccctgggtcttcaggagccgtaaacatccaccgcagacaccgccgtggggtcggagccgcacaaagctcccctggaggtttgagcagcgggaagcgagccagagccacaccccaactgcacaccctgcgggggcctttcagatgggaagagagtaagtctcctcctggtactgtaactttgaggtttggtgattttttttttttttaaacagtctttgaagactgatataaatggtttggccagtgccactaccaggtgctgtctggttttagatgaataactttaattccctgagcttaacttttcatattttcttagtgttttgtgaatattcaagctaagtcagcagtagcgacttagtgcatgactttttgccacccctaatgcatgtccctttgcaatgtgatggttatcttctcccatcaataggtgaagtccattttctcctcctttgagtctgggcttgactgactaacacggcttttgctaatgggaaattaacaaacatgataaagaggcttaagaagaactgacgttggggttttgcttcctgctgctcctgggaccctgctgtcatgtgaacacatcggattatcttgtcggagaatgagaccaggggaagagaaccaacctaccctggccgatagaaagccactcccagggccggacacggtggctcacgcctgtaatcccagcactttgagaggccaaggttggtggatcacttgaggccaggagttcgagaccagcctggccaacatgatgaaagcccgtgtctactaaaaacacaaaaattagctgggcgtggcgggcgcctgtgatctcagctactccggaggctgaggcaggagaagtgcatgaacccgggaggtggagtttgcagtcagccaagattatgtgctccccagcctgggcaacagaatgagactgcgtctcaaaaaaaaaaaaaaaaaagcaaagaaaaaaaagaaagccactcccagagggtaagtggggccatctggatatactagccctcaccagtccactgactgatcaccagaatttgcaaatgaagacaaatgcatgagtgagcctcaccaaaaatagcaagcaaagtgtcctgcctcgctccagtgatgatctatagaatcatgagttgacaattgttgtgttaggacactaaggtttggaatggttcatgacacagcagtagattaccaataccagtcaaatggtgatgagaacagagtaactgttgcaagtttcagaagtaatgctgtgtttttgtttttctttgagaggtttgagtgctgtgctcacctaagtttaaaatgaaaatggggctgggcatggtggctcacgcctttaatcccagcactttgggaggccaaggcacgcggatcactagaagctaggagttcaagacctgcctggccaacatagtgaaacctcgttctctactaaaaatacaaaagttggcggggagtggtgactcatgcctgtaatcccagcacttggggaggccgaggcgggcagatcacgaggttaggagttggagaccagcctggccaacacagtgaaaccccgtctccactaaaaatacaaaaattagctgagcttggtggtatgcgcctgcaaccccagctactcggaaggctgaggcaggaggatcgcttgaactcgggaggcggaggttgcagtgagccgagattgtgccacagcgctccagcctgggcaaaagagctagactccgtctcaagaaaaaaaaaaaaaaaagttagccaggcatggtggcacacacccataatcccagctactccagaggctgaggcacgggaatcacttgaatctgggggcggagcttgcaatgagccaagagcgtgccactgcactacagcctgggcaacagagtgagattctgtctaaaaactaactaactaaataaataaataaatgagaatggtatttgcatatagccactagctggtccccaaaagcctcttccctggccaactggtctcctgcagaaccctgactagtgacaattcctccatggaacctctttttctattattaaacaattatataagtgcatattctgggtaggaagtgctttcacactctaaaaaccctcttctgtgatgaaatctggttgttttcctttaaagatgaaatatatttctactgaccccaatgtggagatcaagtgattctcaccttgaaagtatcatggttggtcactgtgattagaacaagaaaatgctgtgatttttctctgcaacagtagggccgacttgtcctgaaagccgaaagtctttgcagcgaaaggaaagggtgcagtggatgactcctagccctgagaataacatggatctggaaggtccatatatcattcagtgaatcagtaaacaccactgggttccctttggggatatagcaccaacaataaagggccctgttctgaattctctggaattaaactgagtgttcaggatgcaaaactcattaaaaattggcagttgcggcatggcatggcataataataaatccaggagcagaagggatgcgaacccatatatcaaatgaggtcccaaacgctccccagtgtgtgactcctgctagttctagtgtggctgccattgcatgggacgtgttggagtccttcatgggcgctccatgaaagacatctttctgtgctacaggcagccctggtgggatgtgctcccaccacaatgaaaaagtcagccctagaaagatcagtggcagaggaaagaagtgggtattttgctttgtttttttcccaaaacagaaagacgtaattgctattcccactctggtaagcttggcatataaataccagggactctggtcttcctggcaacccctctctccattggtactcagtcactccaagcatgttccatggcatgttaataagtgctgcttcaacaagccttaaagaacatagttccactcttcatgctaattgcctatgcacattctctcccacctttcaccatcacaaattcagaaacagccagcaactcctcacaagtgaatggtattaagctgttaggtcgtaagtaagaccaattgaatcaacaggttcataggactttaaacgtcacactgcttcagatgtctagatcatcagttactcccatcctgctgtgcctccatctccaggtttcttcacatgagcttactagcttaaatgagatttatttgaactaaaaaggtgaaggatgacagggcatggtggctcacgcctgtaatcccagcactttgggggccgaagtgggcggatcacctgaggtcaggagttcgggacctgcctgaccaaagtggagaaatcccgtctaccaaaaatacaaaaaaatgagccgggcgtggtggcgcatgcctataattccagctactcgggaggctgaggcaggagtatcgcttgaacccaggaggcagaggttgtggtgagccaagatcacaccactgcactgcagcctgggcaacaagagtgaaactctgtctcagaaaaaataaaaaaaagcagaaggatctccccacgctctcacaatggttagttactggttaaaattcattatgtgcctttagaaattaaagtgataagttggagacctaactagctctgaaagctaataagctacggcagagagggtgggaatctgagaggcagagagtaagagtaagtaaaggagagtaagagtaagaaaacacgtgtggggtccactctaccctgtgacggtgtcaataaactgtatgcaaaaggctagtactttttttctgaacttgtctaaatctacttttatttaaatagaaatccaaaacacttcctaggttatgattttcaagatcagtctaaaatttaaaagtaagcccctaaaaataatgtttgaattattagctatagaaaatatttcatggctgggcatatgtgtctcacgcctgtagtcccagcactttgggcggccaaagcgggcagatcacctgaggtgaggaagtcaagaccagcctggccaacatggtgaaaccctatcttactgaaaatacaaaaattatccgggcgtggtggcgtgcacctgtagtcccagctactcgggaggctgaggcaggagaatggcgtgaacccgggaggtggaggttgcagtgagccaagatggtgccactgcaatccagcctgggagacagagtaagactccatctccagaaaaaaaaagaaaatatttcatgcctatcaatcagaaaaaatacaataattattcaagcacacatgaaatcttaaaatcatgttcacgtgctagcatacgaggaaaaccttaatccattctgaagatcaatattataaagattgtggtctgctgataatacagtaaatttgaaaccattagtagatgattgatttaaaatgttatgcccgggacatttacaacatgcaattaaaaacttctgagcaagcttttgccagtgcctgctgccttttgtgattgtgcatcctagctgaggcatgcagaaccaaatgaaagcaaggattcattaactctttgaacttgttaaatgctaacagttaaccattagaaatggttcaacgatgtgagccacactacttcaactttttctttgttgtagttttagaatggtcaatttttagctacttgacagattaaaagcaaaataatcacgccatatttagtcctggagttcaagtctacatgtttatgtgaaaaatctttgtaataaacttttaacatgagaaggcaaccttaagctctattttagccaaatgaaacaaaacctgaaattgtattagaacatttccctgtcttcaaactggtgtaacagaatcctgatatgcagcttgatggatttcaccagttaaggcacattcttctccctccgtccctgcaatactgtgtatactgaacaatgtgcatttgtctgaggagttattttgtttgccaccacttaacgaatctcaaaattttgagtaactgtacctcagtctaatcggactttttatgagctttataactacattgaaacccttaattcccatttctgggtgtttgtgagcctgattgctgtcatttgcgactctaggtactcaccagctaaataaacatagtttttgtgtggccagcacgtactgctcctcaattcctttctccagcttccgcggcgtcctggcatccttaaaatatctacaaaatatggccttcattcataaatgaaatcagtttctatgtgagtgtgtggatgtttattgatcgcacatgtataagtggaaatacagcatatgtctgggtattcttttttcttttgagacagtcttgccctgttgcccaggctggagttcagtggtgcaatcttggctcactgcagcctccaccttccaggttctagtgattctcctgcctcagcctcctgagtggctgggattacaggcgtgtgtcaccatgtacagctaatttttgtattttcggtagagacaggttttcaccatgttggccaggccgggctcaaactcctgacctcaagtgatccgcccgcctttgcctcccaaagtgctgggattacaggcttgagccaccgtgcctggcctgtgtgggtatttgtatagtcttctttttaacatatttttttttcattaattacatatcaacattaatttcgtatcttgaaacaagttgattttgtataattaaaggtgccgagcatctataaaataaataaataaataaaaattaaaatcttctgagcaaaatgaggttcattttgaagaatgtagaataaatgacagcagcaccccatgttgatattggtagaacactgccaaagcagtatctagagggaagtaaagaactttaaatatatgaatgaagaaataagaaagattggcaacaaattaggtcaggatttgacccagaattcaccctttagctgttctgagatatagttcatacaagaaaagtaggataaatcctttacttttttatttaccagactttagaataattcattgataaaatactaacaattctctgatccctaggtagagtattatgcatgagttttcacttcatttatacttttatttctgaaattttttttaccaaacatattctaactttataatcagaaaaatacttttgaaaaaggagtcagggaataaagatatatttgcaacttagtaaagttcctctgatctcttgaagtattaaaacttttgaatacatgtgaaaaaaatttctaagacaactcatgaaatctgaaactgggatggtttctggaggttttcaaagaaagcgtctcatactaaagttaagacctctgttttatgtcattttaaaagagagcgcagctctcgtgctggggcattgcttcaacccgcacttggaggaatgagcatcacttcctgaatcaccagccttttctacagagcctcgattttctctagggtcttcccatccacacaccggcaatgctgacaatactcagagcttatgaaacctgacagatcacagtttgaggtgaaaaaactttaggaatgaaaactatcaagaggaattggaaatgaaaggtgaatgccattatatttattcaatttatagctaaattataatggaaaaaatctcgaaatagaaacattttttaaatctgaagactgtaattataacaatgagcattgtcataatgttgacctgtgtcacattacaaatattctttatcaataagacattaaatgtaataagttaatgaagaagttatgacttttgccaaaatgatagggcagtttttttattttgaattttaaaaaaattgtgcttcagtttgcaggatgtttgtgtgtgtgtgtgtgtgtgtgtgtgtgtgtgtggtgtaggggggtgttggtatgagatagaaattgactaacacagtccagcttctgttgattctttttctttcaaaaaaaagtcttcccataatatcttacactgctcgtctcagtagtttagtcaatgtttaacacatgccaaaatatttctgactctcagaataatttgattttagagaagtagatgggaccagccaggttcttaattttttccccacaactttttattttgagaatgttcaaacccactgaaaagctgcagatagtccagtgaataccctttgtgatgggctaaattgtgtccctacaaaattcgtatgttgcagtcctaaactgcgtatctcagaatgcggctgtgtttggagagaggatcttaaaagacgtgatgaagttaaggccattagggtgggccttaatccaatctgactgctgtctttgtaagaagaggaaattgggacacaccctgggacacccctgtgaagcagctgcaagagccaaggagaggggcctcagaggagaggaaggaccccgccgacagcctcagcttgggcttccagccttcaggactccgagaaaatggatctatgctggttaagccagccagtaagtggtattttattatgcgagcctgagcgaactaatataccttatacctttcttatacgttcactaattgttaacattgtgtcacatttttgtgatccctctctctgtctccacaaacacacatgcataggcatgcacacacactaacatgtgaagtatacacatacaacctatcacacacatcatacatatgcatacatatgtgtgtacatatgtatacgcatgtctaccacacttttggcaggggtgaaggaacaggtgaaccattacatgcctgttagttgcaggcaacatgacttttttttcctaaatacttttgtggaaacctcccaagagccagtacatttgcttataaaaccacactataagtttcatattcaggaactaaaaacagtactacattatacggtaatatgcggtcatatttaaatgttcccatttgtcctaatatagttaggtttgtttgtttgtttttctccaactcgaagtttaatcaaggcacacacactgcatttagctgccaagtgtgtttgcttttttttttttttagatggagtctcgctctgtcacccaggctggagtgcagtggtgcaatctcagctcaccgcagccttggcctcctgagatcaagtgatcttcccacctcagtctcctgagtagctatgagtataggcacgtgtcactgtgcccagctaattttttttttttttttgtagagacagggtctcactatgctgcccaggctggtcttgaattcctggcctcaagccatccttccacctcggcctccccaaaatgctgagattacaggcatgaaccaccttgcccagcctttattaagattttctattggtgcaaaagtaattgcagtttttgcaatttttttttttttttttttgagacggagtctcgctctgtccccaggctggagtgcagtggtgcgatctcagctcaccgcaaccttcctctccctggttcaagccattctgctgcctcagtctcccgagtagccgggattacaggcatgcaccaccacactcagctaattttttattttctgtagagatggggtttcaccacattggccaatatggtctcaatctcctgacctcgtgatctgcccacctgggcctcccaaagtgctgacattacaggcgtgagccacctcacccagccgcaattatttttaatgacaaaaaccgcaattccttttgcatcaacctaataatacattcttgtcattattcggatggtcaaatattcccagatttacaagcaggtgtgcttttaagctggtttgcctagcctgtgacatgtccctatgggttttcagcacatccttgcttaagccgataaacaatgaatagcaagtttttcattttgttctatctcttattttgaatctaaaagagcagcccctttttgtttcaaaatcttattgacatattgaagagattggtccggtttctataatgttctaccttctagatttgtccaagtgtttcctcatgatgtcatttagctttgcttatcacgtgtattttgtataatgtgaaagtgagagctaaaggtttcattagctgccaggtaagtagttttggccagatgttttataagttgtgctatactttatgattgcatcacattagcatgtaatatttagttgtcctactcttaaatttaatacttaccctaccattattgaacaaaatacacaaagcaacattaaaaaaagaaaaacaaaaatttaatacttaccctactattaaattgagctgtaatttcatcaccagtgtgtataataaaatgtcaccacattcacaaaactcatgtttttaattcaaatgagatattattgcctaatgactgtaagtgagactttagtgatttcagcaaatatatataatcgttttttgagaacacatccttaaatttcagaaaattgcagtaaaaatgaagtaccaacccattcttggtattacattctaaaactttggcatttttcctttgatcaccaattccacatctggagatactctccggacacttgtcaagttcatgattttactacaggagtctattcgagcaatatttgtaggcacaaaaatgcagaaacagtttcttcaagaaggggcttaataaacctaatgtggaacattggttatgtaactatcatgcagtcactaaagacgaggatctctgtataaggagacagactactatgcagaaattatttagtgaagaaggcaggttgcagaaccctgtatctagtgcaattccatgtatgtttgaaaagagcacagctgaacggaggaatgaatgaagaacatgtggaaacatacacaaaaattagaaaatgttagagaataactttgataaagttagataagattttcgttgtaaaaagcacctattttgaataaagattcattcaggttaaggcctcctttggaccccttacattcacgtggattacttttcaagatatattgcatgatgtctgtatgtctgacattcttcaatatttcaagaaaaagggttttgcaaaaaggccaatctatctaaccacaaatatgacttctaaattaaagacttaccaaaggctgggcgaggtggctcacgtctgtaatgccagcactttgagaggccaaggcaggtggatcacttggggtcaggaatttgagaccagtctggccaacatggtgaaaccccgtctctacggaaaaatacaaaaattagccgaatgtggtagcgggtgcctgtaatcccagctacttgggaggctgaggcaggaggatcacttgaacccaggagacgaaggttgcagtaagccaagattgtgccattgcactccagcctgagcaacagagcaaaactcagtcaaaacaaacaaacaacaaaaaaaaagaaaaaaaagaaaagaaagacaatcaccaaagatacctaattttggcctggcatggtggctcatgcctgtaatcccagcactttgggaggccaaggtgggcggatcacctgaagtcagaagttcaagactagcctggccaacatggtgaaaacccatctctaccaaaaatacaaagattagctggacgtggtgtcacgcgcctgtagtcccagctacttgggaggctgaggcaggagaattgcttgaacccaggaggtggaggttgcagtgagccaagattgcaccactgcactccaaccagggcaatagagtgagactgagtctcattaaaaaaaaataaaaaagatacccaatcttgttacagaaataccaaagtgcagaaatcagaaaactgcatagatcacaaaacttggataccacagaaacagtaatcacaacaataacaacaaaacaaatggaaggaagccaaaccttacaacaaaatgaaccgcacttccttagaggaatgatttgtgttaaataaccaccatcattcacaaaaataacaatcataaattagtagcacatcactgtctgaaggttctcatttttcaaaaagcacctggagcgagcatctctcgcatatactttttgcaggttaattctattttggagacttcttagcttaagatgagccctaagtggacagctgtttagtttcagaacagtctcccccatgtgtatgtgctggtgagtgacacgctccacctgcctgcaggagctgctgcctccttacatctcccagccatgcatcgcgcctttccctttgggaagcacttaatgagccataggctcctgaaagtggaaagagaacacgaaagggcctctggtcctgctgacaaagtcatttccgctgcgcctggtgctttttggttttcacattggattcacttcacttttaattaaagaaacgagatttgtgtgtttctttttgattttggtcatcttccccaaattaaggctctgtctctcaaacaggaagttaacatttattcaagtcaggaacataggggctagcttttccttttccacagatgtacctgagatatttggccaaacttgtccctacattcaaagatctctggtgggattacatagcctaaacgaactcaactactaagttatctttggctatcttcagatatgacccactgatatggtttggctctgtgtccccacccaaacctcagcttgaattttactccccataatccccacatggtgagggtgggacctggtgggaggtatttgaatcatgggcagtttcccccatgctgttctcatgatagtgagtgagttctcatgagatctgatggttttataagcgtctgtcatttcctctgcttgcattcattctctctcctgccgccctgtaaagaggtgccttctgccatgattgtaagtttcctgaggcttccccagccatgtggaactgtgagtcaattaaaactctttttttatagttacccagtctcaggtatttcttcattgcagcatgagaatggacaaatacacccacatagctatcttctttattcatggatataattcttacagttagcaatagacaaaattggacccttttttagtgttacactagctcaattgcatagacatccagtgacctacagctttcctaagactctaatgtttaaagcactgtcatgccccgggccctctctcggcactgccccaaggaagtttgactttgcctctctgtggctcagatttccgtagacagttggaaaggcacccaacaaacaccccatccatccatattcatgcaacttctttatggtttaatttaatagagtttgcctccccactgaatccaattttaacacaaaaacaaataaatttctacttcaacgaaaaggaggagaagatgcctatactttgcttatctctgtgggctattccattgtatcttaacctaaggaaagtggtcttttggggaatacatagaaattataatggagcaattaggcagctcaatgaaacaaaaagacatttaattcaatcaattgaataaggagaacaatcacattcaatatggtactagtgtatcatgtgtggaatatttgtgcatttccaaatctcttgatacaccacaaaacacactcaagtttcatggccttagttaactgatctgcaaaaaaataaacatccctcagtcattcctacatgacctcataataacccatatttctacttttctttcctgctgccttttcttgtagctcactacttaaacttctaggccgggtgcggtggctcacgcctgtaatcctagcactttgggaggatgaggcggaaagattgcctgagctcagaagttcaagactagcctgggcaacacagtgaaaccctatctctactaaaatacagaaaaaaattagccaggtgtggcggcatgtgcctgtagtcccagctacttggaaggctgaggcaggagaattgctgaacccgggaagtggaggttgcagtgagccgagattgcgccactacactccagcctaggcgaaagcgagactctctcaaaaacaaaaacaaaaacaaaaacaaaaaaaacttctaacaaaatgccttccagcctcagaacacttccaaagtgctgtcccaactagctcctgattttccttttatctagcaccttcacctgcacaacttgaaccctttacctacattattcttcttacaaaactcattatgggctgggcgcagtggctcacgcctgtgatcccagcactttgggaggccaaggtgggcagatacccaaggtcgggagtttgagaccagcctgaccaacgtcgagaaaccccgtctctagtaaaaatacaaaattagctgggcgtggtgatgcatgcctgtaatcctagctactcaggaggctgaggcaagagaattgcctgaacccaggaggcagaggttgcagtgagccaagatcgtaccattgcactccagcctgggcaacaagagcaaaactctgtctcaaaaacaaaacaaaacaaaacaaaacaaaaactcatctcttcagaaaggccataggtttccttgcctctggattccttgtgtcccccatagtacattcattgtcccttcgatctccatggctcctcttctaggctttgccacaaatggtaagccttctttctgtgggtcttttctgcatgatcacactcacctcgtgtgtgagtaaaacacgaaaaattaaatttcaaacccagacctgtctgcttcgctctagtccttgagtcacattctcatctctctctttttttatttttatttttgttgagatggagtctctgtcgcccaggctggagtgcaatggtgcgatcatggctcactgcaacggccgactccctggttcaagcgattctcctgcctcagcctcccgagtagctgggattacaggcacgcaccaccaagcccagctaatttttgtatttttattagagatgaggtttcacagtattggccaggatggccttgatctcctgacctcgtgatccacccacctcggcctcccaaagtgctgggattacaggtgtgagccaccgcgcccggcctcattctcatctctttctaatggtgaggcctgacatcatctggaactgaagagattctacaatgagctccaggtttcattctctcttccatgcgggcacagtctacctctcccttccatgcgggcacagtctacctctcccttccatgtgggcacagtctacctctccctttcatgagggcacagtctacctcagtcaaccagtctcaaatcttcagggtcgtgtaaacttccaggcccttaaaacctccgaacccaagttgggatcactgcactggggctgtctttgttcctcctgctttccctgcactgccattttgttcattcagcttcataaaacccgctgaaagaaccagtgtaatcatctttaaattagtcaaccaaagttgacactttcatttttaaacttttaaatctattatcctaactttagtaccctttatctgatccctaactttttaactttgagatttgacttcctaatttttaaaagtttacaataaaaaataattttgaatacatagttttacttgtacttaaaactgatgtgaaaaaagtaattaatttttaatgcttgtattttatcttaaagactggctgggcgcggtggctcatgcctataatcccagaactttgggaggccgaggtgggtcaatcacttgaggtcaggagttcgaggccagcctggtcaacatggtgaaaccccatctgaactaaaaatactaaaattagctgggcatggtgtggtgtgcgcctgtaattccagctacttgggaggctgaggcacgagaatcccttgaacctgggaggcagacgttgcagtgtgccaagatcacaccactgcacttcagcctgggtgacagagcaagactctgtctcaaaaaaaaaaaaagacgaatacaattttagatttaaaaaagaaaaagtgttaaaataattacttttaatttatgtagtgagaagaattaaaaagtaaataatatttgttttagctacagtacatagatcatatttgtcttatgaactttaatttttaaataacatgcacatgtacaatataaacttcaggagagtgggaactttatctccaatgcctgcaaaagtacctgatacttagtaggtgcttacaaatatttgctgacttaatgactatacaattcattggctacaaaatggtaaaaagtgaaaagtaacttttccttttatccctatagatacctggtttctacccccagaggcagtcgcaactttatttgttttgtctttctctagagatattataagcccacctaagcatgtgtatatctatataaagacagttagacatatatgcgtgtatgtacacaccatagatatccttttttctaccttcaaatgggaacatcttgtacatatttcctgtattctaccttttgcctcaactgtattttgggtgtaattttatatcaattttgggaaaactctctcttctttataaaagtgacatagcattccttgtataactgtgtcctcaatttatttgaccaatcttttattggtggtatttcaatttctagaattttgtgatttttttttttttctttagacagaagtttgttcttgctgcccaggctggagtgcagtggcacgatctcggctcaccgcaacctccgcctcccaggttcaagtgattctcctgaatcagccttccgagtagctgggattacaggcatgcgccaccatgcccggctaattttgtgtttttagtagagatggggtttctccatgttggtcaggctggtcttgaactcctgacctcaggtgatccacccgcctcggcctcccaaagtgctgggattacaggcgtgagccactgtgcccggccgaattttgtgatttttaaacaatgctgtactacgtgttcttgtatggatagcattgctcatacatatgagtgtttggaaaataatttttccttgtgcggctataacaaaacacttgagaccagataatttattaagaacagaaatttattttctcacaattttggaagctgggaagtccaaggtcaaggtgccagttgtctggtgagggctgccttctgcttccgagatggcaccttgatgctgtaccctctggaggggtagacgtgctgtgtcctcacatggcagaaggcagaaggacaaggaagccaaaacctgggtaaagcctatatatatatatatatatatatatatatattatatatatatggctttaaaggtgtatacacacacacacaaaggccttatatatacaatttacatacacatatatatacacatgccttaattccattcacaagggaaggagctttcctggccctcccttaacacctgaattttggaggtgacacattaaaaccatagcaatatcctagaagtaaaactgccatatcaaagagtaaatgcatttaaaattttaatgaatattggcaaattttcttccatggattatgtcagtttatacttccatcagcaatgtataaaagcaccattttccttcacactggccaacacattgctatcacattttgagatcattataatttatagttgaaaagcgatatcacactattactttaatgttcttttctttaatgtgaaatttattaattatcctcacattctaaaggcattaatgattacatttttgtaattgccagggactgtttacattttaccaactgatttttgccattattttcttccttcattttcctttcttttttccttccttccttccttccttccctcctttcttcctttcttttctttctttcctttctttcttccttttttattttttcttagacaggatctcacttgttgcccaggccgcagtgcagtggtgcaatctcggctcactgcagcctccatctcctgggctcaagtgatcctcccacctcagcctcctgaagagctgggaccacaggcacaaaccaccacacccagctaatttattttttaaaatgtatgggtctggggtctccctatgttgcccaggctggtctgaaactcctgggctcaagccgtcctcctgtcttggcctcccaaagttctgggattacgggcatgagccacagtaccctgcttcactgtttcctgctctattggtcataatttcactcattatttcctcactttttccctcacgtttctccacttcttcacctcgacggctttgcatgtgtaattctctgttttggaattgcctctctccagcctctccctccatcttcaattggaatcttaattccatatgcacagaatagctccaagtggtagtggaggggagaaacttgtaacaaggggtcctgggtggaagaactggcacacggggtcagagatttcagggaaacttacttttcactgcaacaccttttgtacctttgcatcttgtaggaagcttacatgtaacctctatacaagcaaacacaggcaaaaacacacacattgtcaattcacatccttatttgtcaaggtatagcttgaatgtaatttttagctaaaaagttgtttatctttactcttaacattcatggaaagtaactacatacgtataacatacctataagttgtataacatatacatttttatagaaaaataaacatatttcttttataacttgctaacttcttgattgagaatctctgattattctttgagtcctgccaacatgtctagcatatttcttaatcaatgtaggcattcaaaaactgtttaattcatttagcaaatatttattgagcctctgttctgggaaagtatcttagtaatcaccggcagtagaatttacagtcacagtccttgcccttagacatcccagttaatgatgaagataaacacagagataaataattctaataggtacaatttagagacatgcaaagaaggggaatgataaacatcaagtgattatttatctccgcatttcccaaggactgagtcaagtagcatcttctcatgataattttggtgatcaccaggaaagctttttattagataacgatttattgcagaaaatacataaaaaactaatacttttgcagagattaattttgtgtgaggttaaagtagacatttaatttaaagaagttagtcactgaaagtaaaatattcagtaaataagagtttcgacagaacatagccactgcaacagtagtggagcagaggtgagcacaaccgaggctgcggcaggagaatggcgtgaacccgggaggcggagcttgcagtgagccgagatcgcgcccctgcactccagcctgggcaacagagccagactccatctcaaaacaaaaacaaaaacaaaaagaaaaccaacaactgaagcttggcacatgttaatctgtcccaaccaggcacacattgccttggtaatgataattataattaaatattagtatagcttccctgtgttgagggtttactctgtgtcaagcattatgttatggactttatatctcatttaacagtcacaatctcccaaggacgcttatattttcttgagacaacagaggctgagagaacgtaatgaaatggcacagataactaaaagtttattctttaattgccatgcaactacacccagtaggagccaaatattggaggaaaggatcgctaaagattttgaccttgtaaattttgactttgagtgagaaaagcaagtgccagatgaataaataaccctttttgagaggtgctatgaataagtattatgagcatgcagggcaggagaggattggggatggaagccaggtcagggaagggttccttgaggagatgatgctgaagtgggctcggacgaatgcatcagcattaactaggcgttaacaaaggaagctctaagtggaagtgcctgggagaacacacacagaggcccctgtggtggagccagagagcttcacggtgccacggaccgtggtggagccagagagcttcacggtgccacggaccgcggtggagccagagagcttcacggtcccacagactgtggtcccagcgggcctctgtttctgcagccttgcccaaagtaggttgtcaacattttgaattactgacaaattcaagggtaagaaacgttatctccggtagatttagtttgcattttccttattaagaacatcttttataagcttaagaacaatttacattcttctgtaaactacttcttacattctttgcctattttcctgtttgtttcctcattcatttgaaaaagcatctcatagattaagttagtttcttgtctatgatataagacatatatttgctttctaatttaacatttatttcatctttattattttaaatttttagttatgtgaaaaattttaattattattattattataattttttttttgagacagagttttgctcttgttgcccaggctggagtgaatggaacgatctcagctcacctcaacctccgcctcccaggttcaagcgattctcctgcctcagcctcccgagtagctgggactacaggcatgcaccaccacgcccagctaattttgtatttttagtagagacagggtttctccatgttggtcaggctggtgtctaactcctgacctcaggtgatctgcctgtctcggcttcccaaagtgctgggattacaggcgtgagccactgcgcccggccttattttaaaagtcaaatcaatctgtgatttttgttgtttttgagtttaatatactgaggaggctaatatattccaattttataaaagtattcaactgtgttttcttttagcacttttatggtatcagttttgaagtgtaagtatgtgaacattgggatttattttggtttaaagtgtgaggtagagatacaattaatttttttcttcaaatagctcctcttgttgcaacactatttgtagaataatccatctttctcaattgatttgaaatatcacctttatcaatactagatttccatatgtatttgagtcttttactggacttcattctgtttcattgatgagtctatatcttcatattctagtaatactgtgttttcaatgttattattattattttattcatttatttatttacttatttgtttatttattttgagacggagtctcgctctatctcccaggctggagtgcagtggcccagtctctgctcactgcaacctctgcctcccaggtttaagtgattctcctgcctcagcctcccaagtagctgggattacaggtaactgccaccacgcccagctaatttttgtatttttagtagagatggggtttcaccatattagccaggcttgtctcgaactcctgaccctgtgattcatctgccttgacctcccaaagtgctgggattacaagcgtgagccactgcacccagcctaattattattgttttattatcttgtagggctaattacttgcataaagtatttctcagatttatacttttgcctgttattcttattcacttatttttccataccttcttcagaatcagatttctagtttaaaaaattcctgttaaaattgttattgagcattagatggaagcagcatgggtaggagccgtggggctgtttccgggagggtattccaggcctaatggccagcatgtgtcagggcctcgactggcagtgcgtgttgtgtgtttgaagaacaggggagttggagttactgcagcagagagttcagtctgaggaggggagatgggagataatgccctagtgggggtggaggtgggacatgagggtccagatcacccttggggcccttgtaggccattataagactctgacttttagtctgaatgagatgaaaagtccctggcagatttacagcatagaaatatcatacaaaaatttggggcagggtgcagtggctcacacccataatcccagcactttgggaggctgaggcaggcagatcatttgagcccaggagttccagaccagctttgacaacatggcgaaaccccttctctgcaaaaaaatgcaaaaattagctgagcgtggtggtcctcgcctgtaatcccagctactcaggaggctgaggtgggagtcactttaacccaggaggcggaggttgtagagagttgagatcgcgccactgcactccagcttgggcaagacagcgagacccttatcaagaaataaaaataaaaaataaattttattttattttatttttctatctgttaaatatccaaccaattcatttctgggcatctatctgaaatattcaacatacgccaccctactcccgcccccaccccaacaagagaaagaaaaagcattgtagaaagattattacagcacagcttgttacagtgaaaaactgacagctaaaatgcatattaatagagaaatgattttaaaaatctgtgctgtgcccgtactatacaatactaacatgcagttaaatgcacagaataagtttgaaagcgcagaaaaataaatagcgctcttatgagaccgggcgcggtggctcacgcctgtcatcccagcactttgggaggctgaggcgggcggatgacctgaggtcaggggttcgagaccagcctggccaacatggagaaaccccatctctactaaaaatacaaaattagccgggcatggtggtgcatgcctgtaatcccagctactccggaggctgaggtaggagaatcgcttgagcgaggcagaggttgcggtaagccgagatcacgccactgcactccagtctgggcaacaagagcgaaaataaaaaaacaaacacaaacaaacaaacaaaaagaaatatagctatcacgttgacaacaaagtggtacataagggaggctgtggcttggctttggagctgctcaccggaatgtccgtggtgcagtgacggcgtccacgattcgggtcagagctctccaggacaggtggggtagagctggaacaagacgggcaggtgctggcgctcactgaggctactctggcaacacatgaggacgcattttatttttctccccacttttaatacgtttgaaaattccataaaagtaaaacaaaacaaaaataataaaaattcattaaagactgaaccataaaagtcagaaaatttttccacaacagccttggccattgctgtattgtgcattgaaggcggctcttagtgaagagacacatttgtaataaatgttttgatgtactagacaatcagggctctgaggattgaatgagatgatccgtgtaaactacttagcctggaattctcaggacatataaatctaaaagtttttatggaagttgattttattactcaaaatatattacagtaattttgtaaatctattttatctctctatctctatataatttgtcttctgtttaatagctacagaatgtttcttaatttatttagccattcccctattgaccttttctccttttataacaattttgtaataaatgtctcataatatgtatttgtgcacctgcccaattctttccatgaggtaagtcccagaactggatatggtaaacaccaatgcattttcatatatcttttttccaatttgccctgcaaagagattgtactcatatacacaccctccagttaatggtggcagtgtctgattcttcacacccttgtcaacaaggaactagacacatgcattattagtgaaggcaagtgcatatggactgtgtatttttgtctcttccaaggtgaaatacatttttatgtcctcaacttgttttgtattggattctttgtcttttctttattgatgtgttagaactctttatagtaagactattaatattttgtcacatatgttacagaacattttctctagtttgccatttgtctttaatttcatgtagttttaaatatttcagccttcattttaggctatctgggatttattgcatgcttagaaaagccttttatatttcagaattaaaaagctttttttggtaaactctttcacactgttggattttgtttgaacttctgtttttaagccatctggcatttatttttattttattttactttattttatttttttatgattttttaatttttttattgtactttaagttctagggtacatgtgcacaacgtgcaggtttgttacgtatgtatacatgtgccatgttggtgtgctgcacccattaactcgacatttacattaggtatatctcctaatgctatccctcccccctcccgccaccccatgacaggccccaatgtgtgatgttccccaccctgtgtccaagtgttctcattgttcaattccccacctatgagtgagaacatgtggtgtttggttttttatccttgcgatagtttgctgagaatgatggtttccagcttcatccatgtccctacaaaggacatgaactcacccttttttatggctgcatagtattccatagtgtatatgtgccacattttcttaatccagtctatcattgatggacatttgggttggttccaagtctttgctgttgtgaatagtgccacaataaacatatgtgtgcatgtgtctttatagcagcaagatttacaatcctttgggtatatacccagtaatgggatggctgggtcaaatggtatttccagttctagatccttaaggaatcgccacagtcttccacagtggttgaactagtttacagtcccacccacagttttactttattttatttagagacagggtcttgctctgttgccaagcctggagtgcagtagcacaatcatagctcacttcagccttgaccccctgggctcaagcaatcctcctgcctcagcctcccaagtacctgaggctacaggcacatgccactattcctggctaatttttaaatttttttgtagagacagggtcttgtccaggctggtctcaaactcctggtctcaagcaatccttctgcctcagcctcccaaagtgctggaattataggcatgagacactgggccaagcctggaatttgttactgcagttaggatatatgttttattcctaaatgtagcctactgtcccaacctgttaattgaagagtttattatctatatctggttgggattctccatatcattatttttcttttaggcacttttattggctattttcatacttactatttcgtgtactttagaaacagtttttgcattccaagacaattctggagagactatttttggactcacattggaaattaggtgagaattggcatttgtctttatacaagtgttccacttaggaaaattgtgcgtcctcccacttttaaagtcttttaagtaagtcttattttttatatatatgtatatattatacatatatataaaatatatatattatacatattttacatatgtatttttacacacacatatatatatatatacacaaatatatatatatatatatacacaaatatatatatatatatatatatatatatatatatatatatatatatatatatatttgagacagagtctcactgcgtcccccagggctggagtgcagtggcgcgatcttggctcactgcagtctctgcctcccaggttcaagcagattctcctgcctcggtctcccaagtagctgggattacaggtgcccaccaccacgcctggctaatttttgtatttttagtaaagacagggtttcactatgttggccagggtggtcttgaactcctgacctcgtgatccacccgttttggactcccaaagtgctaggattacaggcatgagccaccatgcctggctgaagtaagtcttatgattaacttccccataaatctttcacatttcttattaattcctaggtattttataatattgaaggttttaaaaaatttcagagatcatttttgccattctattttttaacttagttaccactaagacaacatctacaaaatgctgtagatctctgcgcacacacaaacacacacacatcatgcaacaaataagaaaatgccaatacatgaattatacgtgagatgttggatatattattttattggcacatgtcttagaactcattacacttctaggtacatatccatgagacaccaatgcatgcgaccatcaaaaacatgaacaataatatttacagaagtttcattaacaataactaaaatttagaagcaatctaaatgtccaccaataggagaacagatgagcaaatgggatacgatacagacagaagcaacaataataaaatccctactgatgtggatacacatgaaaaatctcatgaccctcatcttgagcaaaagaaacttcacatcaagaaatgcatactcttttattccatttatataaagttcaagaacaggcaaaactaatcttgtaataaaaatcagggccaggcatggtatctcacacctgtcatcccagcaatttgggagaccgaggcaggcagatctcaggagtttgagactagcctgggcaacatggcggaaccctgtctctaccaaaaatacaaaaaaaaaaaataagaaattagctgagcatggtggcacgcatgtgtagtcccagctacttgggaggctgaggtgggaggatcgcttcagcctgtgtgacaaagtgaaaaaagtcagaataatggctatctgttgagagattaggtactatctgggaagggtatcagatgaccttggagcctgttggacattttttgaatcttgatctaggtggtaacgtcactggtagataagcactgtatataaaagctcattgaatttacacttaagatttgttcacctgattcaatataaaatttacctaattttcggccagccgccccgtctgggaggtgaggggcgcctctgcccggccgcccctactgggaagtgaggagcccctctgcccggccaccaccccgtctgggaggtgtacccaacagctcattgagaatgggccaggatgacaatggcggctttgtggaatagaaaggcgggaaaggtgggggaaagattgagaaatcggatggttgccgtgtctgtgtagaaagaagtagacatgggagacttttcattttgttctgtactaagaaaaattcttctgccttgggatcctgttgatctgtcaccttacccccaaccctgtgctctctgaaacatgtgctgtgtccactcagggttaaatggattaagggcggtgccagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttatctgctgaccttccctccactactgtcccatgaccctgccaaatccccctctgtgagaaacacccaagaattatcaataaaaaaataaattaaaaaaaaaaaatttacctaattttataaaaagtaagcttcctaataggcttctgtatatctagtcatgaaataaaagttaaaataaggctgagcgtggtgactcatgcctgtaatcccagaactttgagaggccgaggtgggcggatcacctgaggtcaagagttcgagaccagtctggccaacatgatgaaatcccatctctactaaaaatacaaaaaattggccaagcatggtggtgggtgcctgtaatcccagctactcaggaggctaaggcaggagaaccgcttgaacccggaaggcggaggttgcagcgagctgagatcgcgccactgcactccagcctgggcaacaagagtgaacctccgtctcaaaaaaaaaaaaaaagttaaaataaaacaaaagcaaaagactctcaaaacaaatcaaagagcagccaaataagcaactaataaaaagaaagtcattgtctggcttgtgcccaaaatgtactcatcagtctaagactcagatcattctaagcaccaatactttgacctgctttctatggagacccctgactattcaacttagcacatccccagaggacctttcctctacacttggctcatcctctgtgctccgtatttctcttcctgacatttctatctgcccgtctcccaagccacaaattacagcatcccattttacactctataataactgaatatcgtctcatatcaatctcttagcccttttactaacactgtcttcaaatggggtacaaaaatagctttctaatagaatcctcccaacccaatttctggctccagcatattttgcaaaaggctgtcagtttgatttcctcgcacagtgcttctggaaaggatggcagtgttgtagacctgctgcatctgatatggtcactgctagccacaggtggctactgggtacttaaatgtgctcagctggctgaagaactgacgttttcatttcattttgttttaatcagtttgaatttagttaagcacatgtggctagtggctagtgtgttggtcggtacagttctagaaggaaagctctgagctgtgcccctctctccaggtggaattagattttatatattcactgactcaggcctgagcaggactggtatcagcctaacggcccctcttcatccaatacaaacataattttgcatatcagacttcaagctgcatttgttcttttaattctcctcaagtaattgtataggaacctttttttttttttttttttttttgagacagagtcttgctgtatcgcccaggctggagtacagtggtgtgacctcggctcactgcaacctctgcctcccggttcaagcaattctcctgcctcagcctcctgagtagctgggactataggcgcaggccactacgtccagctagttttttgtattttttagtaaagatggggtttcaccatattggccaggttggtctcaaactcctgacctcatgatccactcgcctcggcctcccaaagtgctgggattacaggtgaaagccaccacacccagccaggaactactttttaatgcaagcgtctttctcactgctgaccatggatcctggattatttttaagtggctgggcccggttctacagatatatcaaaaggctcccaatctctatgcattatgtccatttgaaaggcactatacttggccaggtgtggtggctcacgcctgtaatcccagcactttgggaagctgaggtgggcagatcaactgtggtcaggagtttgagaccagcctggccaacatggtgaaaccctgtctctattaaaaatacaaaaattagctgggtgtggtggtgcacgcctgtaatcccagctacttgggaggctgaggcaggagaatcgcttgaacctgggaggcagaggtggcagtgagccaagactgagccactgcattccagcctgggcgacagagcaaggctctgtctcgaaaaaaaaaaaaaagaaatgcactttctggccaggcgcggtagttcacacctgtaatcccagcactttgggaggccaaggcgggtggatcacgaggtcagaggttcgagaccagagtggccaacatggtgaaaccctgtctctattaaaaatacaaaaattagccaggtttggtggtgcacgcctgtaatcccagctactcgggaggcaggagaatcacttgaacctgggaggtggaggttgcagtgagccgagatcacaccattgcactccagcctgggcaacaggtgagattccgtctcacaaaaaacaaaaaacaaaaaacaaaaacaaaagaaatgcactttcctggaaacttcagcccaaaatagcaaaattaagtgtgattgaaaccaggttgtattgtctatcatatgtacagataagcaaaaattataaacaacataactggattcaataaaaacttgggtaattcatttatgggaaaccaatagcctgtagccatgtagctattagaatgattagatttgtactgacacagaaagatgtatcaaattataatatgaaatcagcaggatctaaaattctaaatatcccaattctactttatttttaatataaaaatatgtatacaatcatacagaaataaatagaaagaaaacacattaaaatgttagcagcactggtttatctccaggtggtagaatttgatgtagccaatccaaattttctctataactggtattaacactctttaaaaatgaaaacagatttcaatattaaaatattcagtatacttctaaagccagattttttttttttttgaggcggagtttcactcctgatgcctaggctggagtgcaatggcaccgtctcagctcactgaaacctccacctcgtggattcaagtgattttcttgcttcatcctcccaagtaactgggattacaggtgcccaccaccatacccagctaagtttttgtattttcagtagagatggagtttcatcatgttggccaggctggtctcgaactcctgagctcaggtgattcacccacctcagcctcccaaagtggtgggattacaggcatgagtcaccgtgcctggccagatattctttacattttgaattagtggccaggcatagtagcatttccctgtagtcccagctacttaggagtgaggtgaaggtgggaggatcacttgagcccaggagttctaggctgcagggagccgtgatttgtgccactgcactctagcctaggtgacagagcaaaaccctgtctctaaaataaattaaaataaaaattctgaattagtgactgttttctgtaaaattcggagctacaacaccaggcgaaccagaagccccacgtataaggttttaattatttaacaatggccattttcttttcttttctttttttttttttttttgagacagagtctcactctgtcgcccaggctggagtgcagtggtgggatctcggctcactgcaagctccgcctcctgggttcaagtgattctcctgcctcagcctcctgagtagctgtgattacaggcgtgtgccatcatgcccagctaatttttgtatttttagtaaagacggggtttcaccatattggttaggctgatcttgaactcctgaccttgtgatctgcccatcttgtcctcccaaagtgctgggattataggcatgagccatcacgcccagccaacactggccattttctaatagagattctgaaaaaggaaatatgtaagactctgtatatagactctgtacacagactctgtatataagtatcagtctctgttgggagtgccattctaaggaatgattaccaattctgaaattcagaaaaggatctatgtaaacataacaaccgaggccaggcacggtgcctcatgcctgtaatcccgcactttgggaggccaagcagggtggatcacttgaggtcaggagtttgagaccagcctggccaacatggtgaaaccccatctgtactaaaaatacaaaaattagccaggtgtggtggtagatgcctataattccagttacttaggaggctgaggcaggagaattgcttgagcctgggaggcagaggttgcaacgagctgagatcgtgccactgcactccagccttgtgacagggtaagaatctgcctcaaaaaaaaaaaaaaaaaaagaaaaagaaaagaaagaaagaaagaaaaaccaattgaaaagagaaaaaaactattcattaaaggaggttttttttttttttttttttaacaatctcacagtgtcacagtggggaggatttgtccaaacataacgcaaacttcaaaaactacagaagatttgactacttggcaaagaccacaagaaaaaccatcaaaacaagcagctgagagaaatctgcaactgacatcatagacaaaggattaacttccttaatctgtaaatactgtctgtaaaccaagaaaactagacaatgcaagtatacacaagttatcaatacaagctgggtgcagtggctcatgccttgtagtccctgcactttgagaggcagagatgggaggatcacttgagccaatgagtttgagaccagcttggggtgcatagtgagataccatctctacaaaaaaaaaaaaaaaaggaaaaaaaagacatataggctgggcacggtggctcactcctgtaattccagcacattgggaggccgaagtggacagatcacctgaggtccagggttcaagaccagcctggctaacatggcaaaccctcatctctactaaaaatacaaaaattggccaggtgtgttggcgggtgcctgtagtcccagctacccgggaggctgaggcagaagaatcacttgaactcaggaggtggaagttgcagtgagccgagatggtgccactgcactccagccttggagacagagtgagactccgtctcaaaaaaaaaaaaaagatatataaatacagaatagtagttatttcagggaggaagggagacaaaagcaatcagggagaagtccacagaaagtttctaaggtactagttaatatcctattctttgttgtataaactaggtgacgggtacagaggtgttttattattcttaagtctctttgtgtgaacatgtgtatgcgtgtatatacacatacatttacacacactaatatacatgcatatattctgtatttagagtaaaaaaaaaatcacatgcattaaagttttgattacaccacgggctggagtaaaggggaagagagacttgcaagtaaaaatgtatgtgagcatttctctggagaactatgacatctataaaaattccaatgcacataatttttgatccagtatttctacctccaggaaattcactccacatatataactgcacatgtattatatgaaattacattatacaaatctatttattgtaacatcatgtgttttagtgaaaatttgaaaacaaattattgacagggagcctaatatataaaacacactactgtgcttttgaatacacatgcagctgtagccacacacacacaaacacacacacacacacacacacacacacacacacacacaaagtctttagatagaatttcatgagatcggccggaggcggtggctcacgcctgtaatccccccgctttgggaggctgaggcaggcagatctcctgaggctgggatttcaagaccagcctggctaacaaggcgaaaccctgactctactaaaaatacaaaattagccgggcgtggtggcgcatgcctgtaattccagctacccaggaggctgaggcaggaaaattgcttgaacccaccagacggaggttgtgtgagccgagatcgcgccactgcactccaacctgggtgaaaatgagactttttctcaaaaaaaaaaataatttcataatatattatttggggaaaaatatatagaaaagtatgacataattggtttattaaaaagaaatatatacattcagactctctgtagagggatatctgatagagaaatagatatggaaagtgtattatctattcaagaaataagttttaaaaacaagtttccacatagacttgtaatttaatgatcataccaaattaactgcatcttgtgattatacgtagaatgatttcagtcacacaaattaaaaccttaacagaggaaagggaattgcaaaaaatattctctatcaaattaattatacttgtattggggtaatgaaactcagaggggcagttcatatttctccatttttataatgaaagttcacagatttgtaatacacttagtgtgtttcataagctataatagagagttgtcctgacaatatttgaagaaaaatgacattagttccttcctcctgtgtaggaaaaacattcagttgctcttccaggtcattcaacaaagaccttttctttcttttttctttttttttgagaccgaattttgctcttgttgcccaggctggagtgcaatggcgcgatctctgctcactgcaacctccgcctccctagtgcaagcgattctcctgcctcagcctcctcagtagctgggattacaggcatgtgacaccatgcccggctaattttgtatttttagtagagtcggggttttgctatgttagccaggctagtcttgaactcaacctcaggtgatctgcccacctcggtctcccaaagtgctgagattataggtgtgagctaccatgcctggccatgaccttttctttttttaacctcagctttttattttgaaaaaagccaaatctcagtaaagttgaaaaagaattctaatgaccatctctacatatgtccatgttttgcaaaattgggcttatcactttctcgctgttctcagacacacatacacattcaggctcttgttttgatttgacaaaaatcagataactctgtgtagtcctcagtcctcacagtattctcagatggcagcgttacagagcagccagggttcagttgtgaaccaaaagaactgttctaactcctcccccaccctcaggaggaaagcaattcactggagacctgtatatccattctagtctaccagagagggcctgggacagaattgtatggttacagtaagctgaggaggtatcttttcgttgattcaccaatatgttctgaattgggactctggtatctaggaacacatattccaatggtagaagatcattcttttatatgatgtgaccgagtacaggagatgtatcttatggctaggaattttctgtgtaaacccatgcatcagagaaaaagatgaaatcagatatatacctttcactgagggattatcaatccatctctaggcctcgaattccttactattatttagaacatcgtcaacctgctgttgaaaatgaaataaacatcttctgcaaagtttatttattttttattttattattattttttttttgagacagagtctcgctctgtcaccaggctggagtgcaatggcgcgatctcggctcactgcagcctccgcctcccgggttcaagcaactctcctgcctcagcctcccgagtagctgggattacctgctcaatgctgttgtagcagagggggaacatccccagggagctgcagactggtgggaagagcaggcaggcacactcgacacagaagcccagacaaacccttggtatcatgagtggctcaaggtcagagataaccaggcccgtacatgctgtctttccacgtcagacttgtattgatgctatttaaatcataaaagccaccagctccatggagttcccagggaggcagttctccttagtacttcctggtcactcggtggtcagagctgcgggcacacaggctcaagccactccacatgtcagtcgatattgcaaaccatacatcatagtatacctaattaatatatcaatgttggccgggcgcagtgtctcacgcctgtaatcccagcactttgggaggccgaaacgggcggatcacgaggtcaggagatcgaggccatcctggctaacaccgtgaaaccccgtctctactaaaaatacaaaaaattagcagggcgtggtggtgggcacctgtagtctcggctactcgggagactgaggcaagagaatggcgtgaacccgggaggcgaagcttgcagtgagccaagatcgtgccactgcactccagcctgggtgacagagtgagactccgtctcaaaaaaacaaaacaaaacaaaattccacaacaaacaaagtagcatttaacaccaagagaaaggggataggaaagagcgttaatgaaccagtcccaaagaatctcctggtctggcccaggtggcccatcagtcttgcaaggaagagtctttgatgtgggcagagcctttggtggtagattctgggtaccaattaccagtgacagcaagatggggtctgttaagatggctgtttcgagctggtgaagtcctgctgtttgatagccccagagtcctctggtgaggactgattgtggaggagtgtgcctggtgatgcccttatctggctggatgcactctttgttgatcaggtgaaacatttggtccctgttggcaaagtgctttgtgaaatagaagatggagtcttttgttaagatggaattacttatgtcaatggtgttgtatacacttgacaaggccagatgacattcccaatttgtttttataaatagtagagaaacttcgctggaggaggagggtcacacatagcaagagcagagggcttggtgcatcttccattccagatgctactgagaatgtgcaaatcagtgtcacgacggatcccaaaggtttcatttcaaactgagccatggacattttatagtgcctaacttactattcaaaaatactcacacacacagttttgtttgtaacatttccactcatagaaattccacaggctttggtataggaagtgtcagcggaacacacctttaccctggggtaaaaagcatagtcttccctcacagttaatgctctcaatcttctgattctgggtgtctggtagatcttgtgtccccagaggataaatcaatgtattttaaaagtattaataatcagtttacagccatgcattgttttataatggggacatatgctgagaaatgcatcattaggcaattgtgcattgtgtgaacatcatagagtgtacttacacaaacagatggtgtagcctcctaacacacctagattatttggtacagcctattgctcctaggtacaaacctgtccagcatatgactgtactgaaaatgtaggctgaaaattttattttacatatgtaggcagctgtaacacaatgtaaatatttgtgtttctaaacctggaagaagcacagtaaaaatacagtattataatctcatgagaccaccgtcgtatatgtccgcagttgactggagccgtcattaggcagcatatgactgtagtccattaattttaagtattcaaaacaatttccatccattcacaattcaaacaattgctcacaattttgtacagctattaatccaggaaaccattagcctaggaagccaaatgtttagttagacacaagtttagggaaacatttgagtattgctggaggacaaaagcactcactaaataaccagtggctgattaccggcctctggaccatggccagttggaatagctccatgtcattctttctttctttctcttttttttaagttttgttattacaagaataattttctatattagactgttttcactttattaactttatcataagtatgccaacttctgcaaacttggagcaattgcaataatctattgatttattttcaccaaattttcactttatttgcccagaattcaagcttgtctgttaatttcccaggtcttcaatgacttgtctcttattggctagcatctccttattttccttgttcaattagtaaggttttccttattatattacttttttggggggcctttctctgttagtatatagattttctcctgagagctaaaaatcttcataacaccttagtcaatatacctttgaaaaaaccccttatattggctggttgcggtggctcacacctataatctcagcactttgggcggccgagatgggcagttcacctgaggtcaggagtttgagaccagcctggccaacaaggtgaaaccccgtctctactaaaaatacaaaaattagctggatgtggtggcaggcacctgtaatcccagctactcgggaggctgaggcaggagaactgcttgaacctgggaggcagaggttgcagtgagccaagatcacaccactgcactccagcctgggtgacaagagcgagcaaaactctgtctcaaaaaaaaaaaaaatcccttatattataattgtcattgaaataatctgacattcctagtaacctctgacactaaaattttcttcgcttttaatagaaacacaattcatcatttatccattatccattgttttgaatttaatttaattcaccaaaataatacatatattttagtaccaaagatcaaaaagtgctcgaaggtttataattaaaaaaaaaaaatcctctcttctcccccattccggctatctagatacagtcatgtccaactctcagttctttcttatagaatatgcatgatattccctcatctttcatttaagttaaggaatatcatgtatattctataagaaacagaatgaggcattctatttctatttccttagaaatagaaattggaaatagaaatctaaattggaaagattggccagttgcagtgactcacacctgtaatcccagcactttgggaagccaaggtggaggactgcttgagtccagaagtttgagaccagcctgggcaacagagcaagacaccatctctacaaaaaggtaaacaattagctgggcgtggcggtgcaagcctgtagtccacgctacttgggaagctgtggtagaagaatcccttgagtccaggaattcaaggctgcagaatgggcagaatgactgtgccactgcactccagcctgggtaacagggtgagaccctgtcgaaagaaaagaaaaaaaaaaagaaagaaaagagaaagaaagaaggattatcttttaccttttacttgctacagataacttccctgccacctcattccaatatagtcaaagcaacattttattaagccatcaacacctttgttttttatggagttaacagttctctctatatatatttagtttttttttcctagtgtaccaaacacagattcatcccttatactgtcctatggagctataaagcttttcttgacatagccaaacggctaggaaataatcaattctatttattttttccttcaaggtacccttctgtgaatcttccaccttttgttctaattagggccaactgatgctgtcgtcctgggaattttcccattcaccatcactttgctaattccttcacctctttgctttcctgtactcaggagacatccttggcaaaacttaatggttgctgggtcatgatgaaatattataggcatactagagaagctgcttgattaagtagccatcagttcgacaaaacaaaaaacaaaaacaaacaaaagctaatttgtagagttttttagataaaattgtcctgtgaaacttcaaaatcaagcttcctcatctgttcattaatgctgagatctttgttttgttccttcaggtaaggcaaatacccgacatacagggattgtttaataaacactttctgggtttcttgttcattcatttaacgcctttgccatcatggggtttccattccagacaggaagttaaatacataatgttaaatcaggtcatgattaatgctacaaagaaaataatgtagggtaagaggtaagagaatgagtggggattggagagaatgttcagggagggcgctctttgtggaggacagatcaagaaaggcctgtgtggtggcagccagctggagcctagcactgcggtccagatgaaagatcacagcctcaactagtgtggtcaaagggaggatggcgagtgtttgctgagggacatatatggatggtagagctgacagtctttgctgatagattgaacacagaatggcagcaaaataaaggatggctccaaagtctgtgctgtcagaatgagcccctgaagcttttagaatgcacggggtgcctgcgagggtggcacatttgggaatctagttggctctgactgaagctatggagaaacgtggcaaagaagtgaggaagaaaggatgctgaggcgggcttaggaggccctttattaaagcctggctgtgtttataatcgcaggcaagaagggaagctaatgtagtaattcagaaggatgaagagaactaaattgaggaaataggttttcatttttatcaagcaattcatcattgactacgactccacattaattcagctctacccataaagccaattaaattaccccaagaaatcaataaaaacacaggcagggtggggaagacattcttgatgaacattcacacgtcttttttataagtatttgggaagagatttcgggctaaaggggtgaagcatgttccctacatcactgtagacctaggaaacgaattctatttctccttttccctccatacaagcaatctaactccacaatgaagatagggacagcacattctcaggggaaattgacatggacagttcctggactatagctcactcctatctgaagctctgaatgttaacatccaatgtaggaacagcttttagcttcagaaattccacaggccaaagaacaatgataaccattaagaagattgcaacaggagcttttacctccaccctctttttcaaatacaaagttctcttgtatctctgagtatctggaatgaccacatagttctcctatctgaaataagacagacacacaaaacagggtaatctagctgaccagagagtgctgggataaacacaaagctcactaaaacggttagggaggggaaaagcttattcacatagttttaacttttttttttttttttgagacagtctcgttctgtcgcccagggtggagtgcagtggcgtgatcttggctcactgcaacctccacctcttgggttcaagcgattctcctgcctcagcctccagagtagctgggactacaggcgcccgccaccacgcccggataattttttgtatttttagtagagacggggtttcaccatgttagccaggatggtctcaatctcctgacctcgtgatctgcctgtctcggcctcccaaagtgttgggattacagacgtgagccactgcgcccggccaatgtttgtatttttagtagagacggggtttcaccatattggtcaggctggtcttgaactccggacctcgtgatccacctgcctcggcctcccaaaatgctgggattacaggcatgagccactgcacccagcctggttttaacctgttttttaattaaaaattttattttacataaatacactttttgaaaataattttaagtttccatcaacggcttcctttgagtaatgtgaacctcacttccacatctttgccaggcctcgacttccccaactctcccctccagtgagcctgttatctgtctgcaaatacttttaacgagatacaatttgtgtggttggaaagaataaacagcccaggtttcaagagtctgaatatcactctctggagattttgaatgtattggctctatttctgactcagttaaaaaaaaaaagtactgccacttagggtagatgaggtcatagaaagcattctgaaccttccctggcaggtagcaaatgtacgacaaactgaaattgctattttgaaaggagaagcaatatttacatttacatcctttctatttatcattctaccacatccatctatcattacagagaattccttcttctcatgtgaggttaaatttccaatctcatacttgattttttccaggtcaaaagtctcattctcttatatatgttccaatttgtcgaggcataactgaaatgcaaatttacccatgttttgccgttacccacctacgtgttttttaacttccatgtaccattgataatatttatcacattccagtcagaaaatccgaaaaatcaaagcttcaaattccttccttattccctgtgaattcttatctcctctctatcctgtaattccttttcctgctttgtgcaagatcaaaaaattaactgcagtgaggtcacttacctctctccttctttcagccctacacagactatttcaagctgactgccctgcctttccattgaagacagaaggagctggtctagattcctatgagctgtgagatttcctgagcctctcccgctaatccttaacccagaaatgtattcgtcatttggctataaaaaaactcacagcttgacatccctgcacatgtaagagcactttttccaagttataactacagaacaaaactagatattctactttattgatacatttgttgtccaaggtacatttaccatatacaaatacagagacatcttttcagtgtagtgaggtaatcccaggcgttccatagcactggaggccccactggccaaaggcttcctaggtctacttagctcaaatatccaactcttacactttcttttttttttttttttgagacagggttttgctctgtcacctaggctggagtgcagtgacttgctcttggctcactgcagcgtcgatctcccaggttcaagtgatcctcccaccgcagcctcctgagtatctgggactacaggtgtgtgccaccatgccaggctaatttctgtattttttgtagagacaagatctcgccttgttgcccaggctggtctggaactcctggactcaggtgatcctcctgccttggcctcccaaaatgctgagattacagatgtgagtcaccatgcctggccacttaccgcttttatttatttattttttttttgagatggagtcttgctctgtagcccaggctggagtacaatagcgtgatcttagctcactgcaacctctgccttccgggttcaagcgattctcctgcctcagcctcccgagtagctgggactacaggcgtgaaccatgatgcccagttaatttttgtattttttaaatagagacggggtttcaccatattggtcaggctggtcttaaattcctgaccttgtgatctgcctgccttgacctcccaaagtgctgggattacaggcatgagccactgcgcccagcccacttatcacttcttaaagctacttccaattatactttgcccaattaacaatcttcctaatacagctgtttcattataactaatccctagcaccatcaacacatttttacatttaaacagtaaaccgtacactacaccagagccactgaacaaaccgcctgttgttttctatttcttgcttctgccaactttgctgtttgtcttggttggatattgtaatcaactaaggagctttgaaaaaaaatgatgcctagttttcaaccccaaagattctgatataattcttgtggagatatggtttagatattaggatttataaaaacttctcaggtcagccgggtgcggtggctcacacctgtaatcccagcactttgggaggccgaggcgggcggatcacgaggtcaggagttcgagaccaacctggccaagatggtgaaaccctgtctctactaaaaatagaggaaattagccaggcttggtggcaggcgcctgtagtcccaactactcgggaggctgaggcaggagaatggcgtaaacccgggaggcggagcttgcagtgagccgagatcgtgccactgcacgccagcctggggacagagcgagactccatctcaaaaaaaaaaaagaaaagaaaaaaaagaaacacgtgggccgggcgtggtggctgacgcctgcaatccaagcattatgggaggctgaggtgggcggatcacgaggtcaggagtttgagaccagcctggccactatggtgaaaccgcgtctctactaaaaaatacaaaaaactagccaggcgtggtggcgggcgccagtagtcccagcaactcgggaggctgaggcaggagaatcgcttaaacccaggaggcggaggttgcagtgagccgagattgcgccattgcactccagcctggcgacagaacaagactctgtctcaaaaaaaaacttaggggtagagcaatgtctctcaacattttcgttacattagatacaaaactggttaaaaccccacaaggctataaaatgaaaacctttgagatgatctttttctaccagaccgtctacagattttttggacttttttccttaatcacttcctccctcatgaaattttactaccacatacatactgcatatgtttatggactgggctcttttggagggccctagccacagtaatatataagacttttttcacctctcatgaaccgatttttaccaattgaactcatgggttagaagtacaatcatgtgtgtgtctccccagttcctgagaaatgcatccttaggcgatttgtccttgtgcaaatgtcagtgtacttacacacacctgaatggcactgcctgctgcacccctaggccatatggtatagtgtagcctgttgtccccctgggctatatggtgtagcctgttgcccccctaggctatatggtgtagcctgttgcccccctaggctatatggtgtagcctgttgcccgcctaggctatatggtgtagcctgttgcccgcctaggctatatggtgtagcctgttgcccccctaggctatatggtgtagcctgttgccccctaggctatatggtgtagcctgttgcccccctaggctgtgtggtgtagcctgttgcccccctaggctatgtggtgtagcctgttgcccgcctaggctatatggtgtagcctgttgccccctaggctatatggtgtagcctgttgccccctaggctatatggtgtagcctgttgccctctctaggctacaaacctgtacagcaggttactggactgcatactgtaacacaatggttttgtgtatctaaacatagaaaaggtacagtaaaaatatagtattgtaatcttgtgggaccaccatcatatatatgatctatcattgaccaaaacactattatgcaacacttaactgtatacatttaggggtcactgctgaggagttgatagttttggctgtggatatgaggttcacttagaagtgaatgagaagtgagatcctaggaaggaacatgaagtatttactacatatttaaaaggaaagatgcatttggcacaatggtaggaaaatgaggacagtgcacatcctataggtcaaggaagaatatattaaggataaagagattaatagcattgactacttctgagagcttgagtaatatgaaatggaagtggccgggtgtggtggcttacacctataatcccagcacttctggaggctgaggcagatggatcacctgaggtcgggagtttgagactagcctgaccaacatggagaaaccccatctctactaaaaatacaaaattagctgagcatggtggcacatgcctgtaatcccagcttcctgggaggctgaggcaggagaatcacttgcatccgagaggcagagattgtggtgagccgagattgcaccattgcactccagcctgggaaacaagaacgaaactccacctcaaaaaaaaataaatacataaaataaaatcagttggatttagcaatatggaagcgattaagacctgtaggcagaaagagacagaaagcaaattggactgaacacaggaatggatagcataaaccaacacacacaccagagtgcatttgggaggccgaggcgggcggatcacgaggtcaggagttcgagaccagcctggcctatatggtgaaaccccatctgtactaaaaatacaaaaactagccgggcgtggaggcacatggctgtaaacctagctactcaggaggctgaggcagaattgcttgaacccaggagaaggaggttgcagtgagccgagatcacgccactgcaccccagcctgggtgacagagcgagactccgtctcaaaaaaaaaaaaaaaaaaaaaaaaaagggagatatagtcttttttttttttttttggagacaacatctcgctctgtcgcccaggctggagtgcaatggtgcaatcatagctcactgtagcctcgaacttctgggatcaagtgatcctcccacctcactcttccctgtagctgggaccacaggtgcaagccaccatgcccagctaatttatcttttgtagagacaatgtctccctgtgttgcccaggctggtcgcaaagccttggcctcaaggtgtcatactgcctgggcctgctgaagtgttcatattacagaaggaaccaccacgtctggcctacattagctttttaaaagttaattttagaaggtcctgattgaggaatagtttcaatattgaaaagagaaaacgaatcacctatagcaggggtaggcaaactgtggcccctgtttttataaagttttattggaagagtagagccacatgcattaatgtaagcactgtcctggctgtgtatgcactagagcagcagagttagtttcaagagggacagtacgaccaataaagtctaagatattaattacctagttttttacagaaaaagtttgccaagccctgatctccaggtgaggatttcctaaaagccctcaggaatttggaggaaatacaaggtaggaaaaaattggtttattgcaagacagaagaaaggagaaagaataggtgaaggtgaatttgcaatttgttgctcaaaagatgagaaatgttgactgctgggctccttgaaagattgatcatccgaaaatcctgttgatcgaacaaagctttagagctttgacagagtcaggctctctgtcataagcacacaacctgacagtcttatcagtgtgtcagatggagaaagaggggaaagacacagggtctgggttggaaggttcaaagggggtcttgcaggatgtagaactagttggaattggagtttttggacattatgaatgcattttttaaaaatatggatgaaaggctgggcgaagtggctcatgcctgtaatcccagcactttgggaggccaaggtgggtggatcatgaggtcaggagatggagactatcctggctaacatggtgaaaccccatctctattgaaaatacaaaaaattagctgggcacggtggcacatgcctgtaatcccagctactcaggaggcggaggcaggagaatcgcttgaacccaggaggcggaggttgcagtgagctgagatcgcgccactgcactccagcctgggcgacagagtgagactccatctgaaaagaaaaaaaacagatgaaaatgtatagaattatgaccaaaatatttaactaataacttagttattattatgatattcacaaggtaatttcaatatattaattttctctgtcttaaattcaatattcgaagataattagctgttaacaaataacctgcagcctgacgaatatggtgaaatctcatctctataagaatacaaaaattagccagctgtgttggtgggcacctgtaatcccagctacttgggaggctgaggcaggagaatcctttgaactctggagttggaggttgcagtgagccaagatcatgccattgcactccagtctgggcaacagaaaaataaataagtaagtaaataaataaatagatagataaaacttggaaagccctcactacatgggtacattaggaattcctgcactttggagaaagaatgctgataatggtttaacaacgttctctgatttttcagtttgctaccctcgttttttgctattattgttggtctaggtcagggtttgtcagcctcagcactactatgttttgagctgaatgattctttgtgcgtcaggctgcgctgtccatcgcaggatatactgcagcatcactggcctctattcaccagattccggtggcacggctcttctggtgacaactaaaaaattgctccagacatggtctagcttattataaacaattttatttttatgttgtgggttgtatagcaatgtttgatccaaagtatttatcttagcttgaaatttgcagtagctagacatggagatgtctattactgggttttgaacattaattatacatttattgctaaatcatctcacatttccctttatgagtcatcatcatattttcttaaaaaattaggtaagggtttgagagccattgctctgaattcttttttttatttttatttttttgagacagaatcttgctctgttgccaggctggggtgcagtgcagtggtgcaatctcagctcactgcaacctctacctctactgaatcgcttgggttcaagcgattcccctgcctcagcctctcaagtagctgggactacaggggtgcaccacaacctctggctaacattttgtatcttagtagagacagggtttcaccatgttggccacgatggtctcgatctccggacctcgtgatctgccggcctcagcctcccatagtgctgggattacaggcgtgaggcatcgcgctcggtctgctctgaattcttcatcccagtgtttcaaataattgtctcacttccagctcacttatctgacctgaccctgacttttccaatagagccatttcccccaattctccatgtgattcagcaacaagatgtattgtgacttttccaagtgtatatctttaccagaatatacttattcacatcttttttttttttttttttgagacagagtctcactctgttgcctaggctggagtgcagtggtgtgatctcagctcactgcaagctccgcctcttgggttcacgccattctcctgccttagcctcccaagtagctgggactacaggcgcccgccaccatgcccggctaagtttttgtatttttattagagacggggtttcaccatgttagccaggatggtctcaacctcctgacctcatgatccgcatgcctcggcctcccaaaatgcagggattacaggattgagccaccgcgcccggccttattcacatcttttaaaagcacattttgagaattcgaaatggtcaaaaatgtctccccaaaagataggtaagcaagatcctacatcttccttgactcccatgagtcaacagaggcaattttctgacatttgcctttcgttccttcctcctctgcccatcctaaagaacttggcctccatgagccagagcccacctacagagggctgtgtacatgatatgctgcttctattttctgtgggaactgacttgcattttgagaacatttgagtaaaactggaccaccgttccacctagtcatgctcattacaactgatccctgtgcgacaggagtcaaggcggagcttgctttttgatctgatgaccgtctcaatttaattccttctccttgtcactagatatgtaacagcaatgtcactttagaaaaaacaaatcagctctctgagcatcagtttccacatgagtaaaaagattaatgcacactcataggttgttaaaaacattaaaggagataaagcatgatagaacttaaacataaaagtccctatgtagatacttattttctcagcattatacaaccatccctgagcaaggatgtaagagaaggcatttgcctgtagaccaccaaacagagaaagaagagggtgaacaccaggcatcatcggtattacttacctgattcaaaccattacctgtcgggcttcttctaataaatcaaattgttcctatcagaaagagaggtaggccgggtgtggtggctcacacctgtaattccagcactttgggaggctgaggctggtggatctcttgaggtcaggagctcgagaccatcctggccaacatggtgaaaccccgcctctactaaaaatacaaaaattagctgggcgtggtggtgggcacctgtaatcctagctactcgggaggctgaggcaggagaactgcttgaacccggggaggttgtgatgagccaagatcgagccactgtactccagcctgggcgacaagagcgaaatttcgtctcaaaaaaaagaaaaagaaaagaaaatttaaaaatattcacattttccacaactccttcttatccacataaaatatctatataaattattattctctatttggaataaaacactttaggaagtcctgatactcactgtcagtaatggacacctgttccgcatggtggcatgctcatatctaaagtcccgctttcattcctgattatacctgattctgcaaatgttttcagaaatacatcaagttcctaacctagttctaaggaccccagactgtatttcttctctaattccccaagcttacgatgcatatgcattttttctcattagcataggatctccccgttattatcattcatgattcaggttaagtgcaacctcttccactacacacaggtgttgacagttacacaaatgcaaaggctctggatattaaatcaggctcctactcctggaacgctttttattgggttagtttacacaaattctttcaaagtcttgttctccaactttctggtgtctcgtggtcttggattttacacacagaagattaagggctaacagtagcatcacaagaaggaccatgttgtaagatggtgagggagtctggacttgtgtctccatttgggatacagagggaaaacacaggcctgagagctccttggaaggcgcaatgggagaaattgtaaatgagggacatctcggtcacattgtagaatgatatctgcccgtgttcgcagtcaaggaaaacgccaactgtgtccaacttcttttccaggaagagccttttcagaggggggaagacccagagagtccactcggtccccatcaccgaccccgtgagcaagactttctctccggaagctctggccgtgctgcccttcgcgtctgcagagccgtggtatatgcccacttgccacctggttgccttttccacgtccacctcccagtagtgcctccctgaggtgaagctctccgcagccagcaccatggcactgaaatccaatctttctgggttgccagccccatcctgctgcccatgtctcaatctcatagttctcaggtcctcagatagtgccaggcagggatgagctgtttcaggatccaatgttaaatgtcctatcaggagagaaaaccctcgttaacctaggagttcaccaatgccaatgccagagacatgatttctaacacacctgggcttcccactgagtgggcacaagtcccaggcccagatacgggagaggcaatttgggagggtccaggaaaaggaactgctgaacttcaatatggacctcatggaggaaaaagtccataagatatggaaagggacacagtctacctgagcgggaagaataaaacaaagatgaatgagctaaggaaggtttagaaacaccttcatccaacgtggcgcggtggctcacgaggtcaggagttcaagaccagcctggtcaagatggtgaaaccccatctctactaaaaaaatacaaaaagtagccgagtgtggtggcaggcgcctgtaatcccagctactcatgaggctgaggcagaaaattgcttgaacccaggaggcggagattgcagtgagccgagatcacaccactgcactccagcctgggcgacagagcaagactccatctcaaaacaaacaaacaaacaaacaaacaaacaaaaaacagcttcaccccagagacggtcaaactgtcctggtgccaagttccatccagatatcacttggggcccaaccctggtcttctagatctccaagcctggagcggccacaggagtcggccagcagcaactcattcgtggccctcccgatgccgtactctacacatcttaaatatccccacagggtgacatagaggcctggaaattgctgacaacaggccctggacatcaggcattacatcagataatttatcagcggaggatggaacacctgtgtggaccctccagaaactcacgctgagaacacgcaggctcaatgaattcctcacacctgcatgaatacgtcttcttcctatctctgactgttcctctcatctctttctgcccagcctctaactattgtgatctttcagggcttggtcctgggacttcttctttcaagtagtatattctccttcactgcccccaggtaactgtgcatagcttcagttttaaacatcttctctgtgtttgtgactcgctccataaacagctaaataccagttggaaaaaacacaggaatttcaaacataacacacccaaaatggaacttcaacgccagccctctgcagtctctacttctcagttcacagctccctcattgcttcagttgtctaagccataaacctggaaggcctttatttcctactttctgtaatgtggaatccagcttaatttctattatttgactgaagtaaatttaatgaacttaaatctctgaatttgaagcccaattcacattattagggtggtctcaacagctacacgtcttgaatttttaaaaaattgtctgagactctcagtatttccaggagactggcagaaacaaatgcaaattatctctggaaaaacgcacagctgtggctgggcacggtggctcacgcttgtaatcccagcattttaggaggccgaggaggacggatcacttgaggccaggactttgagaccagcctggcgaaaccccatctctactaaaattacaaaaatcagccaggcctggtggcggcctgtaatcccagctactcaggagggtgaggcaggagcatcgcttgcatctgggaggcagaggttgcagtgagccgagatcatgccactgccctccagcctgagcaacagagcgaggctcatctcaaaaacaaaaacaaaaaaggttgaagaaacaacaggagtatctcaagagaaaaagaacttgataaattcaacattgattcataaaaattcttagtaaaccagaaataaagggggacatcctcaatttgatgaaaggcagccattaaaaaaaactatagctagggccaggtgcggtggctcacgcctttaatcccagcactttgggaacctgaggcaggcagatcacgaggttgggagttcgagaccagcctgaccaacagagtgaaaccccgtatctactaaaaatacaaaaattagctgagtgtggtggcactcagctactcgggaggttgaggcaggagaatcgtttgaatctgggaggaggaggttgcggtgagctgaggcttcgccattgcactccagcctgggtgacagagccagacagcatctcaaaaaacaaaaacaaaaacaaaaacaaaaacaaaaacaaaaaacacaaaacaacaacaaaaagcgctatagctgtatcagaatttagagtgaaaagacttaatgttttctttcttcctaagatcgagaataagcaagtgtccactctcaccacttctgttcaacacactgcaggtctgagccagtataataaggcaagaaaaattcagaaaaggcttacagactggaaaggcagaaataaagctatctatactcatatactgcatgactttgtagaaaatcctgaaggatctatttatagaaatccactgtctaatgagtgagttttgcatagttatagggtacaaatgtcaatatatataaaacaattccatttctatatacttgcaatgaactagaaatgaatgaaatgtcaattagaaattgatattttaaaataccgtttacagtggctgtaaaaaacataaaatacttagggatacatctccaaatacatataacattttatgctgaaagtgacaaaacactgatgagagaaatcgaagacctaaataaatggagatattttgtattcctggactgaaagcaccaaatattgtcaagatgtcaattctccccaaactgatcaacggattcaatgtaatatgaataaaaatcccagcggtccattttgaagaagccaacaagctgatttcaaaatttatgtggaaaagcaaacaacctacagtagccaaaactattctgaaaaagaataaatttggagaatgcacagtacctgctttcaagacttcctacagagttatcaatcaagccagtgtgctattggcaaagggaaagagtcaaccatcaatagacctattagagtcacaaatagacgtgatcgcatataccagttgattttcaacaaaggggccaagtaaattgaatggacaaaggtagtgtttttaacaaatgaaactggaacaaatggatacatgtgagtcaaaaaataaaaatagaaggtggggggaggagagggtttgcaccattctgtgaactgtatacagatattaactctcagtggttcataggccacaatgtaaaaccgaaaaccataaaacttttggaaggaaatctttgttggctttggcaaaatttcttaaataagacacaaaaagcagaagtcataaaagaaaaaacttgataaattgaacttcatcaaaatgcaaaacctctacacttcaaaagacagtattaggaaaatgagaatacaaaccatgctgggaggaaatatttgcaaaatttatctgataaatgaatgctaaacagaacatataaagaaattataaaactcaagagacatacaacccaatttagaaaaggggtttgtacatgtatttcaccaaagttgagatagagggaaaacaaacacatgaaaatatgctcagcatcattagtcattctggaaatgcaaattaaaatgacataccactacccatctatcgggtcggatgtagtaaaacaaactgacaataccaaaccctggtgagaatacagagtaactgaatctttcgcacgttattggtgggaaggcaaaatggcacaggcaatttggaaaacaagtttggcaatcccacccttagacagtcaatcaagaactatgaagctgtgcccacacaaaaatctgctgctaatatttacagcacagagctggaaacaacccatgtccgtagaattgcaaaaggataagtaaattatggtatatttatacaatggaatattatcaacaataaaaaggaacaaactactgatacacgaagcagcctggacgttctatatgtcaactgcagtatgctgtcagcctcgaaaggccacacactgtaggattccatcgataggacattctgggaaaggcaaagctataaggacaggagatataaaccctttgttatacatgctgaatttcttccccagaagttttaaatttttaagcagtggaatctgcctgcaatcatgtttcatggctggggaactggtaaagaatctgcagccaggcgtggtggctcacgcctgtaatcccagcactttgggagcctgaggcgcgtggatcacctgagatcaggagttcaagaccagcctgaccaacatggtaagacctcgtctctaccataaatacaaaaaattagccaggcgtggtggctcacgcctataatcccagcactttgggagcccaaggcgcgtggatcacctgagatcaggagttcaagaccatcctgaccaacatggtaagacctcatctctactatacaaaaaattagccaggtgtggtggtgcatgcctgtaatcccagctacttgggaggccgaggcaggagaatcacttgaacccaggagggggaggttgcagtgagccaagatcgcaccactgcactccagcctgggcaaagtgaaactctgtctcaaaaaaaaaaaaaaaaaaaaaaaaaaaaaagattttgcatgggaagagctttcatatgagatcatacagttatttttttgatccttatctaatatgtataacatattaagctctccagtctcctaaaatttttatttatttattttaagacagagtctcattctgttgcccaggctggggtgcagtggtgtgatctcagctcactgcaatctccacctcctgggttcaagcaattctcccacctcagccactcaagtagcagggactacaggcacacgccaccacaactggctaattttcgtattttttgtagagatgggatttcaccatgttggttaggctggtctcgaactcctggcctcaagcaaaccgcccgccttggcctcccaaagtgctgggattacaggagtgacccactgtgctggcctaaaattgttaaactactggaatttgttttcatttatggcaggatggtcacctgattctcaaatgcagaacagtgccctgtgagtattcacatgtgtcaacttactctggagtactctgaacatgctgctgagtcctcttatgtggcataaactcaggtctgtgatatgagcgggctccagatgctcaagcagcagtgacttgctcctgaagagaaaggacagcctcagtcatctgcacagaccacaggccccttagtctactggatggatcccattacatcctaccagcaaatgcaatctccctatctcaatcaacatcttactggactctgattctcacccaattgtatccaaaatgaaaactcacctttctaaagagtattttgcattctaagggaaagaaaagagaccaggttactactgggtttttgagctgtttttgcaatctgtgcccaggaaaatatcctcttacaatgaactcaatttccatgtcatttcttcaacctcataatgctagttatcagatgaacaaattctaacatggaaacagaaaaagtcagaaaaatgcatgaaatcattttgtcgtagtcccaagggaaaggttttctatccctcaccccaggcatcttactcagagccatcatttctcagtcttcagacgggagcatctatctgctttccatgcagggggtggccagagttcagcaggtgaaggggccactggctgggagggcagtgggagccaggcagagccacacctgcctgcatgctcaagaactgagctgcttcctaaggatttacctacagacgctttccagatgagcgcattcattgcaattataagcccaggagagggatatggacagtcttaaaaagatagtaaggccaggcgcggtggctcatgcctgtaatcccagcactttgggaggccaaggtgggcgtataacctgaggtcgggagtttaagaccagactgaccaacatggtgaaaccccgtttctactaaaaatacaaaaattagctggacatggtggtgggcgcctgtaatcccaactactcaggaggctgaggcaggagaatcgcttgaactggggaggcggaggttacagtgagccgaaattgcgccactgctccagcctgggagatagagcgagactccgtctcggggaaaaaaaaaaaaaaaaaggtaacccactttctgaaaggcaacgtatgttactatacaaaattcaaaatatgcaatacttaccatagactgagtagcttctgcacagcagaaattcatttctcgcagttctggaggccgaatttcaagatcaaggcactggcagattcagtgtccggtgagggctccatccctcctaggtagcctccatctccagcctcacaagctgaaggggtgaggtcttcctcggcctcttttataagagccctaatcccattcacaggggctctgcccccaggccccactcactacccaaaggccccacctcccaataccatcgccttgggggagaggatttcaacatatatattttggagggacacaaacattcagatcatagcagataatctcacccttgtttcaagattatcacagatgactatacatttattaattttttgccagaaagtctgtgaatgttagcaaccacacatgtatatgtgtgtgtatatatacttattatccaaagatcaaacaaaaagcagtctgcatctttctttttcacttaatgagtgcttgaaatactgttagtgcctatagagctgttttattctttatgatcacagaatatttcattgcatggaggtattaaccacattgtgtcacatctcaaccctaacttactgctgataattttaaggtgagaattcatctcatgaagcagctccacactatcccacaaagctatgaccattcctaaagcttttggcagctgaaagaaagtcatgtagccttcttttgtggttgaagatcattggatattgtgttctgacagcaacccctaatgagtactgtccacttctcatttctcaaatactggaatgaattttattttctttttcccagcatcttaccttgagcaatgccaaggtgccttccccacactttttctcaagctccacgatgagctttaggaggctgcggacctgttcagaagccctggcttcactctccttcagtttctccatgttctctctccccacacggcccagtctctgcagaagcatttcttcgttactattcaacaacctcaagttcaggaacaagagttcggtaacttctcctatagattaattcaaccatgtttttaaaaacctgcttttcggttgggcgcagtggctcacgcctgtaatcccagcactttgggtggccaaggccggcggatcatgaggtcagggtttgagaccagcctggccaacatggtgaaacccagtctccactagaagtacaaaaattagccaggcgtggtggcgggtgcctgtaatcccagctactcaggaggctgaggcaggagaatcgcttgaacctgggaggcagacgttgcagtgagccaagatcgtgccactgcactccagcctgaatgacagagcaagactccaaatcaaaaaaaaaaaccaaaaccaaaaccaaaaaaaaaaaaaccctgcttttctgcctgctaccccaggaacagacataattaggcaaggccatgatattcttctgctgaagcaggattcctctcaagagacagttgattctttgccccctgttatgtatgtttaagccaatacagatgtgtgtgcacgcagcccttactcacattaatatgcacctaaaacatttcatgttttttctgtggctgtttgttcagaaggttccctattttttcattaacttgaaatcaattaaaattaaggtatatagattaactaataagaaataaataattacgttactgatatcaattttctttttatccttccaagtatactttacatatactgcgtagtcacatacgcaacttgagtatgttatttagggggaaaaaacataaacataagtgatagtttattatatttgattactaatctgacaacttactttattcttggagaacattccttattcatatacacagagccatgacatcatcttaacatgctgaagagtattcttccatgtatgtatggagcacattttgtgagtcttctattgacaaatacagggtgtttctaacctcttgctatgaatgttataattgtaacatctgctactcatcaactgcttaacatgaacaagacacgatttaataagctttagcagattatctcactcaaatctcacaataattttataaattaggggtcactgttatatccagtttacagctaaaggaaccaagtcaaaggttaagcagcaggtcgtaggccacccaggagccagtaaacagctggctcagataggaactccattcatccggcttcaaaggtgaattctaggccgggcgcggtggctcacgcctgtaatcccagcactttgggaggctgaggcgggtggatcatgaggtcaggagatcgagaccatcctggctaacacggtgaaaccccgtctctactaaatatacaaaaaattagccgggcgtagtggcgggcacctgtaatcccagctacttgggaggctgaggcaggagaatggcgtgaacccgggaggcgaagcttgcagtgagctgagattgcgccactgcactccagcctggagacagagccagactctgtctcaaaaaaaagaaaggtgaattctaaaccatggctctaaactgaaactcagtttcagtgttgccttacccaggtgtctttttctatgtgtgtaagtatgtttgaagcataatacagtaatatgtgtacaaatatatttataggtatattgtgctttatttatgtctttttatatgcatgtcaagataaattcatagaaatggagttgccaggtaggtatataattcatttaatacatgtgtggttgtcactggctatgttattttggaattgacataatgtttagctcttctttttctcatttctcaaatatgaggatgttgttttcaatatctcacctgtagcatttcctggaacatctcctctagctcggtggcaagcttgatcgcttgattcagaagggtttctctcaggttcaagtcagatatgcattcctgctgtctctggagattctgctcacactcttcattcaacaaccggagtctcatactatactcagactcaatcatctttttaaaattttgttcctcttccttcctcatatagacatgatagacttcaggttaaacatgatagattaacaacacacacacacgtcataatagatagatatctatatctatatatagatatatatatcttacactgaccacaatgtattctttccatctctaaccccaatataaagacaaggaaggctgggcgcagtggctcacgcctgcaatcccagcactttgggaggccaaagtgggtggatcacgaggtcaggagatcgagaccatactggccagcatggtgaaaccccatctctactaaaaatacaaaaattagctgggcgtggtggggagcacccataatcccagctactcggaaggctaaggcaggagaatcgcttgaacctgggaggtggaggttgcagtgagcagagattacgccactgcactccagcctggcaacagagctagactctgtctcaaaaaaacaaacaaacaaaaaaagacgaggaaatgtaaagtacagaagaaaaggaataaacccaaaggagaaatagaatttgagtcaacatcagccaagacatcaacacaattttagaacataaaatgcagacgaagaaatgttcatcaatgaattggctgggcgcggtggttcacgcctgtaatcccagcactttgggaggccgaggcaggcggatcacgaggtcaggagatcgagaccatcctggctaacacggtgaaaccccgtctctactaaaaatacaaaaaattagccgggcttggtggcgggcgcctgtagtcccagctactcgggaggctgaggcaggagaatggcgtgaacccgggaggtggagcttgcagtgagccgagatggcgccaccgcactccagcctgggcgacagagggagactccatcttaaaaaaaaaaaaaaaaaaaagaaatgttcatcaataaggaaaaactaaggaagctatagcctctgtcaaacagaggaggagaccaggacattggaaaagggccaatgggatttgctgatgcttgggtaagagttgtggggaaaaaaggagtcatggacgaaagacaccaaaaattttagactaagcaactggaagaatggaattaccaaaatatatagagagaatctatggaaaggctggattccagaagtgaggagtgtgcgttagctcgggatgtgatgaatttgattagtcaattagacatccaagtaaagatagtaagtaggaaattggacatgaagcctactaccatttggaaatctgagctagggatatatatttgaaagtagtcatcttagagatgcttaaatagcatctctattaagctatttaagattcagtgaaattgtccgggctcacgtctgtaatcccagcactttgggaggccaaggcaggtggatcatggggtcagcagttcgagaccagcctgaccaacatggtgaaaccccgtctctactaaaaataaaaaaattagccaggcatgatgacgggcccctgtaatgtcagctacctgggagactaaggcaggagaattgcttgaacccgggaggcggaggttgcagtgagccgagatcgcgtcactgaactctagcctgggtaacaagaacgaaacttcatctcaaaaaaaaaaaaaaaaagattcaatgaaatcaagatttatcaagaacctgactacttctcaccactgctctacctgtcccccagctcaccatcatctctccctaattattgcaagtccctttgcacgtctctccacctctgcttttactctcttggtttttttttttttttttttttttttgagacggagtctcgctctgtcgcccaggctggagtgcagtggcgccatctcggctcactgcaagctccgcctccaaagttcatgccattctcctgcctcagtcacctgagtagctgggactacaggcacctgccaccacacccgattttttagtagagacggggtttcaccgtgttagccaggatggtctcgatctcctgacctcgtgatccgcccgcctcggcctcccaaagtgctgggattacaggcatgagccaccacgaccagcctgcttttactatcttaatgtctattttcatttggcagctagcgtgtttctatgaaaatggaagttaaatcatgtcagccttctgttcgaaaccttccagtggttttgaagcttgtatttcattgaaggctgccaccctaaatgactgaccgccttcttctgatctcatcacctacagcccccgtttccttacacagctccagccacatacacggcagcctccaggcctttcctctgcctagaatattcctccccaagaaaactgcatggcccaatcccccacctccttcagtgccaccttctgaataacaaggttctgatcactttatttacaagctcactccattgcttcctttctcacttaaaaaaaatttttttaaacacttcccaggtaacatactatatattaaacttattttgtttatatccactagaatgcaagttccacgaaagcagagctggttttttttgttttccattggtgagcccctagcaccttgcatagtccctggcaaacagtgggatctcagtatttgctgaacacatggtacttggaactgaaaaagaagggggatcggttgaaaaatccttacctagccaggcaattctcctccactatcttccctaagtaggcatttatttcctttaaaaattgagggagagaaaagacccagaatcggggataccttgcacagaataggattaagtatgaagatacaggctgaaattagaagtgaaatatgcctaacaggtggtgaaccctcaaatctgaatagctattctcaaattgctctttaaagggttttagaatttatgtggcaaccagaagtacaagagatgctcattctcctatgtcattgttataaacggtgtcgttaatctttttgatcattgcaaatagcattgcaaatgccattttactcaccatataatttgtatttctcttaccacgaacaaagttcaaattctttcaatgtatttaaaatatatttactttcttttctgcaaactcttatttgatcgttttttaaaattaaatttctagtcttttccttactgactttttttatttttattttttttgagatggagtcttgctctgtggcctaggctggagtccagtagtgtgatctcggctcactgcaacctctgcctcccagttcaagcgattctcctgcctcagcctcccgagtagctgggattacaggctcgtgcaaccacacccagctaatttttgtatttttagtagagatggggtttcaccatgttggccaggctggtctcaaactcctgacctcaagtgatccgccctcctcagcttcccaaagtgctgggattacaggcgtgagccaccacacccagcttcttactgactttaaagagctttttatacattaagatattagcacttttccttcctatagatttcacatttttcctgctttgtgatttgtcttttgactttgtttatgatacactattttctaacaacattactggtaatttccccccaagaatcaagataagcactcactgacctgaatcatcgccattctttcttgctcatcagtcaatatgcttttagctgcttcaagtttctccctcgatgtgttcaatatttcctggaataacttctatagagaaagcacagaattccaggtgagatcattgatttagaacagttggattcctgaccttaaacagccaacaactctgagtatatattttcttagcctttaggttgaaggttcaacgaacttatctaatattctgtaataaacatcaactaaggtaatggttttggaggaccagaatgtctgtccatttcatccatataggagttggccagagtgttttgggatttgcgtgagtgactcttaccctgtaattctcagcagcctcttgtatcccacacaccatgtgatgtttgtgctcctgggactggaagcatttgctgcagagtgtgatttggtcaacatcacagaacagccgtgttggttccaggtgtgtttcacaataggcatcttctgtgatgttgtgctgtaactgagggctgagccttttggacatcctggtaggggtccctagttgaagactggactgtatgcttctactgaggtatctccctgcactgtgaatgagaaaaaatggtggcttcctttgttttctggagcaggcacacacacttggcaacttcagagtccacgaagatccaaggaaataagtccacgcagacagagcgggtcggcgctctggactcctcaaatccaacaaatttctggcagctgcctgcttggggaaaagacagagttaggccagtgttctaagaccagcgggtttccctcaggtcttctgacaatcttgagcaataggctgaaaattaattacaaggaacagcactcacttacgagtcattcaggggaaaacagtgctctaaaggcatcgcgctaattactgaaggaacttcaggactagagtgaggtaacagagtgcgaaagaggttcgttgatagaattacagaaaaaaaccacaagtatctgaaaaagttattaaaatactttccctttgagagacagggtcttgctctgttgcccagtctagagtacagtggcgtgaccacggctcactgcagcctctggaactcccaggctccagcgatcctcccacctcagcttccggagtagctgggactacagctgggacaaaacacatgcaacagaaggaatggggaagcaaataagggaaaacagctcctctttttttttttttgagacggagtctcgctctgtcacccaggctggagtgcggtggcgcgatctcggctccctgcaagctccgcctcccgggttcccgccattctcctgcctcagcctcccgagtagctgggacttcaggcgcccgccacctcgcccggctaattttttgtatttttgtagtagagacggggtttcaccgtgttagccaggatggtctcgatctcctgacctcgtgatccacccgcctcggcctcccaaagtgctgggattccaggcgtgagccaccgcgcccggccgaaaacggctcttctaagaagccatcaattaaagagatttgcaaaacagtgaagccaaagccactcttctcaataattgtttccgaaataaaatttcaggagtgacgtgacgcgctgcccgcggtctggccgtgagcgccctcgctccttcctctttgactccatcttcgcgggggcggcagccggaaccgcggttcagtcaccaacatgcagttcttggtccgcgccccggagctacacgccctccaggtgaccggccaggagacggtctcccaggtcgcggctcaggcagcgccactggagggcttcgccccggaagatctatcgtgctcctggcaggcgcgtccctgcagggcgaggccaccctggaccagggcgaagtgggaggccccgactgcccgggaggccaagtccgtggttccccggcccgcgctgggaaagtgacaggtcagactcttgctaaggtggccaagcgagaagacaggccgggctgagccgcgggtgcggtaccaccggcgctttgtcgacgttgtgcccatctttggcaagaagaagggccccaatgtccttcttaagtcctttgtaattctggctttctctattaaaaaagccacttagctcgaaaacttttttctcagaaaaatgtttttgtttttattattttattaacttatttatttatttttgagaccgaatctctgtcgcccaggctggagcacagtggcacgatctcagctcactgcaacctccgcctcccgggttcaaccgactctcctgcctcagcctcccgagtagctgggactacaggcgcgtgaaaccacacccagctaattttttgtatttttagtagagacggggtttcaccgtgttggccacactgatctggaactcctgacctcaggttatctgcccgcctcagcctcagtgctgggattacaggtgtgacccaccgtgcctggcttgtttttattattttaaatgaataactataaaatgcagttttaaatttctaatacagtaaacatagatattaacgctcataaacaaaagcttattgggatcttcgtcaataatgagtgcaaaggagtactgattccaaaaagttgagaatcttggcctgaaaaggcatattccccacaaataggactgtgaatgaatgcatccataattttgatatgttttgtcagtttcccaagcacaaaagttgtacaattttgcactccaagcaacaaattaaaaagatgttaaacttttggatcattgcccactggctgggtgagaaatagtgtattcatatattttcaacttccatctgttatattattaatatgtctaagccttttattttcatatgctaaaaaaccattttcacttcttttgctgtgaagtctatgttcaagcctctctctcagtttattccatcaggtttggcctttttggagggaggggtcaattttaagagagagctatagatccaagttcctgtaaattgtgtgagttgcaaatactttctccctccttccttgtttttgatgctctcatcctttcttctgcttaggtctttgaaatccctgctggtttcccgtgtcttaggtccctgaacatgtccgagatgactccactgagtcaccaaaacaaagaaattcaccaactcaaatttttccttgagctctcagcagcagttaacatagctgaccacacccttcttcctagaatgttttcttctctcatctgtctgcagctgacattcctctaacttgtctggtcttgttctccgtggccttttctggtcccacatcctctgaacctctcaatcttggggtgcttcaaggttgagttctggtctcccagtcctggtctctccctaggtaatcttactcgtttctgaagatttaagttccattctccgatttcaatctcctgcccaattcccaacatttttgcaatagaatgtctaaggagcactcaaaattaacatatctaaagccgctcaggatctcaacccagtggctctcttcccccaaactcattcctttagagccacagtttaagccttcctttcaccaattcaactattgttttccaaatttatattctgtcctgccctcctcgtccatctccagctcctctctgctcaaccaccagaatactattttaaaaccaaaaccaagtgagcaggtttgtggtcactttctatggcattagagtaagatcgaagtgggtaataaccccgtcctatacaatctggcctcctgccttcttctgatctctctatagctttcccccatcactgtcaatctagctgcctctaattcatcacagcccttcccccttccgtggccaacagagctcttctctcatatttttgcaattccagctgcctcttctttcttctcttcagttctcagctcaaatgtcttcccaagagagacctttccatcactactcaatttgaaataccttcccactactcatctccttattttattttcttagtagcgaaaagattttatctttctatgaacaagtttacttgtgggtcactctccatccataagaaactaagtccttgagatgccctgtgtctacatctgacatactcgatgcacaataaatattgtaaacgatattttatgttaaaccagtaaaaattgaaggtgtaatgagagagggacagagactaaatatttttacagaaacagcaaaggaaaattgacgaattaagtccccagcatgttgtctacccttattttgtttttcctaatatttttcttcaggctttttcctgataacacacagatacacacacacacacatagattctaagatcaagtttagaaatctaaagaaacaattattaagaaaatgatctatagagaaaatctcacttactttctttgtagcaatcctgggtatttccttttttttttttttttttttttttgagacagggtcttgctctgtcacccaggctggaatgcagtggcgcaatctcggctcactacagcctcgagctcccaggctcaagtgattctcccaccttgacctcctgagtagctgggattacaggcgctgcacgaccacacccggctaatttttgtattttttgtagagacggggtttcagtatttttcccaggctggtcttgaactcctgggctcaagcaatctgcctgcttcagcctcccaaagtactgggattacaggaatgagtcaccacaccgaaccaaggtatttcctttagggaaaaagctggaacagtggagactgaagagattttatctgttcaattcctccctcagccccgccctcacaccatcaggaaggcgtctgtgaagtttcttatcatattcacacaattaatctcattagaaccacctgagtttattaaaacgcaagcctcttcacagggtctctgattccagaaatctacggtggggtccgtaatttacatttttaatggactcccagaaaatgcttaatagccctgaccttggttggataaatatcttgttttatctccagtgccatgtacagtgcctaacacctctagctccttaaggtttggggttttctttcttaatgaatctagtgtatattgacaatttcacaggaaagaagccttcgagctaacactcaagactgtgtttgttccttagtagaaaataatgcctgacttgttagtttctagaacgtttgctggagaagtgttcattccagtatctgtggaaagaaaaaccaagagtagggataactgcctatggaatctgtcacagatgggaggtcagggaacaatcccagataattcatacttgatatttggcttcagtgaggaggaactcttcacagctttctaagttttatagttttgtccccgagggtttttattgcatcagtcagtcaatcccctgctaatcaaaccagggagtttttttctttatgctgctgacaggataatgagaattcttctgctttgcttatctgatctttcagaacctggttctaccttatggaatctcaatacaccgtttctctttttcttttttctttctttttttttttttttagatgagagtctcactctgttgcctaggctggagtgcggtggagcgatctcggctcactgcagcctccgcctcccaggttcaagcaattttcccacttcagcctcccgagtagctgggattataggcgcccaccacacccagctaatttttgtatttttagtggagatggggtttcaccatgttggccaggctggtctcaaactcctgacctcaggtgacccaccctccttggcctccaaaagttctggccaccgcgcctggccatacaccctttctcttatctcagatgattacctacacccactctcttttccaaaacccaattccccagctttcttcaaatagaccacatttattcctgtgccccctcccctcctcagccagtccatcctcctttacttctcttatttttctaatccaatcttcctttctcttctaagcctgggtacggccaacgtctgtgaagatactcacacatacttgttgtcagatactctgtcatttactctcaccatcccttgagctttcataactcttgagcttactcatcttgacaagaaaactttgtaatctttgaatcaaatggaaaataaacatcaagcatattgtcaggttttgaagtctcttaaagcctgttttagagtattaaatgcttaaataaatacttattaaagcctgttttactattaaataaatatttattaataattaaattattaattctagaagagtcaatattttaagataattctaaaaacattacaaaaaagtgtgctaaacccttatttactgttacatgccccacctgttgcatgctccaaccccgtgaggtacatctgcagctgatgaagtagatgacgtagagattaagtcacgggattaagtaattgaccaagagcactgggtgcagaaaattgaagatatggaatttgaatcgggtgccaaatttcatgatatttccttattataattatttgtccttattaaatattaatcaaatggcttgacaatttacaaaaaagatgcctcaaatttgtatgacaatttatcacgagatgctttcatagggctagagtaatcacattacaaggaacacagatcattttaaggtagttagatttttcataggaaaacttttcattaaaatgaaaatcctgaagaaatgtagttttttttcactgtcaaagaacaaatacaattatgaatgagtgagtcattgttctcctgagtcatttcatgaacttataacagtcgtatcccagccgggcactctggctcatgcctgtatccccagcactttgggtgaccgaggcgggtggatcacttgaggtcaggagttcgagaccagcctggccaacatgggaaacctcatctctactaaaaatacaaaaattagccggaaattgcttgaacccaggaggcggaagctgtagtgagccaagatcgtgccactgcactccagcctgggcaacagagcaagactcggtctcaaaaaaccaggacaaaacaaaaacagtcctgtcccctttgttagccacatcaccttcaccactcgccccaggctggcatactctcggcttctgggtgggatgagtatggctggtgccaaacaaggctgtatttgttactttggaccaaatctgcggcaggagactaccacctcctcccattccagaaaagaacagctggaggcgggggtgtgctggttgtggtcccagtgttatcactcatctggaaggtgtggcttctctctggctccttttctccaaggctgctccattagaagcaggggcttggctctcactggtttacttcccacagctctaagaggtccagaagtcatgttcaactgcttcttccttgcttaagaaagcattaaaacttaagaatcaggccaggcgcagtggctcacgcctgtaatcccagcactttgagaagccgaggcaggcggatcacctgagttccggagttcgagaccagcctgatcaacatggagaaaccccgtctctactaaaaatacaaaattagccgggcgtgggcgcatgcccagctactcaggaggctgaggcaggagaatcacttgaacccaggaggtggaggttgcagtgagccgagatcgcgccactgcactccagcctgggcaacaagagcaaagctctgtctcaaaaaaaaaaaaaaaaaattaagagtcaaacattatgggggccgggcactgtggctcatgcctgtaatcccagcactttgggaggccgaggcagttggatcacaaggtcaagagatcaagaccatcctggccaacatggtgaaaccttgtctctactaaaaatataaaaattagctgggcatggtggcgggcacctgtaatcccagctacttgggaggctgaggcaggagaatcgtttgaacccggtaggcagaggttgcagtgagccgagatcacagccactgcactccagcctgggcgacagagcaagactctgtttcaaaaaaaaaaaaaaaaaagaatcaaacattatggtcgacctcatgatagcacagttacccatttgttgttgtaagtcagtgcatgcttatctgaacccaacatgttcagtttgcttgcactcttttgtaaggaagataatcctcctaacaattccagcagaattaagaggtcaccttcacctcacctattacaacaccgggacaagccctatcggttttcaccagacagaataccctcagcaaaaggaacgggctggtttaactgaaatcagtgaatcctgagcaaataaacttcggatttttgccaaagttcacaggctgaggaaagcatcatgtctcatggatgaagttagactgacgtgggctctgattccagcttggccacacacttgtcatgacctgcagcaagccactgaacgctgagcatcacttgcaccatgagtcaccgtcaccatcttccacaagtctctgagcattaggagaggttcgatgaaatacacgtaggagcgaggagggtggtaatgagaacagaaattgctctctgaatgagtatgcttcctctcctcacccagagtcattcttttcagcaaagtcaagagcacggccctctacataagggagagtgcagccgggaaggtgatggaggtggtagagatgaattattggcatatgggaaataaagagatctttgatgcccttttcagtttcttttgtttaataatatatatattagtaatgtagtaattgcgtaattgatatcaaggcatatattcagcttttattaatgtaatgtttatctgaaaacttttaggccactggtataatttttttttttttgatactgagtcttgctctgtcactcaggttggagtgcagtggcacgatctcagctcactgcaacctccgcctcctgggttcaagtgattctcccacctcagcctcccgagtagctgagactacaggtgtgtgccaccatgcccagctaatttttgtatttttaatagagacagggtttcaccatattggctaggattgtctcgatctcctgacctcgtgatcgacccaccttgtcctcccaaggtgctgggattacaggtgtgagccaccgtgcccggccactggtataaatttttaggaagaatttttttctgttccattatagtcagtttcaacaataaagcctcattgtcaagatattaaaatcgctgggcatggtggcgcccacctgtagttccagctacttgggaggctaaggtgggaggatctcaagccagagaggtcgaggctgcagtgagctatgattgtgcccctgcactccagcctgggtgacagagtgataccctgtccctaaaataaataagtaataaaaatgtaacaagatactaaaatctacatgctgctcactatcattggaggatatgcatctttacaccctcctgaaagaaggagtcaaaaagcctcctccacactttaaagttatgtgataatctggatacccttcaggacctggacctgtttaaaaagactggcatcaaatgttgtaagggattggatctcagagaaaaaagcagctttataaataaacttgaccagaagttattatgccggcaatattcgttcaaacagaaaatctggccaggcatggtggctcatacctgtaattccagcactttgggaggccaaggtgggcagatcgcctgaggtcaggagatcaagaccagcctggccaacatggtgaaagcctgtctctactaaaaatacaaaaaattagccgggtgtggtggcaggcacctgtagtcccagctactcaggaggctgaggcaggagaatggtgagaacctgggaggcagaggttgcagtgacccaagatcgagccactgcactccagcctaggggatagaacaagattctgcctccaaaaaagagaaaagcaaagaaaagaaaattttatgtcgtcaaaatatttttacaaaaccaggtgttagtcttgcagaacttaatgcagttgagttaatttattcaacctactcaatttagtacacagtagggttgtactactgtgaacatagtttcatagtctgattggaatgaatgaagaaagatggctgagagacaaaataaatcaataaatcagtactatccatcttctctcaaaatataatgcaggaaatccttctccaaatccaccttcaatagtagccctagtagtgatgtaaacaagagtatttcctcagcatactcagtccctttactaaactttacactacgtttcctggctgcgacggcttagcatggatccgttgatcagtattgtcggtgcaatcctggagagacactgcttttttgcttctcttgttaaagtggttaaagtgaatgttaagtagaaaaagggcgtggtttgctagggtgaaagcagcacagagatagaaaacatcagggccaccctgagtaatgcacatttaaatttaaccaggtaggatataaactatggattgcttcttagtcataaagtaccttatataaagaaaatggaggccaggcgcggtggctcatgcctgtaatcccagcactttgggaggccgaggtgggcagattgcctgagctcaggagtttgagaccagcctggccaacatagtgaaaccctgtctctactaaaaatacaaaaaattagctgggcgtggtggcgggtgcctgtaatcccagctactcgggagactgaggcaggagaatcacttgaacccgggaggcagaggttgcagtgagctgagatcgctccactccactccagcctgggcgacagagtgagactccatctcaaaaataaataaattaataaattaaaaaaaaaaaaagaaagaaaatggaaacagccaggcacggtggctcacgcctgaaatcccagcattttgggaggctgaggagggcggatcacctgaggcagggagttcaagaccagcctgaccaatatggagaaatcctggctctactaaaagcacaaaatttgctgggcttggtggtgcatgcctgtaatcccagctactcgggaggctgagacaggagaatcgcttcaacctgggaggtggaggttgcagtgagctgagatcgtgtcattgcactccagcctgggcaataagacaaaactctgtctcaaaaaaaaaaaaaaaaaaaaaaaagagaagaaaagaaaaaaagaaaatggatacaaacatgaagttatagaaaagtagtggagatcatgtagtaaagtaaaaagatcttatggatataactctttgggaaaagttataaacacaaatattttagtaaacattgtaagactaaactagctaatgcaaaagactgttttctaagattcggaagtttacacgggatacatctacctaggcctagtgtgctttctcaggttttgtttctttaaaaacttaataattctcttggtattatattctcaaaaaaattgtctgcaaatgattttagctgagcatccctcttgcaggtagaagaaggataaatctgacagaaacatccatgggctgtatgtagtaatcacagttcgtgtgtgtgcatgtgaataaaatatgtttctttcacattattaaatcgttttttcttttgaaatgaagtcttgctcttgtcccccaggctggagtgcaatggcgtgccctcggctcactgcaacctctgcctcccaggttcaagcgattctcctgcctcagcctcctgagtagctgggactacaggcgcccgccaccacgcccgctaattttttgtatttttagtagagacggggtttcaccatgttggccaggctggtctcgatctcctgacctcatgatccgcccacctcggcctcctaaggtgctgggattataggcgtgagccaccgcgcccggcccacattattaaatcttaatatttatatcatttccactagtgtagatgctaacttaaatgcttggtcttgatctctgatcattaccaagtcaatatatctaatacttaaaattaatgtttttccctctgttgctgaggctggagagcagtggcaccaacacggctgactgcggctttgacatcctgggttcaagcaatcctctcaccggagcctcctaagtagagacacacgccattgcacctggctattttttcacaaagttttttgtagagacagagtctggctttgtttctcaggctggtcgcaaactcctggcctcaagtaatcctccccgccaaagtactgggatcacaggcgtgagccacggcgctggccctgttagaacatagagctagctttgtcaatgctttttcatcagtagtaggtagaatgtagggactggttaaatgttacggtgattacaatcttgaaagaaagtaagtggtatcattactgccaaataacttcttctttagcctgtaactatttcagtgcgcattatgattgtaactagaaacaatggaggcaggagccaggcctacattttatctattattctatctgcttagtgcaaaagtccctgactcctaatccaggatttttttttctcagagggttaaaaatagttttctttttaaagatttgtggactgggcagacaattaatggtacagaatccccacgcatattgtgggaatgaaaaaaaagaagacaggatgcagagttctaatggcacaattggcaaacagagtaggaggcagtctctaatagcatcataaacgaaaacagcccccaaatacctaggaagagctcttccttgtctgtaacaagctttgtttgaggaactaatagtaaagaatgtggttacagaaaatacagtggtgtctgccaagcacctcggcaaatacaaatccacactggagaaagagacgactttgtcttccgagatacctgcctgactcctactgctcagccacgcttctctcccacacgcacccccagtaatgactccagaggtcaagttctgagttctcacgatggcaggagaatcagcctgtcaagacggtcacctcgattaaccacacactgcaaatctgaggactccgtgagggaagggctctgttcctatccagggtttaggcactgggattagagttctccagaaagacacaatcagtaggataggtagagagatgcatgagaggaggtgtattaggggaactggcttatgctattaggaggctgataagtcccaggatgcgacacaccctggtgtgtcagctggagggtgtgtctccagccggagaccagccacgtgtgaaggccttagagccagggaggccgatggtggggctcgtggccagggctgaagccctgcaaaccccggctgctgctggtgtaagtcctggggcccaaaggcctgggaaccccgagttctggtgaacaaggacaggagaggaagagggcctgcatcccaccacagaagatggacacacagattcagtgcccacccgattgagggtagatcttccccatcccctccagtgtgactctcaccctcatcttttccagaaacactttcacagacacaccccaaataatgctttcccaggtttctaggcattccttaattcagccaagttgacacctaaaatcagtcgtcacaatgcgggggaaaaaagcatagcccccaccacagcaatgtatagacatgtcattatgttctcgccaacaggttctaccacaaagtttttgtgccactttgtagagtcctttttttcttttttcttttttttaagacagcgtccaggctggagtgcagtggcatgatcttggctgactgcaacctccacctcccaggttcaagcggttctcctgcctcagcctcccaagtagttgggctaaaggcgcctgccaccatgcccggctaattttttgtatttttagtagagacagggtttcaccatgttgggcaggctggtctcaaactcctgacctcagggatccacttgccttagcctcccagagtgctgggtttactacaggcgtgagccaccacgcctggtcactctgtagagtctcaaagagagagggtgtacccttctcctcttgagcctggcttcaatgtaaacataatgatagaaactgggtcatcagatatcctgtaggacggaggctgtatgtgtcgaagaaacgagagtcgaggtccctgaattcattctgcctactgggtattaaatgaggaaaataaacttccacccgttttaagccactgttactttgctttttactgtcacacatagctgaagctagtacattggatacattgactgtcctaaagttaagatctggaagatctaacatggacagctgagcatgggatttatttgagtttgggataactcatgggatcattctgagttttttggcagtgatggcgaggggaggtggcttaggaacaggagataaagctatggaaaaagcagtgttaatcgtggaggaggactcagactgtctctgccttctagactatgtggctttaataatgaagagctgcaacataaaacctgcgaaccaaaagcattttcttgaaactgatagttcctgaaaagagagaggatagaaggaaaccgctatttctatctaagtcctgtgtcccatggacagtttcatttgattttaatcctgtatgggtaagccttggtcttttcccttgactgctccaagcttggaggtgcagtacagtgatagaacagccgtgaatccaggccagctcgcctgcgccactgctgacttcgcctgaaaattctctcatccattcttaccatcttgctgcatgctcaggccttctcaaaaccaccttggggacgttcttcatcttggaatggtgcctgtgaacaaagatggagttattctgtttaggtaatgctaagaaaaaaatttgttttccttactcccttccctcactggatacctgcagtaagtaggccatcccttagacacaggcagatagagaagaggcactgtggtgggcagaaatatgagaatgcccccaggattctcacccactagtacacatacactttctcccagtttttcaaacacatactaatctgggtgctggccaggagcggtggctcatgtctgtaatcccagcactttgggaggccgaggcgggcggatcacaaggtcaagagatcaagaccaccctggccaacatggtgaaaccccgtctctactaacctccaaaaattagccaggcatagtggcgtgcacctataatcccaggtactcaggaggctgaggcaggagaatcgcttgaacctggaaggaggtggaggttgcagtgagccgaaatcacaccactgcactccagcctgggcaacagagtgacagagtgagactatctctcaaaaaaaaaaaaaaaaaaaaaaaatctggttgttgatgtgagggattttgcagatgtaattaaggccaaatcaattgaccttaaggtagggagactgccctggataggcctgacctactcctgtgagcccccaacaaagactgggtttttgtggtgaggaagacacaatgtgagggattggtggcttgggagaaggattctggagagacacacggcggggatctgacagtggcggacagtggcctctgacagcaactctcattgacagtcagcaagaaaatggggtcttcatccactcctgtaactttaaggaactgagttctgtcaacgatgtaaatgaacttggaagaagaccccaaacttaaaagaatacatgctgtccaacctctgagaccctgagcagagatcccagtcatgggatgctggatttctggcctgcagaactgtgagctcgtacatgggtgttgttttcagatgctaagtttgtggtcacccgttacaatgcaatagacaactgacgcagacactccactgaactgctcagtgactaaggagataaagaaagaggattagaagtggattcttcaagcaacgcctacatcttatgttgggttcaggaaacaaatcaagccgggcgtggtggctcacacttgtaatcccagcactttgggaggctgaggtgggtggatcacctgaggtcaggagttcgagaccagcctggtcaacatggtgaaaccctgtctctactaaaaatacaaaaattagctgggcatggtggcacatgcctgtaatctcagctattcgggagactgaggcaggagaattgcttgaacctgggaggtggaggttgcggtgagccaagatagcaccactgcactccatcctgggcgacagagtgagactgtatctaaaaaaaaaagaaaacaaatcaagaattctgttctaactcaaaattattttattagaccaaaatgatagcctcaacacaaacctagaatagctttgacacagaacttaacctagaaagaaaatatactcggtgaggattttttcatgagaaagtagtaaattttacccttcccctacaagggtgaaaccctctccctgaaccaaagttctttagaagatacaaagtatttgttttccaaaaattcaccctacttgtcactatacctgttcacacaagacaatgaactaaatgtcttcacatgttcagtgaaatgagcacaaattgctaccagtttcagtagttttacattttattttaagaattttcttattttaagaaaacgtggaatgcttcacgaatttgggtgtcatcctcgcacaggggccttgctaatctctgtatagttccaattttagtttatgtgctgctgaagcgatcatggtttccgtttttttctgaccagattctgcataagagaagcctcctgcaggtattgacagattcttgcattttctttgtttttctccacttcctactcattcacgagaggtttcacgtttgactactggtagttaactgtgtaatccacgtggttgaagttcgttccacgaagttagtggcgtacccgctctcagtcttacagaggctaacaacaggtagtcacagattgttacctgtggctttccactttaaggagataaatccttcttcaaaggaaatccgacacacagcacacacacacgtagttgaaattctcatccagccctttgtttatccagcatctgtttgttgctactctccatatatatgcacagaactgttagaatgcaatttgtggagaaaaataaaatacccacacacacacacacacacacagtcccctcctcttgggccagttattctagactgcaggttgctatgtcagttgaattaaccatgaccagtactaaaaaaaaatacgatatttgggccgggagtggtggcttacacctgtaatctcagcactttgggatgctgaggcgggcaggtcatttgaggtcaggagttcgaaaccagcctggccaacatggtgaaaccctgtctctactaaaaaatattaaaaaattagtcgggcatggtggcacgccccgtaatcccagctactcgggaggctgaagcaggagaatccttggagtgggaggtggaggttgcagtgagccgagattgcaccactgcactcagccaaggcaacagagtgagactccatctcaaaaaaaaagattcagggcactttttctgcagcaaagataaaagtgtttcatcagttgcatgtcccatgtcgtgtaaaactgtgtttcttccagtgggtcgtggtcaatagtatgaaaagcactgacataagggagttacagtctaaggcaagagacaaatggcaacactaaggcattgaaggagagataggaagaactatgagctcttgtatcagagggggaacttaattaaccaaggagacttggaaatgcttcccggaggaagctcaagctgagaagcaataagtggggtagatgccctttaccctgaggtatcttccattaatcctcgcagctcacttctaaaagtagtcatcgttgggcaaatagatgaacgaaagcttgctttcttcttcaaaatgattggtggtttaaaaggaaaactattaccgagtacaaaacaaataaattttttgtttcttctttttttttctttttcctttcttttaatttttttctttgtttcttcttatcatctagaagtgcctttggtctggtcctttcaaaatcttgagggttttgcaaaggttagcattttacatggaggttcccatggctctgtagcagatcttatatcataagtgaatttatataaaggttaggggagccacaagggcagtatttttatacgtagactatctggaaggtttgtatttataaagccaaaccccaaaataggttttcttaaacttttaagtttgtttagagttgttatataattctagtaaattttaccactcaaagacccttatgcttggtctcgtttacaaagctagaccattttatatagtgaggatatagttatcaatgaacgtagtcaatatttttaaatagtttaattgtctgacttgaaaaatatccttcctcagcaagaaattcttttttttttttttaatttgagatggagttttgctcttgttgcccaggctggagtgcagtgacgtgatctcagctcactgcaacctctgcctcctgggttcaagcgattctcctgcctcagcctcctgaggagctgggattacaggcacacgccaccatgccgagctaatttatgtatttttagtagacacagggtttcaccatgttggccaggctggtctcaaactcctgacctcaggtgacccacccgcctcagcctcccaaagtgctgggattacagacatgagccaccgcacccggcccaaaattcttatatgataaatcaaacttataaaaatagtgaacctgatattctgaaacatcacaatgctttgtatatatttaaacctcaacttagaatcacaaatctaaatcaatgactcaattatatgttttacattggagttacttggttatttccatagctgagttctcctaaatatcacaagcaaaactaaatagatttttacatatccaaaagtacgaagactctggttatggtacttctttcagttaaaaggcactagccttctagggaatcactgtcattgggttggacatttcagctgggcgtgaactctaaggcagcagatacccagggtgcttctcctcagcacccaccacggaactgacctcccaccacatgatgctgatgcttcccttcctatgtgattttttggtatttcttttgcagcctgcttgaagtgacataatgaccagatacgtttgtgaggatgctgactgggatttggtcagaggccccggtaggcccactgaattcttaccgtacatcagtgacctcataacctttcaagctttctattcatgaagctcaaaacacccctctcagtaacatacacacatcacttgatagattttgcattttcttggctcttaatatactcaaatgcctttttcatttaaatctagagtttgatctggatgaaataatgcatttttccatatataggcatttctgctacgtgcaatgtattttcctaacaaacaaacaaaaagacaccccactctgccagataatgtattaaaataatagtgcttccgtaagagttagagtggaacactcaatccctatacaactcaaaccagatgcttacaaaatgttaacagcccttaaaaaaaggccacatatagagtcgaggacacataaacttctaacaacgacaaaaacaaaaatacagggtaactattgaatctgctttttttggaagtgaaagttatttgataagaaatttgggaaagggttgaggctgccgagttagggtggccaggacaagaggcacataggaacagcaaaatcagcatctctatgacagagtatctggtcaaactgagccaagaagagtgtggtgtggatggctgtcgtgatctcatcatagcagagagatcaccccactgagggcttgctgccttggctgcgttagtgttctctgccttcgactgctcttacttacaaccaaacttcagtgtgccagggaaaggacatgtttgaatcaacatgattttcttgtcatactaaaacaagtcctttactttgcattatagaaacatgttatttttagccctacagttgatttctaatcctcgtaggacaattcccaaggatgtttaagatctatttgaactttgagtttcacctgccttctataatcatgacagtggagactccccattctacatattctttctggacagttacctgtgatctagtcttcagctaccttctgtatgccagaacttcatctctagtttaggtccctctgttcgtcttcaggctcataaggatgtacatattgatcactggagctctctatccagatattgtgcaggacacctcaaagtcaaggtgtccaagatgaaacatgtacatatatatacaccattctctccccgtgtcaaaggcaaccacatccactcagtttttcaggaatgccagtattgtctaggaaagactatctgcgtcatatttctatagttaattactaagttttagctatctaagactttttttttttttgagatagagtctcactctgtcgcccacgctggagtgcaatggcatgatctcggctcactgcaacctctgcttcctgggttcaagcgattctcctgcctcagcctcctgagtagctgggactacaggtgtgtgccaccacgcctggctcatttttgtatttttagtagagacagggtttcaacatattgcccaggatggtcttgatctcctgaccttgtgattcgcctgcctcagcctcccaaagtgctgggattacaggtgtcagccaccgtgccctgcatgtctaagactttatacaacattaaagtccacttatctctatcccactgccactaccccagcccagcttctagctgagaactgcaaccaaatatcaagttttgtgacagtgtaaactattttgatcccaacctgaagccagtcaaaataaataaataaataaataaaaaataatctttctctgccaatctcttgtttaccactttggtggatatatatttactttggaattaagtacacattttttagatgtgcaaggccctgcctattttctcccaaataacttttgctgatgaggagcttgacttactcctccttccagtcctttctacgtaataatggtgccctctgagccttcttgttccttcaaaccctattaggatggaagaagtgacgcttgagtagaatccttaactatttctttgaaactgtttctggctttggtgctttgtgtactcactacagccattttaccatagtttctagatcatgactgtccagtgacttttctgactcttccatgaggatagtttccttgaggcaagaactcgctatattttctggcctttatatagtttgggtgctcacatttggccaaattggtgtttacactgtggtgaggagaagctgcagcctgtgaccctggactcactgaagactcctcgttaatcaagcggccatccttattcggaagagccccaagcatactcacctgttcatttttctctgccgaggcagttgtccgcttgtgagaccattgccttgtgtagagaattccggatttcttgggcctcattctgaaaaggataacgattatcctctcttggaggttgctatgctagagctataaagtcaaaagtaagcataaatttaggcgtgaattagaatgtggaaattagcattactgtcagtcaaaacggggcttttggggctcctgagtctccgttgttgacaggtcagggatagaaaatgaatgagctagtaggaattgttttgaagaccccacgtcttcaaagacggaaagaatgatcaagaatgaacccctgaaattttctttttttcttttttctttttttttgagacagagtttcattcttgttgcccaggctggagtgcagtggcacaatctcagctcactacaacctctgcctaccggattcaagcgattctcctgcctcagcctcccgagtagctgggattacaggcatgtgccaccacgccaggctaattttgtatttttagtagagacggggtttctccatgttggtcaggctggtctcgaactcccaacttcaggtgatctgcccacctcggcctcccaaagtgctgggactatgggcgtaagccactgctcccagcctgaaattttcagagtagacaatcttaccttgaagatgacttttgccttcccagtgatgaattttgagagagacttgtgttgctgagacagaacacgagtctcacacaggagcatcaactctgtcaacacaagccttcaggctttttgggtgcatctcacatatgctattcttgaaatccattacatgacatctcagatgctttgccatctcagccatcatcccctactgcacagcaaaccttggagccataaccagatgttcctttccatctccctagaggcactcacagcaaggcctgcgtgcacctgcaattacaagtggtttgatcaaatgatgcgaatggatagaacaagtcagctctttcttgaaatctggtagatccaagctagccttcatactttgcagggaggaagagaaggattaaggagagaaaaatcaataaaaacctctcatcttgacctgatttttttgcagcaacaggaatttgtctttaatgtcagctcacgatcacatgccttcatcttctgagtcacactctgactgagtcacacttgccattcttagcctgtatagaagttgtctgggactttcctccctccaccctacacctccctcagaatgttactgtctacccacactcatctgggaactctcatttggaatgaggggagggaggcacagttttgctaagaggcagaataaaagcatgccccgggtgccagcctccagctgcctgggaacccagtctttgtgaggtggttttatttgtgaaagtcgtgattcttaacttcttaacttcattgcatgttagaatcacctgaaaagtgacaacaattctgattctttttttgttttttttagacggagtctcgctccgctgcccaggctggagtgcagtggcgtgatctcagctcactgcaacttctgcctcccaggttcaagtgattctcctgcctcagcctcccgagtagctgggattacaggcatgtgccaccacacccagctaccttttgtattttttagtgaagactgggtttatccatgttgatcaggctggtctcgaacacctgacctcaggtggtctgcctgcctcgacctcccaaaatgcccagattacaggcgtgagccacggtgcctggccttgctggctccttttgaaagccctgtcataaacttacctagaagtaagcgctctcttctctggccttaccaactgcggctacaagtaatcaatgagcatgggaggagtgtccccaggcagcatctggcaccaattattattggatagttcaggggccaggggaacctcagcccatccactgccagggacggacttgacaggatccttgcccagcaagcctccttttggtcacaaaactcaaggagtctggttgccagccaaactccttgagttctgcatttgtggctcattcagttctgtggaaatggcagcatggctctgtggttgatagcctggactctgaaataaggccacctctgggccgggcgcagtggctcacgcctgtaatcccagcactttgggaggctaaggtgggtggatcacaaggtcaggagtttgagaccagcctgaccaacatggagaaactccgtctctattaaaaacaaaaaaaatcagccaggcgtggtggtgggcacctgtaatcccagctactcaggaggctgaggcaggagaatcgctggaacctgggaggcagaggttacagttagcagaggtcgagccactgcactccagcctgggcaacaaagggagaccccatctcaaaaaaaaaaaaaaaaaaaaaaaaaaaggccacctctgtgaatctaagagaactcacataactagagtttgttttctcatctgtaaatggggcaggaactcatgtccacctcacagggtcacatgttgaaagtgttcagaatggtgtctggcaagaattgggtgccattagaacaactagtctcgtttctttccgttaaagatcctattttttgcaggggggtgagaggtagagtcttatggataaatgttaagatttctgggccgggcgcggtggctcacacttgtaatcccagcgctttgggaggccaagacgggtgaatcacaaggtcaggagttcaagaccagcctggccaagatggtgaaaccccgtctctactaaaaatacaaaaattagccgggcatggtggtgggcacctgtcatcccagctactcgggaggctgaggcagggaattgcttgaatctgggaagaggaagttgcagtgagccgagattgcgccactgcactccagcctgggcgacagagagagagtgcctcaaaaaaaaaaaaaaaaaaaagatttccctaagaaaagcaaaaagtggactttctcattaaggaagtggtgtgcacttatagtcccagctacttgggaagctgaggcaggaggatcacttgagcccaggagttcaaggccagcctgggcagcatagcaagactctgtctctacagaaacaaacaaacaaacaaacaaacaaaaaaaacagatgaggaaacaacgtgtatatacttaagcatctgtttccctataaaatactagtttaatgtgggatgattatttatttcctaatatactgggtgtattacaccacctagaacttaaaaggtttttaataattcctgcagaattaagtgatagaagcaagcacagaacaagtgacctttgatctcaagagtttttctaaattaatctgctattattctttaccaatattaaatcctatacacatggtagtaattcaaattatttatctctaataatctcaaaccccagaatctgcattagaatgagggaagaagttaaactataactccttttttttgagacggtgtctcactcttgtcgcccaggctggagtgcaatggcatgatctcggctcactgcaacctctgccccctgggctcaagtgattctcctgcctcagtctcccaagtagctgggattacagatgcctgccaccatgcccggctaatttttctatttttagtagagatggggtttcaccatgttggccaggctggtcttgaactcctgacctcaggtgatccacccaccttagcctcccaaagtgttgggattacaggcgtgagccaccgcgcctggccttagactataactcctaaatgtcaaccaagtgtttaaattcttatttgtcttatttgtttgaactgcttttcaaagtttcctgcccaggctccccaacttacacaatttctttttgacttctcccccatttttttaaatctctttaagagacaagtacataaagcacccagcagaaagcctgaaacaaggaaattttcttcatttaacatttattaaagcaaggggatgaacaatatagcctttattctccagaaacaaacaaagcacctccccctaaatcctcagggaagctacgcagatggaagctctagagagcacctcccagtgtccaagctgggcaactggttgagagtggctgggttccacacaccaggaaacctgtgcagttacagtgcccggaaccttccccacagatatggccccatgtcttgctgtgtaatgttaaaggcgaatattgtcaagctgaattgtgtctttaaatatttcagagataacaagagtgttgcgatttttgtttgtttgtttgtaatattttgactcaccgtcaatcagattacacattttatttctgaaatattcagtgagttttctcactcctaaatagtagcttatctcttcagttgaaatacgtgttagtccgtaaaggtccagatcgaataccatttctcccggaagttttttctaattgttccagcaagaatgtcatgttcccgccactaaaatgccaaagcagttaattaatttaaattctaccactctcagggcacacgtcttttcatttcgtagatttttcttcttcttttgcacgtatatcttctgctcccaaagaagagaaataatttttagtcactttcagcactgagctcattgctctctatataatagaggcgcaatatctaatcgttaaataaataaaagctgccattgaagttgcaaactattaaaaaattttattatatcacagctgaaaccaatcttcagagacaattttatccttaaagctgaggaaaattgcttcattaattggcttactccaagtcacacctcacatttcttagctcctactctattctccaatatttctttactgaaaaaactgctgacaaattatttagaaggtatatgtgtgtgtgtgtgtctgtgtgtgtatttggagacagggtcttgctctgtcacccagggtggaatgaagtgacaatcatagctcactgcagccttgaattcctgagctcaagagatcctcatacctcagcctcccaagtagctgggactataggcacacatcaccactcctagctaaatatatatatatatatatatatatatttatatttagagacagggtttctctatgttgcccaggctggtctcaaacccttggtttcaaactgttcccccactcttcgttttattttttaattttaatttttttattttttttgagatggagtctcactcttgtcgcccaggctggagtgtaatggcacgattccgcctcctgggttcaagcgattctcctgcctcagactcccaagtagctgggattacagatgctcaccaccacgcctggctaatttaaaaattatttttggtagaggcggggtttctccacgttggccaggctggtttcgaactcctgacctcaagtgatcccccaagtgatccgcccaccttggcctcccaaagtgctaggattatgggtatgagccaccgtgcctggcctccccaactcagtttagcaccttctcacttttccctcccccagtccctggaaaccacccttctactttctgcttctgagtttgactatgtcaggtaacttgtagaaggggaatcatgtggtatttgttctctgtgcttgacttatttcatttagtataatgtcctcaaggtccatccatgctgtagcatatgacaggccttccttttcaagactgacttgaatatgtatagtatattcaagagagtatattcaatatagtgcattcaatatatgtattggtatgtgtagatctcattttctttatccattcattcctcgatggacatttaattgtttcctcatctccgctattttttaaattgttttgagacggggtcttactctgttgcccaggctggattgcagtggcactatcacagctcactgcagccttgacatcttgggctcaaatgatcctcccacctcagctggactaaggaccacaagcatggaccactacgcctggctaatttaaaaagaagtttttttgtagagaagggtctggctatgttgcccaggctgaattcctgctctcaagcaatcctcctaccttgaccttccaaagtgctgggattatggcatgagtcaccatgcctggtccctcatctcatagcaattgcccctattttggatttccaccaacggggttccaatttcttcacatcctccccaacttttgttgtctgttttttgtttgttttctgttttttgataatagccatgtaacaggtgagaggtgctctctttgtgattgtagatttgcatttccctgatgattagtgatattgagcatcttttcatatacctgttagcctttctatgtcttctttggagaaatatctgactctttggtccatattgttatctggctattagtttttttgctattcagttatagaagttccttatatatcttgggaattaaccccttatctgacatgtgatttgcaaacagagtcagccctccaaatctatgggatctgcatctgttgattcaatcaaccgtggatcaaaaatattttttaaaagactcattatggggccagtcatggtgggtcacacctgtaatcctagcactttgggaggcggaggtgggaggatggcttcaggccaggagcctgaggtcagcctgggcaacatacaaagaacatatctctacaaataaaataaaataaataaaaactatacaggcatggtggtgtgcacttgttgtcccagcaactcaaaaggctgaggtgggaggatcactgcagccctgggggcctgaagctacaatgagctatgattgcaccactgcattccagcctgggtgacaaactgagaccctgtctcaaaaaaaaaaaattatgttccttaccttgtttaaaaattgttctttctagcacttataactacttaatatatatctgtttttgatcttatgcttctccttactaaaatataaattccatgatggtagagattttcctttattttttcctaatttctcatttataaagaaaaagctggggtgttcatgttatttgtatttctttcacatgtgtggttctttgatcttctgaaaatgttatataatattttataattttatcactcctgtgcctaaaatctctagcaattcccatcgattacagaaagaatttcaaaacttggcgtaacacagaagcctattgtgattggctctctgctcaccctcacctccagcccgactcccacttcgtcaggttctacagtctgccaaaacctctaagttttctatttttgaagtttttttgtatttagaatgttaactatttggatgccacatgcagagtgtgggggaaaaaagcaagagcattaaaaatactttaatacttaaaaataaataataaatgtgaaagtctgcaaatgtaggcttttttgggtcattctctaaacaacacagtataacatcgatttacatagcatttacattgtattaggtattacatgtaatctagagatgatttataagtatacaggaggatgtgcagggttaatgcaaatattatgtcattttttttccgggactggagtatccctgaattttggtatctgcaggaggtcctggaatgagtctcctgcagacgctgaggggccactgcattttctttcgttccgcagaatatgcatcttcacgctgtcgatcgtttcctctgctgtgcaggagctttttggcttgatgtagttccctttgtctgttgttgctttttttgaccatgcttttagtgtcacagtcatgaaattccatacttcttctgtgctttcatctacacaaatacatatgtcaacatctatagcatgacctcttatttttaggaaaaatacacaaatagtggaatataatttttattatttagacaaactatttttgagggcaaaaatttatttccccttaatgtcatataatggatgtcatatcatgttaatgtatgtaaacagatctgctttttaaaaaatgtctatgtagtaagatgaagggctattattttggcctggtgtgatggctcacgcctatagtttcagcgctttgcgaggccatgacaggtggatcacttgaggtcaggagtttgagaccagcctggccaacgtggtgaaactccatctctgctaaaaatacaaaaattagccaggcatggtggtgcacatctgtaatccccagttactcgggaggctgagacatgataatcgcttgagcctgggagccggaggttgcagtgagctgagatcacgccactgcactccagcctgggcgacagagcaagattccgtctcaaaaaaaaaataatagtaataaaagctattattttaagtatacattcatgtaagactgctccataatttcagagtatatatttgacaactgttgcaaattctctttcctagaaatatataaataaggtgaaaaaagcaataaaaaaggaaacatatgagtagaaattcatacttgggaaaaaatagacacactcccccctgcccacgcacacacacatatatcctgtatttatctacctggaatatacttcggtataagttgctgggtagagatcaactgaatttatttttccagatgactccctgactttccctaaactgtgtgttgagtaacctatcttttccagactggcatgaaatgacagatatacagaggacccttgaacaacctgggtttgaactcctcaacatggacacttatacacggatttttctcaataaaagtgacaccaagaatgcctgcctctcctgctcagccttccacttcctctacctatctggcctctgccacccctgagacagcgagaccagccctcccacccccacctcctcctcctcagcctactcaaagtggtaacgacaagggtgaagacctttatgaggatccgctttcacttagtgaatagattttctcgtaataacattttcttttctctagcttatttgataagaataaaataatacatgtaacaaaaaaatatattaattgactgtttctgttattgataaggcttggtcaacagtagactattagtagttaatgttctaggaaagttaaagtgtatttttgactgtgcaaggggtcagcacctgtaacccctgcattgctcaagggtcaattgtatttttttaatctcgctctgtgcccaggctggagtgcaccggtgatcatgtctcactgctggcttcgtctcctgggttcaagtgattctcgtgcctcagcgccgagtagctgggattacaggcacccgccatcacgcccggctaatttttgtatttttgtagagacagggtttcaccatattggccaggctggtcttgaactcctgacctcaggtgatccacctgccttggcctcccaaagtgctgggattactggggtaagccactgggcctggctaactttatttttaaagctaggctttcaagcaatgtatttttcaaataagctcccaactagtccaccgcctcatcaacaaataagcccttactgtatctataaagttcatttttttctgcatgtgccaaccctgatggcatctgggtgatagttgtgacagtgaccctcttggagtactcctagcatcaccctctcaggagagaaaggccagagaagaagctacttgagttgttgatctcagaagccgtgtctggtagtgtgattgggtcatatattttgggaaggctggtctattctatgaatgcatttcatctatgaattaagcccaagcaaaatgttgagaaagatggtaaggaagtctgccttcccaagagtgaatgtggtcagtgatttcagatgcctgtcacaccatcactccataatgacagctgtctgacttccttctcacagcaattggacaatgttcatttttttttttgagatggagtcttgctctgtctcccaggctggagtgcagtggagcgatctcggctctctgcaagctccgcctcccgggttcacgccattctcctgtcttagtctccctagtagctgggactacaggttcccaccaccacatccggctaattttttgtatttttttagtagagatggggtttcaccgtgttagccaggatggtctagatctccggacctcgtgatccacctgccttggcctcccaaaatgctgggattacaggtgtgagccaccgcgcctggcctgcaatgttcattttattgagataactggaaattttcacccactcacaagtcaacaagtggatgcagtatagtgtgttgacaaaagagaaagactgggaggtaggcgctccagtttcctagtcctaatccggcgtatgtggtaagtgagtatcaggagatgaatttaatttattctagcctcagttttcctcagcatctgtagaaggtagttggactatatgatctcttgacttccagctaaatataagactatgattccataataatatagttcctctattcatttataactcattaacagaaaaatcgagccacgtgcaaagaattcttgtagtcatcaatgaataacacgtggttattgtgttacgatgcctataaaataaaaaaaattatctggaagagggaaacgggatagagcagatcagtgtgacttgaacagagactatgccagcctccctattccaaattggaatactggctctgtgatgtgctataactgtattgtgaggcttattctaatgattttggtaaatgttaaagactcctcctggggttgtgttgaaataacacactgaatggagatggtagttcataaattctttttctagtggtggcagttagtgttattgtagtctttttttttttttttttttttttttgagatgggatctttctctgtctcccaagctggagtgcagtggtgggatcttggctcactgcaacctccacctcttgggttcaagtgattctcctgcctcagcctcccaagtagctgggattacaggcgtgcaacaccacacccagctatttttactttttttttttttttttttgagacagagtttcgcttttgttgcccaggctggagtgcaatggcgtgatctcacctcactgcaacctccacctcctgggttcaagcaattcttctgtctcagcctcctgactagctgggattacaggcatgtgccaccatgcccggctaattttgtatttttagtagagacggagtttctccatgttggccaggctggtctcgaactcccgacctcaagtgatctgcctgcctcagcctcccaaagtgctgggattacaggcatgaaccactgcacccggcctaattttcatatttttagtagagacggagtttcaccatgttggccaggctggtcttaaactcctgacctcaagtgatccacccacctcggcctcccaaactgctgggattacagatgtgagcaaccgcgcctggccaaactttttttctttttttttttaagactcttacaagactaactcatagcaatattctgaagctgtgacaagttagtatcctggaggctatcttggtagaggtttcatgatgccaccctgatgccacctctcttcctctttacagtagtataactctttgctcttattttttcatagcttaaattctcatcctagcaattcacgtatgctttacaagggatgtataggattgaaacattttgaattaatgatttcagaaaggtgagttttgactaggagaaaggaaggtggaggaaaaaacattctcagccagaaaacttctttttcccaaagttcaagataagaaaacatccaacatcctgttggaggtaagtgggaaagaagtagcagttggagccttgaaagtcagaaaccaatgaacggaacagcctgagtaatggacccgactcgtggaaggctgccaagctggagagtgaggggacggagacagaaatatggcgtgatgagttcgtgggaaggtcaaactcgctggcctttgaggaagagcttttgaggtgcaacttcctggcatgcagtgagcagaaggcaggccaggacaggagctgactcccgagcaggggacacagtgaatttgtggcatttgttaccaatctcggagttcactgtgcacagtctccacactaggcatttactttttcatatgtccgaaaaaatgtctgcacacttcatttctgtccagtaagaactgataatcagggatttgaaggggcctagtttggaaattttcaatgggtgaaaataagtgagcaaaattacatttatactaaaatataattctttccatctgctccatagtgggatagcctcttgaggcaacttccaattagaatgtcattttagatgctttccaagatggcagatgggtgagtactagggtgtgcagggaagatcaataaacagctctggcaattcatcgtgcgcctaacaccaaggaatacttcagtggaagagctctcattttgttgggatgaataaaattaaataaaagtacacagtacccaataaaggaacaaaagcttaggctttggtcaagcagaacaaaaggggctaatgagaaaaggactatgtattacagttttcttctctcagttctcaactaggttttattagtggagttcccaaaagatttggaccaaatttccaattcagatattattagagatcatcaaaactcaaatctctttactggtttacaccaaatcacccaagcttccagcctaaaacccacatgctcacatggttccacagtgctgtttatgtacaataaccagttctcaaaatggtaatcctgttagaagccagaatcctcagcctctagcatgtgtgcttttcacagagataagtctcaaagtttggggttggtgaggagcccagtatacaggagttccacattaagtcataattggctttgtgttggacagtgtatgtcagctggtgaaatcaggcacagaagagataagggtttcttgtcataacaacataggaacaggtcacccgcgtgttactcaaaactgtaggacggcagtgagggctttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgcccaccactgccaaggcgctctccgatgacgagcagggtggaagcgccttcgtagcccagagccatggtgcaaacagagtgcatctctccagcgaggctgaggagcatcacagagtaagacagctgctcagcatgaaccccacgactcatcgcagctaactccgttagctttcctgacgtttcctaacgtcctctgtgggggacagtcacgagggcccatctgagcaccacatcacaaactggcgtgggtccagtttacacccttttttttccctttttttgtttttgagacagagttttgctctgttgcccaggctggagtgcagcagtgcgatctcagtcactgcaacctccgcctcccaggttcacgccattctcctgcctcagcctccccagtagctgggactacagtcacccaccaccacgcccggctaattttttgtatttttaatagagacggggtttcaccatgttggccaggctggtcttgaactcctgacctcaggtgatccgcctgcctcggcctcccaaagtgctgggattacaggcgtgaggcgccgcacccagcctgccctttgttttagaggcctaggactgcgcagttactggtcttcaaagccccttcatgacctgggactctgctcatttgccagaaagggtttgtttctattgcaggagaaactccaggaaatcctgaatcttttgcgtgtaaggagaaaggaagctcaggctgtactaacccatgagaaggagagagtgaaactgtgccaggtcggtgtctgtctgacttttgctgcttgtatatgaccccataagggggactaaagggaaatttagtgaaatatcaggaaaaaaaaaagacaaatttttccagtctcacctctaaaatatgcagtttccttgcattgggctgccttcttctgagcgtcctcgtgggagtctcaaggctcagctgcaattcgccccctctaggagcctcctttgcataactagacaacgctgtggcttcctctatgatggctctggtagaattatttaaaacacaagtgatacttatagacatgtaacatgagacggaaagcgattttaaaaagaaatatctcaaaaacatggaggggaaaatgcaaattaaaaaaaataaagagacagagatataaaagcaaaatagtggtttaaatgatacctgacaagtcctcaaggttggtcacggacttggatttgagctctccagcagtcaaagcaaaggactaaatatcaaattatatattttttaaaaccatgtatctgattctcccaatagactttgaaatctgtttttttttttttttttttggagatggagtctctctctgtcgcccaggctggagtgcagtggcgcgatcccggctcactgcaacctccacctcccgggttcaagtgattctcctgcctcagccttctgagtagctgggattacagacgtgtgccaccatgcccagctaattttgtatatttgtggagatggggttttaccatgttagccaggctgatctcgaactcccgacctcaggtaatccacctgtctcggtctcccaaagtgctgggattacaggtgtgagccaccgtgcttggccgtagactttgaattcttaagtgagagtatttgccatgtatgtttctgttcctttttggttatctgacacctactttcattgaataaatatttgttgaataaatgaacacacatttttcataatttttcttaattttgttttatttgtatcatagtcctgatcactacttgtcatatttcttactcatttttggttttctccactagaacgaccgcctcctgggaatggagattttggttttgtttactattgtatctatagcgcacatacctccgaaaacatcaacctctacacccagcgcatcaacagattaaatgtattatatgttggatttcaggaattgttgccatgaaactctaggacttggccaggcatggtggcccacacctgtaatcccagcactttgggaggctgaggagggtgggtcacccggtcaagagacttgagacaatcctgaccaacatggtgaaaccccatctttactaaaaatacaaaaattagctgggcgtggtggcacactcctagactatagtcccagctactcaggaggctgaggcaggagaatcatttgaactcaggaggcagaggttgcagtgagccgagattgcgccactgcacttcagactggcgacagagtgagactccatctcaaaaaaaaaaaaaaaaagaaagaaagaaactctaggacttgtaaggattaaaaatctacagacaagggcatttctcttactaactttatctcgtgtgtgtgtgtgtgtgtgtgtgtgtgtgtgtgtgttttggcaggaagaaacaaagacttgtaaacaggttgttgtgtcagaatacatgaaaatgcaccagttcctgaaggaagaggagcagctgcaactccagctactagaacaggaagagaaagagaacatgaggaagctgaggaacaatgagatcaaactgacccagcaaatcagaagcctaagcaaaatgatcgcacagattgagtcctcaagtcaaagctcggctttcgaatctcttgaggtgagaataacattcatgagagtaatgggaaaaattatagtaactcatagtacttcaagccataggaaataatgttttctttattcatcttaaaaactaagttctggtccaaaagtagttttcctaaagaattgacattctatatgtcaataaagccttatagaagagagagagagagaaaaaaaaaaacacatccagaggaataactatcccaaacaagcctgagagtggcttcaatttcttctgtacctgcctctctgcaacctcagctttgttaatttttttttctagtttattaatgtgtatttactatgtgctgggcacattaaatttaatcttcacaaagacctgatgaagataagtaccattatgatatgaactctaggtctagatgactgtcatctacaggatgggttaatagcggcactgatttaattattcatacctgtggtactaacgagatctgcccgcctgatagttaatagacaggagagccctcctgttctgtgcagggagctcctatttctcaccacctttggtctactgcccttctaggctgctgcattcttcaggacctttttttttttttttgagacagagtctcgcactgtcgcccaggctggagtgcagtggtgcaatcttggctcactgcaatctacgcctcctgggttcaagcaattctcttgcctcagcctcccaagtagctgggattacaggcgtgtgccaccatgcccagctaagttttgtatttttagtagagacggggtttcacaatgttggccaggatggtctctatctcttgaccttgtgatccatccaccttggcctcccaaaaggctgggattacaggcgagagccaccggcacccggccgtggactttcttaaacataagccatgtgatccaactccagcttcaggtctgttttgtagactggttccacagagtgctactatttaatttagtgccttccaaacacaccaccccgacctgacacaggcttggttagcctcagttctcaccagcccattttcctttgttatctctgcctctcactggatgatcgagactaacaggttggcttgtttgcagaacaggttccctggacaaggtgatgatacgagaaaaagaaaaggacaaagtattctctagtcattgtgagaaacaccttgtgttcaccacagcacatccctggaagaaactggggacgcttttctctgctctctgtgctcccactcatggtgtgcttcatgggaagcagattctgtgagctttgcaaggactgtatgcaaaatgaatttcgtctgtgttatgatcaaagcgcaccatgctaacttctttcttttttacccgtaggaagtgagaggagccctggaaaggtaggctttcattctgtgttcagttatgcaagctgcggggcagtggtgctgatggacagttctgagtggggataggaggtctgcgctgttgctgggggagaaatgaggtggactctccagctggagcaggtcacgcggtctgtgccgaggagtgaacctctctgctctcttgcaggagcgagccactcttgcttcagtgtccagaggccaccaccacagagctgagtctgtgccgcatcacgggaatgaaggagatgctaagaaaattcagcagtaagtcagcctgatttgttacccctccggggctcgaagaattaacttcagcataccttcttccagtgtcagacattcacgatctgacacgaggctcctggttaaggaatccgggccagcacggaacaccagggagggctggggccacagaccgtctctgagcgtgagcagagagaagcagtgagacttgactcaggctttatctggctttgttttctgtctaaagggtctttttttttttttctttgagacggagtctcactccgtgtcccgggctggagcgcaggggcgcgatctcggctcactgcaagctccgcttcccgggttcacgccattctcctgcctcagcctcccgagtagctgggactacaggcgcccgccaccacgcctgggtaattttttgtatttttagtacagacggggtttcactgtgttagccaggatggtctcgatctcctgacctcgtgatccgcccgcctcggcctcccaaagtgctgggattacaggcgtgagccactgcgcccagccaatcctagtcctttctttgttggttttgtcattgtcttttccatcccccccttgcacgtgcagacacgcccccctcatgcaggggcgtctacatttctagctctgatcccgttaggatgaaagctgacttaaattctaaaatcccagtgagggtgcattcaacgaactgtccttgtagaatgctccagatgtttagtccagccaacactgagagacgtcaggattagttctcagcttttatcttgtggacaatctgaccttcagaggaagaggcctaatgagctttgaactccagagtgctgaataaagccctgccatgggccccggcactatgctactgggctctgcgcttacttacaatgataagtaaggcagattttgcctttccttttgtagaattttcaatgaaattgaggaggaaggcattaatcacacagataattagttatggtgggatctggtctataaataaaagtatgaaatggtatgattggggccgggtgcggtggctcacgcttgtaatcccagcactttgggaggccaaggcgggcagatcacttggggtcaggagttcgagaccagcctggccaacatggtgaaactgcgtctctgctaaaaatacaaaaaaaaattagctgggagtgatggtgggcacctgtaatcccagctactcgggaggcctaggcaggagaatcacttgaacccaggaggtggaggttgcagtgagcagagatggcgccattgcattccagcctgggcgacagagcgagactccgtctcaaaaaaaaaaaaaaaaaaaaaaaaaaaaaaaaaaagtcagaaatggaatgactggggtacctgatcttgtctggacagtgagtggaagttggaatcctcagccaggcatggtggctcatgcctgtaatcccagcactttgggagactgaggtgggtggatcacccgaggtcgggagtttgagaccagcctggccagcatgatgaaaccccatctctactaaaaatacaaaaaactagccgggcgtggtggtggacaagactactactcgggaggctgaggcaagagaatcacttgaacctgggagacgaggttgcagtgagtcaagatcgcgtcattgcagtccaggctgggcaacaagagcaaaactgtctcaggaaaaaaataaaaaaataaaaggaggccccatatgtgactgtcggttcacagactatgtgtgcttcatcacatggtccctgggtgctgcactgaactcacaggaagctgcatttgtcatgacataatgaaaaaggctgattagggattgtgatttgtgatttgaacactcagtaaccgtgtaatcttggtgaagtttcctaaccttcctgaacctgttttcttttttgtaaaaattatagaaaagaatgcttgcagtgattaaatgagataatgtacagaaaatgtttggcacattagaagttcagccaaagataagtgctattttctctcccacccaaactgaagaaccagaacctcccatggctaatatgatgcgaacaaccaagggtgtccctatgtggacgcacagctcggagctctaaagatgtcctgtgaacagagcgacgcccattccacccacagggattctcctccccacctcaggcaggctaaagctccttctccacgtggctcttctctctgtctccatttagagcttcatgctatgtgttgtggaacagtcaaagaagagctcagaaattttgttctcaaccaaatactgtttttttctgaaactgagtcttgctctgtcgcccaggctggagtgcagtggtataatcttggctcactgcaacctccacctcctgggttcaagcaattctcgtgcctcagcctcctgagtagttcggattacaagcacgtgccaccatgcctggctatgttttgtatttttagtagagacggggtttcaccatgttgcccaggctggtcttgaactcctgaccttgtgatctgcctgcctcaccctcccaaagtgctgcattacaggcgcgagccatcacgcccggccccaaattacatttaaaaaaccaggactaaatactaagaattcaatggaaatctcacatacctaagaggtttttcaagcatgcccaagggaaatctcttctttcctcctcttgcagcggagataacgctggacccagccacagctaatgcctatctcgtgttgtcggaggatctgaagagtgtgaaatatgggggaagcagacagcagctacccgacaacccggaaagatttgaccagtctgcgactgtgctgggtactcagatcttcaccagtgggagacactactgggaggtggaggtgggaaacaagaccgagtgggaagtgggcatctgcaaggactctgtgagcagaaaggggaatctccccaagccacctggggacctgttctcactaataggtttaaaaatcggagatgattacagcctctgggtctcgtcacctttgaaaggtcagcacgtcagagagcctgtgtgtaaggttggtgtcttcctggactatgaatctggacatatagcattctacaacgggacggatgaatccctcatctacagcttcccgcaggcttctttccaagaggccctcaggcctatcttttccccctgcctcccaaatgaggggacaaacacagaccctctcaccatctgctcactgaacagccacgtctgaggggcgtgccctgagccgtcacagcgggcgatgtctgagaccaagacacaactattaagacgatgaaggcatcgacagtattaatgtcaggtgatctgaaataaactcccgtaaccccaccccacccccaagagtttccattaacttgatcccattatgaacagccacattacacaatcaacttcaaccccaatagaagagagctgatcatattctgtgtctttaagtaaatgtattctctgggctaccccatgtgtgtgctggtcactcaaatattgagcccctattaccatgaatcctactgccataggccagattttataaatatatgtcactttttcaagtgtatttaattatttgactcttaaaaactgtgctgctcgaatgtgtctttgtcctccgtgcagagctccgcatgctggggcaacgcaaatccatctggggaaactgaggcatggacacatcttttcagggtgtgtgagagggctcagatctcatccttctcccaaaagccattttccttcccatcccatgagcctgcagtgtttgtactcaggaaggcttatatgttcagaacactgcaaatatttgtgtgaatgtcgtcataccattcatgcttccataatcacaacaggctggaaccttccattaatatgttaaaaggtgacagagcaaagtgtctgttcagtaaatgtatcatgacacgggatgccaagcgactatattgcattgtatataaggttcttttcggtgcttttgtggtttgctgtaagcagaaggctttcaatctccagaaggccaaagagcctaccctcttcttatctcaaaacgtcagggttggccggatgcggtggctcatgcctgtaatcccagcactttgggaggccgaggtgggtggattacctgaggttgggagtttgagaccagcctgaccaacatggagaaaccccttctctactaaaaatacaaaaattagctgggcatgatggcacatgcctgcaatctcaactactcgggaggctgaggcagcagaattgcttgaacccgggcggcggaggttgcagtgagcggagatcattccattgcactccaccctgggcaacaagagtgaaactccatctcaaaaaaaaagaagtcaggttttgtgaggaagtggtggtggctgaggggagctcttttggctggtggtctgcattaggctcgctgtctttagtgatctatccctgcaggtgtttgtttgtttgttttaagatgcaatctcgctctgtcacccaggctggagtgcaatggagcgatcgcagctcactgcaacctccacctccggggttcaagcaattctcctgcctcaacttcccaagtagctgggattacaggcacttgccatcattcccggctagtttttatgtttttgtagaaacagggtttcaccattttggccaggctggtcttgaacccctgacctcaggtgatctgcccatcttggcctcccaaagtgctaggattacaggtgtgagccaccgtgcccaggctttttttttttttttttttttttttttgagacggagtagtcttgctctgtcacccaggctggagtgcagtggcgcgatctcagctcactgcaagttctgcctcctgggttcacgccattctcctgcctcagcctcccgagtagctgggactaaaggcgcccaccaccacgcccggctaagtttttgtatttttttttttagtagagacggggtttcaccgtgttagccaggatggtcttgatctcctgacctcgtgatccacccgcctccacctcccaaagtgctgggattccaggcgtgagcccccgcgcctggcccagcctttgtttttaaatggaatgttcccttgctagtactgcagaatgtccccggtcacagagggtatccctttacctcctctcatctctcagataagccattgtcctaaggcaggcaagacagtggatacgatttaaccaccactccagactgtgttattactaagatgtttaggaaaaatgtttatcagagttttgtctgtaaattggagactcggttggaaagaaattaataattcaacctgttaatcagcacacaaggccttaaaaagaggtctgtgaaataaagagggtttactgtagggtgcgcttatccttctcacccatctgaatctgctttctcttgccactctatacgtttcaatcttgtgtcctcgaaggcaggggagcaaagaagaaacaggctcaagagtctgggaaatgctgtctcctgtgctttgcattcaccatttaattcccaccctgaattcagcatttaattcccaccttgacatcacgcacaatcagagtttgagacttgcagaggggagcccagcacgtcctccttagactatctgtggcccactgtgtttccttcttatttatgtatttatttatttatttgagatggagtctggctctctcgccaggctggaatgcagtggcgccatcttggctcaccgaaacctctaacccctgggttcaaacgattctcctgcctcagcctcccgagtagctgggactacaggtgctcgcgcaccaccatgcccagctaatttttctatttttatagagacagggtttcaccatgttggccaggatggtcttgatctcctgacctcctgatccgcccacctcagcctcccaaagtgttgagattagagacgtgagccaccgcgcccggccttattttatttatttttaaaaattattattattattttttgagacagagttttgctcttttacccagcctggagtgaagtggcatgatctcggctcactgcagcctcctccccacagggttcaagtaattctcctgcctcagcctcctgagtagcttaatccccataggcatgcaccaccacacccagcgaatttttgtatttttaatagagatggggttttgccatgttggccaggctggtcttgaattcctgacctcaagtgatccacccgcctcagcctcccaaagtgctgggattacaggcgtgagccaccgcacctgggccccacttattagacagattttatatcttgatttctcacctcaaaaagctaagaaacaaaatgataaaaagcaaacagcaaccatttggaatacatcttttctcaattaccaaaaatcccagttttgtggagggactaaataaatacaaaagtaatacattttactttgtgggcattacatctcattgtagcataatccagtgatacatcctttcctttccttctttgtcccaaagtggtagatactgacaaagagtctagcctaatttttcctttggcaaaatcatccccagtggctctttgctgcaccattgtgtacacagggcctgccactgatgaggtgtgtggggaagattgaatctataggatcaacctttggagtttgaataaaccaccaagaaaactttgcaagaaaattgccactcacagtttctggatacaaactccaaggtgatgagacgtgggggtgagaaggggagtgagagttgggggtgagaatgggagtgagagttatgggtgagaagggcagtgagagttgggggtgagaaggagagtgagagtgggggtgagaaggggaatgagagtgggggtgagaaggggagcgagagggggggtgagaaggggaatgagagtgggggtgagaaggggaatgagagtggggctgagaaggggagtgagagtgggggtgagaaggggagtgagagtggggctgagaaggggagtgagagtgggggtgagaaggggagtgagagtgggggtgagaaggggagtgagagaggggttgagaaggggagtgagagtgggggtgagaagaggaatgagagtgggggtgagaaggggaatgagagtgggggtgagaaggggagtgagagtgggggtgagaaggggagtgagagtgggggtgagaaggggagtgagagtggggctgagaaggggagtgagagtgggggtgagaaggggaatgagagtgggggtgagagggggagtgagagagggggtgagaagggaagtgagagtgggggttgagaaggggagtgagagagagggtgagaaggggagtgagagtgggggtgagaaggggagtgagagaggggttgagaaggggagtgagagagggggtgagaaggggagtgagagtgggggtgagaaggggagtgagagaggggttgagaaggggagtgagagagggggtgagaaggggagtgagagtgggggtgagaaggggagtgagagtgggggtgagaaggggagtgagagaggggttgagaaggggagtgagagtgggggtgagaaggggattgagagtgggggtgagaaggggagtgagagtgggggtgagaaggggagtgagagaggggttgagaaggggagtgagagtgggggtgagaaggggagtgagaggggttgagaaggggagtgagagtgggggtgagaaggggagtgagagaggggttgagaaggggagtgagagtgggggtgagaaggggagtgagagtgggggtgagaaggggagtgagagtgggggtgagaaggggagtgagagtgggggtgagaaggggagtgagagaggggttgagaaggggagtgagagtgggggtgagaaggggagggagaggggttgagaaggggagtgagagtgggggtgagaaggggagtgagagtgggggtgagaaggggagtgagagtgggggtgagaaggggagtgagagtgggggtgagaaggggagtgagagtgggggtgagaaggggagtgagagtgggggtgagaaggggagtgagagagggggtgagaaggggagtgagagtgggggtgagaaggggagtgagagagggggtgagaaggggagtgagagtgggggtgagaaggggagtgagagagggggtgagaaggggagtgagagtgggggtgagaaggggagtgagagagggggtgagaagggaagtgagagtgggggttgagaaggggagtgagagagagggtgagaaggggagtgagagtgggggttgagaaggggagtgagagagagggtgagaaggggagtgagagtgggggtgagaaggggagtgagagagggggtgagaagggaagtgagagtgggggttgagaaggggagtgagagagagggtgagaaggggagtgagagaggggttgagaaggggagtgagagtgggggtgagaaggggagtgagagtgggggtgagaaggggagtgagagtgggggtgagaaggggagtgagagaggggttgagaaggggagtgagagtgggggtgagaaagggagtgagagtgggggtgagaaggggagtgagagaggggttgagaaggggagtgagagaggggttgagaaggggattgagagtgggggtgagaagggaagtgagagtgggggttgagaaggggagtgagagagagggtgagaaggggagtgagagtgggggtgagaaggggagtgagagagggggtgagaagggaagtgagagtgggggttgagaaggggagtgagagagagggtgagaaggggagtgagagaggggttgagaaggggagtgagagtgggggtgagaaggggagtgagagtgggggtgagaaggggagtgagagtgggggtgagaaggggagtgagagtgggggtgagaaggggagtgagagagggggttgagaaggggagtgagagagagggtgagaaggggagtgagagtgggggtgagaagcggagtgagagtgggggtgagaaggggagtgagagtgggggtgagaaggggagtgagagtgggggtgagaaggggagtgagagaggggttgagaaggggagtgagagtgggggtgagaaggggagtgagagtgggggtgagaaggggagtgagagtgggggtgagaaggggagtgagagtgggggtgagaaggggagtgagagagagggtgagaaggggagtgagagtgggggtgagaaggggagtgagagaggggttgagaaggggagtgagagtgggggtgagaaggggagtgagagaggggttgagaaggggagtgagagtgggggtgagaaggggagagtgggggtgagaaggggagtgagagtgggggtgagaaggggagtgagagtgggggtgagaaggggagtgagagtgggggtgagaaggggagtgagagtgggggtgagaaggggagtgagagaggggttgagaaggggagtgagagtgggggtgagaaggggagtgagagtgggggtgagaaggggagtgagagtgggggtgagaaggggagtgagagtgggggtgagaaggggagtgagagtgggggtgagaaggggagtgagagggggtgagaaggggagtgagagtgggggtgagaaggggagtgagagtgggggtgagaaggggagtgacagagggtgtgagaagggaagtgagagtgggggtgagaaggggagtgagagagggggtgagaagggaagtgagagtgggggttgagaaggggagtgagagagagggtgagaaggggagtgagagtgggggttgagaaggggaatgagagagagggtgagaaggggagtgagagtgggggtgagaaggggagtgagagtgggggtgagaaggggagtgagagtgggggtgagaaggggagtgagagagagggtgagaagggaagtgagagtgggggttgagaaggggagtgagagagagggtgagaaggggagtgagagaggggttgagaaggggagtgagagtgggggtgagaaggggagtgagagtgggggtgagaaggggagtgagagaggggttgagaaggggagtgagagtgggggtgagaaggggagtgagagtgggggtgagaaggggagtgagagaggggttgagaaggggagtgagagaggggttgagaaggggagtgagagtgggggtgagaagggaagtgagagtgggggttgagaaggggagtgagagagagggtgagaaggggagtgagagtgggggtgagaaggggagtgagagagggggtgagaagggaagtgagagtgggggttgagaaggggagtgagagagagggtgagaaggggagtgagagtgggggtgagaaggggagtgagagtgggggtgagaaggggagtgagagaggggttgagaaggggagtgagagtgggggtgagaaggggagtgagagtgggggtgagaaggggagtgagagtgggggtgagaaggggagtgagagagagggtgagaaggggagtgagagtgggggtgagaaggggagtgagagtgggggtgagaaggggagtgagagaggggttgagaaggggagtgagagtggaccctgggaagtgtgttcccccgtgtagacactcatcccttgcactgctcagggtggggtctcgctgcttcggcctttgacctcgtgataacgacattctttggatatgaaggtgtccccacagaacctgccaccattccttaagctgttccttatcctcccttgttaattcctctccaaatccctgtctttcccccctttcctgaggggcccatttccccgggagatagctattccaagcggaatctgcttctccacctcttcgaacttggctagaagaggtaggaaggacatcaggaggaatcttctgcatcggactgcaatttgctttatttttaaattttcttcctcctggagcactttaaaaataaaatattgccaatctcttatgctgaaatctgatatccaaaacaacttcagataagatctttatctactcttttgctctgattattcccaacttcctggtgtacctccccctgcccctgccacaatcaacctattatgcttggagagtaccggtaccttatctgaccttagattactttacaaggccctcttacactaagtaactgaagaatgtggccaatccagccttctatattcttggatttatccctggcttgtaccttggaaggatgagatccaatacgccaccataggaaaatgaaaaaatgctgaaatgtgcaaaggttaaaataaaaattgcatgcaattttacaacatgcagataaccagtgcttatatttttgtgtatatttttctaaccctttgttttttaatgtatgtatgtttttaacaaaatgaaaaaaaggttaccttaatattacatagtgaacttccttcaatcattagatagttctttaaaatatgaacttttatattcctaaatgtataagcatgtgtcttctacaaattagcacattttattacatttcttatgcaaaaatctacattcaataaatgatacgatattatctaataaacacttcatataaaaatttctcacttgtccttgtaatgttctttatagttgtttttcagtcttccagtaaccagaaataatataggagcatgcattgaatttaattgtctcagaaactatgattttttttttttttttactttttttttttttttgagatggtgtctcactctgttacccaggctggagtgcagtggtgcgatctgggctcactgcaacctctgcctcccaggttcaaacaattctcctgtctcagcctccccagtagctgggactacaggcgcacaccaccatgcctggctcatttttgtattattattattatttttcaatagagactgggtttcaccatattggtcaggcttgtctcgtactcctgacctcaggtgatccacccgcttcggcctcccaaagcactgggggattacaggtgtgagccaccacacccggcctgatttttttttttttttttttgagatggagtcccactctgtcgcccaggctggagtgcaatggcatgatcttggctcactgtaacctccacctcccgggttcaagtgattctcctgcgtcagcctccctagtagctgggtttacaggcacgtgccaccacactcggctaatttttgtatttttagtagagatggggtttcactatgttggccaggctggtcttgaactcctgacctcgtgatccacctgccttggcctcccaaagtgctgggattacaggcatgagccaccacgtccggcagaaaatatgatttttaatgggagtagtatttcattatatgactgtccctaatttatgtaatcattccactattgtgcagcattcagattttctgttggtaactattatacctcccactgtggtgaacacagtgcacataagcccctgggtgtctctctaattcttccccaagtgtgtctccggcaggcaggaaagcttactgtgtgtcctgcaccgtgtgcgtgttggttgtaccctcccttcgttctacctgcactgcaaggcgtcccaaaggcttccctcacacccccacaccgaagggacagacacactagttccagaccagagaaagaccatgtttgcccctgccttgcggtctcaccagagcattgcgtttattccccaagaaactacactgagtggaattggagtagggcttagactttgaaactagacactcaggctgggcgatggctcacacctgtaatcccagcactttgggaggctgaggcgagtggatcacctgagatcaggagttcgagaccagcctgaccaacatggagaaaccccgtctctactaaaaatacaaaaattagccgggtgtggtggtgtggatctgtaatcccagctactcaggaggctgaggcaggagaatcgcttgaacccaggaggcagagattgcggtgagctgagattgcgccattgtactccaccctggacaacaagagcaaaactctgtctcaaaaaaaaaaaaaaaaaaaaaaaggcctggcgcagtggctcacgcctgtaatcccagcactttgggaggccgaggcgggcagatcacgaggtcgagagattgagaccatcctggctaacacagtgaaaccccgtctctactaaaaatacaaaaattagccaggcgtggtggcgcatgcctgtaattccaactacttgggaggctgaggcaggagaatcacttgaacccgggagacagaggttgcagtgagccgagatggcgccactgcactccagcctggtggcagagagagactctgtctcaaaaaaaaaaaaaagaaaaaataatttaaaaattacaaatgataaaattaggcccagtgtcttagagagtatcaaataaataagggcctgaaacttaagtttctctagctccattgtacatctgcctctgggttagccagatacgaagatgaagcacaaaggcagtaaagccaggtctgctgggttcaaatctcagctccaccactcaccacttactaactgtaccagcttgtctccccatgcctcagtcccctcatcaggaaaatgtgtttgaaaataatatccgggccagtacatggtaacctcagcaagttgggaggcccaggcaggaggatcgcttgagccccgctcaagaccagcctgggcaatatagtgagaccccaagtaatactattaccaaaaataaaaagaatgagccaggtatggtggcacacacctgtggtcccagttactaaggaggctgaggtgggagcatcacttaagcctgggaggtcgaggctgcagtgagccgtgattgtgccattgcattccagcctgagcgacagagcgataccctctctcaaaaaaaaaaaaaaaaaaaaaggaaataatactgcttcacagggctgtctagggctgtcgtatgcatgaaatgacataacacttgtacttggagcatcacttaatttcaggtgtaagcactcaacagtgctaactatgaatcgctcctcaccaagcttggacgtctacactagcatgacgctgtttgaggttttagacactgccctgattcctcacagttctgaccaagaacctgaaactgaggtcggaatattgccttctattcctcccatttctgcctgggggtcctggttctgtccttactgtccttacggaaactctacctcaccagttttgcaatggcctctgtggggtcccccagtaacccttctcccctacttcactttctttctgtgccctgaccaagaatcacagagtgtcctgacagctcttcacccagccaggtgcaagcttctcccagcacgcccaaacccaaaccgggcccaaaccggagtctcgaacattcccagacactcattaaggtctcgaggttgtcgcccgaaacacggaaagaaactggccctggcccctaaccaaatttcttaaaactctcacattccataatccctgaacccctcactgcagacacacgcaggtagaacaccttttttttgagatggagtttcactctgtcacccaggctgaagtgcagtggagtggtctcagctcactgcagcctctgcctcccgggttcaagcaattctcgtgtctcagcctcttgagtagctgagattacaggcgcataccaccacgccctgctaatttttgtatttttagtagagacggggtttcaccacgttggccaggctggtcttgaactcctgacctcaggtgatccgcccgcctcagcctcccaaagagctgggattacaggtttgagccactgtgcccagtctctcttttttttttttctggttattatataaatactttttaaaaatgtaatttaattttcagttctggaatgtatgtgcaggacacgcaggtttgttacataggtaaacatgtgccacggtggtttgctgaacctatcaccccgtcatttaggtatttaagccccgcatgtattcactatttatcttgatgttctccctccccctgccccaccgacaggccccagtgtgtgttgttcccctccctgtgtccatacagagcacccctttctctccaaggatcgctgtggcctctgtaagctcccctcataactgctctgaactgagcaccctgctgatgagggcttctttctttggaatcccaatcgaccccatcctggaacagttcagagtactcccttgtgggaattcccccgccgctgcttttggggtgattccagcgttgggttggctggacaaaacagcctcgaagcatactgccccaaatctggtccttctgagtttctgattccctcactcttcatctcttatgacgccttcctaaacattcctgagagtttcaaacattgtctttcatttgactcagggattcatcatccgcttcctgttgaaatagtaaacgcctccacatggactcacgggttcacctccttccggtctgaacagtgaactcctccgcatcaactcacccattcaccccttccggtctaaacagtgaacgcctccgcatggactcacgagttcacctccttccggtctaaacagtgaacgcctccgcatcgactcacgggttcacctccttccggtctgaacagtgaactcctccgcatggactcacgggttcacctccttccggtctgaacagtgaacgcctccgcatcgactcacgggttcacctccttccggtctgaacagtgaactcctccgcatggactcacgggttcacctccttccggtctgaacagtgaactcctccgcatcgactcacgggttcacctccttccggtctgaacagtgaactcctccgcatggactcacgggttcacctccttccggtctgaacagtgaactccgcatcgactcacgcgttcacctccttccggtctaaatggtaaactcctctgcattgtaagtcagtgtctagagtggtgatttgctttctggggtgtgtttttcacagtgatggtggatccacaaatttcaaacaaattctttctccaccagttctgttcggttctattttggtggggcccacgcgtcatcacagagtatctgggagccctgccctcttgcagatgggaatgaaggcccaggtgctctggagaggtgactctcctctaggtgaggggtgtgtgtgtgagaggagtgaggtgcggtgtgggagggtccttgcagggtccggctgctttcggaggctgtttttctcagctccccgttttgtccctccaaattgtgcccctctccttccaattgtcactctcctttcccccaaccctccctgtctcccagttgtctcgcttctcagaaaggaaacactggttctgtaaacctgtttgagaagaaaagctcgaggtttcttggcctctctgcttctggagccaggggaaaaaatagccccaggctgaagacaggagggaccagattgctgcttggtgatgcgatctcactgcagaggcagccaggagaccctcctgagacgaatcggagagtccatgctgcttttacacacatcctagttcttttataactagccttttcctattaacggacatcattcaaaagccagttttaagcaacataaatattgaaaacaatactatactatttagaattaattataagttttgtttttaaagcctaaatcttttattgttgtttgaaccctgggcactgaagctaataatgtaacttttctcccttctttcttctttggcatagatttaaagaactgttagactcatttaaaatgctattaggcattttaaagagtaattgttaaatgtgttgtctcttgtgggactggaaatgttctgttcttatctggcgctggttacatcctgtttttcatttgggaaagtgcattgagctggaaatttatatgttcaatttctgtatgtaaattgtacttcagtaaaaattttcaaaaaagtggctgccttttatagcaggtgtcccatgcgcatatatatatatatatatatatatttttttttttttaagaagatgacctcaagaccaagacctgtttaaaggtggggaaggaagcaggatttggcagagggataagtctagctgccatgcagggacagctacaggctgcctcagccacacacagggcgccctggagctaaattggctctgcaaactagcctggctggagttggactgagatatcctagccgttaggcactcttgggcaaggtggctcccccagccgaggcagttcctgaaggggctgacagctgcagtcagtctatctgcccaggggattcccagcaaaagaggcaaccaattgctgggaggaatctgggacatgcatcaaagtgtccacgttggcctggcgcagtggctcacacccataatcccagcactttgggaggccaaggcggacagacctggagtcaggagttcgagaccttcctggccaacatggagaaaccccgcctctactaaaaatacaaaaattagctgggtatggtggcacgtgcctgtaatcccagctacttgggaggctgaggcaggagtattacttggaccagggaggtggaggttgcagtgagccgagatcgggccactgcactgcagcctgggcaaaagggcgagactccatctcaaaaaaaaaaaaaaaaaaaaagtgtctaccttaattctggagaccaggacttcaggagggaagaggtggagcagagttctgttggcctttcattttaaaactccattttatttatatatttatttatttattgagacagagtctcactctatcacccaggctggagtgcagtggtgcaatctctgctcactgcaacttctgcctcccaggttgaggggattcttgtgcctccgcctcccgaatagctggaatttcaggcacgtgccactatgcccagctaattttttttttttttgtatttttagtagagaatggggttttgccatgttggccaggctggtctcgaactcctgtcctcaagtggtctgcccaccttggcctcccaaagtgctgagattacaggtgtgagccgctgtgcctggcccagcactctgtattatttaatttttaaaaatccatgtaggtggcctggcgcagtggctcatgcctgtaatcccagcactttgggaggctgaggcaggcggatcacgaggtcaggagatcgagaccatcctggctaacacggtgaaaccctgtctctactaaaaacacaaaaaaattagccaggcgtggtggcaggtgcctgtagttccagctactcgggaggctgaggcaggagaatggcgtgaacctgggaggcagagcttgcagtgagctgagatcgcaccactgcactctggcctgggtgacaaagcgagactccgtctcaaaaaaaaaacaactatgtttacatatagagatatatatattatcacatactgaatgtacaaagctgtccttaattcttcaggagttacatacattgctgttgttttttttcttatgagctactataaggaagaggctgagaatgtctttaaaaagagcaggctgtggaagatctagttggtagatcttagttagtattctgctctagaaatcagattctattttatccgcctcttctcatctccaccgcttttatcttccacttcatggataagatcttggctctgtgtttggattcagatgcttatcttttcccagaagcttggccctctggggactgtcatcctgccttcctcccctgatgggtaatggctgatggctgcagctttgtgcttagacgagcagccactgagccaggctgagctgctgctgggcagcctcggtgtgcatatgcaatcaaggcaaagagaatagctatgactgcaagtctcttctatgcatatgtcctttctcgctaataacgatgatgatctcttggataacatatcccagatatttcatgaattctcacatttatgaaacgtctgtaacaggccaagtatgtgtataacagttacactacttttagaagggttaaagaagttgcctaggccgggtgtggtggttcatgcctgtaatcccagtgcttggggaggccaaggcaggaggatcactttaggccaggagttgaagattagcctgggccacatagtgagacctccaattctacaaaaataaaatatattagccggctgttgcggcacatgcctgttggcctagaactcaggaggctgaggagggaggatcacttgaggctaggagttcaagaccagcttgggcaatatagtgagaccctcatctctacaaaaataaaataaattagccggatgtggtggcacatgcctgtagtcgcagctacttgggagggcaggaggaagtcgaggctacagtgagccataattgcgctactgcactccagcctgggtgacagagcaagactgtgtctccataagtaaataaataaccaggccggttgaaacagcatttgaatcaagatggtggtcaatagaatgctgggaaccactgtgttattttaatgatactaaatttgctcatacagaatttctatgagaaaaaaaatcacagggggaaggaataagatgttacaagagacccaatttttttctttctcatgtttcagtttccttcctctttttctccattttgcatttggttgaccagcacagaaaaaaaaatttttttctaaaaagcaaatttataaaagtaaatttatttactttttggggaacaaaatgtagaatcttaaaatggcagcaaagtttagtcataaaacagaatcagtagagtaaaatctcacattcttggttattaattaaccagagggtcccatgagtattgcaagccaagtatcagtgctctggacttgaaataaccaatagttttctcaatagggctgagggtttgccgactgctgattgatattcatcagcaaacccctgacatcctggtgtcaacatcttaggtagcagatgttaacctctggaacattaataaaaggtggtagatcaaggccatactgatgagaaattggggtattatgggaagtcagtcattaagaagaattatccctatagtttataaggatatattttatacatgtttatcattttaccaccttgtgaaaggtcatttttaaaaaagaccaagatggccgggcgtggctcacacctgtaattccagcactttgggaggctgaggcagatggattgtttgagctcaggagttcaagacgagcctgggcaacctggtgaaaccccatctctaccagaaatacaaatattagccaggcgtggtggtgcatgcctgtagtcccagctacttgggaagctgaggcaagagaattgcttgaactcaggaaggagaggttgtagcgaaccgagatcacaccactgcactccatcctgggcaacagagcaagactccgtctcaaaaaaaaaaaaaaaaaaagtctgggtgtggtggctcacccctgtaatcccagcactttgggaggccaaggtgggcagatgatgaggtcaggagttcgaggctagcctggccaacatagtgaaaccccgtttctactaaaaatacaaaaaaattagccaggcatggtggcgcatacctgtagtcccagctagtcgggaggctgaggcaggagaatcacttgaacccaggaggcggaggttgcggtgagctgagatcaggctcaagcctgggcaacagacctagactctgtctcaaaaaataaaaaggaaaaaaaaaaaaagaccaagatgactttcgtctttttcttcttttgagatctacacaggaacagctttgagggctgctgtgcctacacctcagcagagagaaaagaccactgttggagaaagttgttaattaaggaacttattaaatgatagaaacaaaggaaaggaaaacaattttgtcaatttgggccaatgctgacgagctaattattttgctaaccgagattcaaggagaggaaagaaaatcaatgagctgaaaaggcatcttatttaatctaagaaacctattcaaaaaagtttgagaacaaattttcttttctttttttttttttcagacagagtcttgctctgttgcccaggctggagtgcagtggtgtgatctcggctcactgcaacctctgcctcctgggctcaagcaattctcctgcctcagcctcctgagtagctgggattacaggcacccaacaccacacccggctaatttttgtatttttagtagagactagaaatacatgaggttttgccatgttggccaggctggtcaggtcttgaactcctgacctcaagtgatccacccacatcaacctcccaaagtgctgggattacaggtgtgagccaccacgcctggcctaaattttctttttctttttctttcttttttttaatttggtatctcacactgttgtccaggctggagtgcaatggtgcgatcttggctcactgccagctccgcctcccgggttcacacaattctcctgcctcagcttcccaagtagctgggactacaggcacacaccaccaaacctggctaattttttgtatttttagtagagacgaggtttcaccatgttagccaggatggtctcaatctcctgacctcgtgatccacctgccttgggctcccaaagtgctgggattacaggtgtgagccactgcgcccggcctaaattttctttttctgaaagaaataatgaaacctcattaagtcactatgtgctaactggatgttgatgatctcataataggtaaaggccaggtgctataccaaagataaccccaaatagtgtagattaaacagcagaaaactttctctcaggtaacctttcttggtgaattagtggtctctgctccacagagtcattcaggaactgggactagcagagtgtctccgccacacccagcacagggttttaaagtcagcttcagtcatgaccacttcaagctgctagaagctgggcaggtaagggagcctggaagttcagagcgagaggctgttctttctttctttctttccttcttctttccttctttccttctctctttctttcgagttttgctcttgttacccaggctggattgcaatggcgtgatcttggcctactgcaaactccgcttcccgggttcaagcgattcttctgccttagcctcctgagtagctgggattacaggcatgcaccaccatgaccagctaattttgtatttttagcagagacagggtttctccatgttggtcaggctggtgtcaaactcccgacctcaggtgattcgcttgcctcggcctcccaaagtgctagattacaggcgtgagccaccgtgcctggcgagaggctgttctttacccggatgacgcagaagcttcagcatctccttgcctcaggttccactgctcatccggtccaggtgtctgcgaaaatggctaggtattgggtgcagccaagcgctaagaggagagcacatttagggaccccagcaacctctgcagcagctgcactaaaacctcacacacgttacctgcttgacgggaaaaatgctttgaaaagcgtgcaggctttcaattccttatcccccttgggctcaatgtgttttgaaagtcaggaatttttggtttatagaaaagtaacaaattacacgcactctccactgtgtaggaccccagtggggtccgaggcagcaccctttacacaaatcggtcaatattcctggagtgaaacataaaagtattcatacgaagtgggatcagtaaagactaaaagcatcctcctgtcagtgcggggcaggttgtctccgaatacacttttttcccccggattgaggaaaacactttttaggcctggattgataaattgttgataagaaattacggaactgaattaatggtaaaaccatgtaagttaagcatgattgagtaattttaaagcaaaacttctaaagcaattataatgacacaaggtcagataatttttatttaagttctatcctttaaaattatggttctttatatataaatatagtatttgtgtgtatggcaactacaataatgacagggtggcttagaattctaggaataggccatgtgtggtggctcatgcctgtaatcccagcactttgggaggctgaagcaggtggatcacctgaatcaggagatcgagaccagcctggccaatatagtgaaaccccatctctattaaaaatacaaaaattagctgggcgtggtggcgggcgtctgcagtcccagctactcaggaggctgaggcaggagagtcacgcgaacctgggaggcagaggttgcagtgagccgagattgcaccactgcactccagactgggcgacagagtgagactctgtctcaaaaaaaaaaaaaaaaaaaagtctaggaataaaggactaaaagaagtcccacactcaacagcaacacagctaacaaaggtggaaacgatggcccaggaggagagaggatgggcacaggattgggagagtccctgtgtcccctgagcaaaatttctaaaagtagatactgtttaaaagggaggaaatacatttgacattgtggctgtcatgagtgcaagagaaagtggtcagtggatggtgctaggaagcaccattgttctcatccataactgactctcacccagcttaaccccaggacctcttcctataaggctggaaccccactagacctttgcctccaagggccgccctgaactttccttttcctcctttttggaagagaaactcggaaatgcatgcgttttcattcggagcttgctaaccatccctcagtgctctcacatttgggtgctgatttgcgtctctgcacttagcatcacgcaaaatgtagaaatgaccactttttcctgatgcccaagaaaaactggctgagatgcaggagtatccccaaacaggaacttgtgcctgatcaatgtgagcagtgtgaatttggtcctcccgctccggatgagctcagcttcactccagggtcctatgagaagtgagggctggaaaatctctgtgtgagaaacagtatcacttgaggaagtcttaaggcttcttagagcagtttcaggttcgaagcaaaattgagagaaacatagagagatttcccataaactcctgcctctgcacacatgcatcctcccccatgatcacctttgcccactagagtggtacctttgtcagaactgatgagcctacacgggtacatctttattatacagagtccagggttcacactcgggttcacccttgggctcaatgtgtttcaaaagtgctgcacattccttgggtttgaccagtgtataatgacatgcatccaccactatcgtattgtactgagtcgtttctctgccctaaaaatcctctgtgctctacgtattcatccttctctacctagtaacccttggcaaccattgatctctgtaatgtctccatagctttgccttttccaaaacaccatatagttggaatcacacagtatgtcactgacattttttggagcaaggatttagtgactattcctttctactaggatagactgcttccttgcctacatcttctgctgtgagacagcttcacagtcatctccattttgctcttaatgtgggaagagtattcccatttctcaccatctgtccaagaatacccagagatgcctgacaactgaaaacagcttatgtttaatagcttgataggctacgatctgatggcacgactccctaaggaggatctgatcagatcgctcatatgaaaatacattcagttctgctattcacttgttttgaaaatgcaaatttgttccaatgcaattggtgtattggagaacaattcaagcagaatgagaatttcatgtttgtgtatgcatgatttcatccatgaaaaacactaggtgagcagagacaactgcacttagctgaatccagctgcccaggaaggcataaaacagtcacacactcacacacacgcacacgcacagacacccctcaacatctgccagccacctcagttcactgacaatgttatgagccacacccatgcacatttggtgttaacagctttctgtttgatttcctttcttttctgtccctcctgataactctccttctactgcttcagaataactcataagctataatccttctgatgcccacttccacaagcaaacttcagatatttttcaaggtacagtgccatatttattgtagtatttatgtatttcttaaccatttaacaagtgtaaagctgtgctacagtgtttattaggttccttcttttttaatgtgtcagctgacaacgtttctaggtgttgtgcccaggaccccataaacctagtagtttgttgttgtgtttctttatttttttaattaattaattaatttatttttgagacagagtcttgttctgtcgcccggctggactgcagtggcgcgatctcggctcactgcaacctctggctcctgagttcaagctattctcctgcctcagcctcccgagtagctgggactacaggtgcatgccaccatgccctgctaatttttttgtatttttagtagagatggagttttaccatgttggccaggatggtctctatctcttgaccttgtgatccgcccaccttggcatcctaaagtgctgggattacaggcatgagccacgacacccagccaaacccagtagttttttattacacaattctgtagattgcagcgatttttaggaacacatgtggcactccagcagcagaaatgactgtgtatgacaggatgcaaaaatggaattccttttctctaggattccactgagagtctaagatcatttatgtgtcaacttcctcatttgcaaaggagttagaaaaagaatcacttttttatttactcttgcatgggcaagtactaaagttgaagatggaaatttatttggaaattggaggtgctaaagcaaaatatccaggaggccattagcctggggttggttctgtacctggaacacttacacaggcaaaccaaagttcaacttggaagcatttcttgaaactgattattattatttttttgggggggggttgggagtggtgggggggagacaacaaccaataatcagccaatcagaaacagccaactagcaaccagtcacaaccaactagcaaccaatcagtgaactagcaaccattcacaaacaaccaactagcaaccaatcacaaacagccaactagcaaccaatcacaaacagctaagtaacaaccagacaccagcagccaactaatgattaattataaaaagccaaccagcaaccaatcacgagtagcaaaccagtaagcggtcactaacaatcaactagtagtcaatcacaaacggccaactgggaaccaatctcaaacacccagccacaaacagctaattagcaaccaatcacaggcagccaactagtactctatcacaagcagccaactagcaactggtcacacacagccaactagctgttagttatgtaagtagggacttttcacaagatcatactcaaatgaggcctggctggagtcagttgagtaattcctttgttttcatggtcagcctgcaaaagcttgctgttcagtctgctggagcagagctctctgcatctcttctgtgtctgagtgctgcccgattgctgaatgccttaatgctcaaactctgtaaaatttattttgtctaaactttttcctttcatggaaactttctttggaaagagtaacttgagcacctgggtccctaaatctcccttctctgggagaaggatgggtgtactgtcccctcacatcatgcctggtaagaggagctccaggcccctgctacagctgactgtgcgtccatggagcttgtggttacacagtggagcagtgcctgcctcacagctgagaagagccaacaacccggctccagtgatctgaaatacatgaccaacactaaattttgtgtatttgccacaactgcttgaaagaatcatttagaatggtgtcacaggtcctgagaatagagatgatgactgaagagggttgtggacaagatgtaaggacataagtagagggcagagaggacacaagatgccacgctcctggctgtgaagatagggtaagggaccacaagccaagaaatgcaggcagcctctagcggccggaaaaggcatggaaacagctccttcgcttatcttccagaaggaatgcaggactgcctacacctaatcttaatcgagtcaaaataatgtcagacttctgagacctccagaactgcgagataataaatttgtgttgttttaaaaccacagaaggcgtggtgatttgttagcccagctatagaacacttaacacgaatcaagggtggaagcagaggagaaggggaagaagggggaaagaccttcaattcgtcttggaaagtaaggctcacagtcaactgcacactgagtacaaatttacctccagggactgaggccaacctagctcaggaccagggcaaaagcaccttgaagtgctgagaccagtctcatcatatcaccaccaatagcacagggaggctcaattccagcagacacaccctgtgactccattgatgacacagtctgtctgcaattggcaaactcttctttgtctgtgagtaaaatgatgttgtttacaagcaaagttgaaagcatgaaagattttcgataaactcctcagggctcattacaattggaatcaattttatgcactctggtttgggtagcatccttctatgattagagggtggatgccaagcagcctatcgtgttaaaaataggaaaaagactataggattgtctaagcagagtggaaaaacaggctgaaagagttcagtgggtttgtgtaactttgtcttgtaacaaagtcagcaagtgaaaagctagggaaggttttttcctcctcttctgcctcaattttctttttttttctgcctgaatttgaatatagatttcatctatttaaacagaaatacagtctatcctctttgtatactgatctcttgtattccccgcttcttcacttttgtttcttcctcattacttacaagcaggatggaagtcaggtagagccgactgcattccaagtccttcactttctcttcgggtagctgggccctgggtctggcatcttgtgaatgtaaaatgaaggttgccttttgtctggtccttctttcgtataacagatcatagtgattggcactcgtcacacacacatttttattccagagtatagtctcagaaaatcctgctgaaggttcaagccaagaagacacttctatgccaattaatcctaaaaccacccttgcataattataaataatgagagaactctaacatgaccaactccatcttgcttttaaccttaactgctcacttgtttttgttttgcttattatagtagagagaccaataaaactatgagaggaatgtagtcatagttaaacttggagtcaagggaaactgatcccctttcttgtctggagattaaaggtacattcataaaacaaaattagaattatggtaggggattaaacttcgctaaggactaggaagcattaatgacttgccattgcttagtgattattaaactctttctttgctgcaataactgttgttcttgggccaggcagggatggctcatgcctggaatctcagcactgtagcaggccaaggcaggaggatcacttgagcccaggaattggggactagcctgggcaacatagtgagacctcgtttctacaaaaaaattttaaaaattagctggaggctgggcgcaatggctcacacctgtaatcctagcactctgggaggccgatgcaggtggatcacctgaggtcaggactttgaggccagcctggccaacatggtgaaaccctgtctctactaaaaatacaaaaaaaaaaatggccgggtgcagtggctcatgcctgtaatcccagcactttgggaagcttaggcaggcacatcatgaggtcaagagatcgagaccatcctggccaacatggtgaagccccgtctctactaaaactacaaaaattagctgggcacagtggcccctgcctgtagtcccagctactcggcaggctgaggcaggagaatcgcttgaacccaggaagcggaggttgcagtgagccaagatcgcaccactgcactgcagcctggtgacagagtgagactccatctcaaaacaaaacaaaacaacaacaacaagaagaaaaattagctgggtgtggtggggtatgcctgtaatctcagctacttgggaggctgaggcaggagaattgcttgagccgggaggcgaaggttatagtgagccaagatcatgccactgcactccagcctgggcgacatgcaacaagactctgtctcaaaaaaaaaataataataataattagctgggtatggtggtgaatgcctgtagtcccagatatttgggaggctgaggtggaggttgaggctgcagtgagccatgatttcaccactgtactccagcctggatgacagagtgagactctgtctcaaaaataaataaataaattaaataccttccatctcactggctttttcagggaggcagtggaagaacctgtcagtctgtgacaatccctcaatattggctatcagtgacttttatggtctggatggtcaaagagaaaaatggcgccagaaaaacccagcatgtccctatttaattaggaaaaggggaattagtattactgtatgcctactatttgctaggtactgattaaagtgttggttacttagaaatatttcatttctttatcatgttcatagttctaccaaagcgtagatttaattgtcaaatagcacaatctctagcaactggtataacttacgctattaataaatgctaggtctttggaatacgagtggagtttgaaactttattttgctttttagaaagtggtggatttcagacaattttcttaaccttttcaagcctcatttattcaactgaccttttacccagtgtctgcaatggatctaccactggcctgtcctgaaggggtaacagataaaagacaaagtcccttctttgcagagaaaaccattagcctttagtttcttccatgtcaaaatttgaatagtacccattttgcagtgtgttgtgagaatcaaatgagataagtttttatgagagtgcttcacatttagaagaaactcaataaatgttaatttcttgctttccctagcggcagcctagggggaaggaaatttttcagctgggaaacttttatttgtgcttctcaaataatattaacactgccttgggggtgagtggttctgaataacaagcatgggaacaatattagaatgaaggtacctccatggattggtgaaaattgtagtgagattttggtcaatattcaacatttgacagtaaccttattataagaataattctattatattcagttttattgtttggtgagatgtgctgaagcgtaacctcactgatggagacaaagtgagagatagtagtgatttggagtagaattaacagaagtgtgtattactgatcctgggcttattaaatggtctgttacagccaatgcagtaactcctgtaagatgtgctgataagagtagagtaatactgtgaccattcattcgcaaatggtaggaccaaagttctctctttttttttaaatggagtttcgctcatgttgctgaggctggagtgcagtggcgcgatctcagctcactgcaacctccgcctcctgggttcaagcgattctgctgcctcagcctctctagtagctgggactacaggcaagtgcaaccacgcctggttagtttttgtatttttagtagagacggggtttcaccatgttggttaggcttgtctcgaactcctgacctcaagtgatccacctgcctcggcctcccaaagttctgggattacaggtgtgagccaccgggcctgccctggaccaacgttcttctaacaggacgaatatgcttaactcgtatgaaactggactgcagtctgctctaaaggtgtgcctccttctttggcgaatttataaggaagtccccacagccctcaggacagagactgaacaagggatgtgactgctgtgaatactcccagccaaaggccatcaggacacccggagttgaacaaggtaacaaggagaccatcctgtggggacccatggcacgtctcaggaagagggtgacagcacgggcttgtgatggggtttgagcttatgctaggtgattttgagtgagtcatcaatgagacatggtttttctctggtgctgagagcaagcagtggagattctgtgataaaacgttgtaataatttttatctaggaggcaggaggaacacaggagggcttaagctgtaatccacacagaggcagttgttcacgttagcggaagaatgggatgttcaggcagtattatggtttgcaaagtcttgtgttttttttttttttttttttttttttgagatggagttttgctcttgttgccaaggctggagtgcagtggcgctatctcggctcactgcaacctccgcctcctgggttcaagcgactctcttgcctcagccccctaagtagctgggattacaggcatgcgccaccacgcctggctaattttgtgtttttagtagagacggggtttctccatgttggtcagcctgttctcgaactcccaacctcaggtcatctgcccacctcggcctcctaaagtgctgggattacaggcgtgagccaccgtgcccgcccagtgttcttgttttattctgtgctcagacatgtttatggagtggtcttgtttttgtctccctccatcacagtcacagagtgaccctgttgatgctatgctctgtgaaattgtttactttcaccagaacacctggcccagctgtgagcgtcaggccagctcctaccaaatgaatggcaggagctgctctttttcttttgtgtttttcctgccctcaccacatggcctatttccttccagtccagtagaaatgggcagtgactggcccaatagtaggagcccttagccactgacatctggaacaggcttaaggctggtgagtctgcaacactcagcaaggagatagtctgccaaatagcagaaaaaaaggggagaaatggagggattgaacagggagattagagagaaagagaagggtggaaagggagactgggagagagagggagacagagggagagagggagacagagggatagagggagacagaagcagagagagggcccatggagacacgctcctttccaagtctataagcttccttcctttgtttgcaagaaaatgtaaattatataggacttacacgtaggaatgctcttttgaaatccacctattccattcgtgcataattttgtacacttcccttggagtttggtatatgattggccacccagcaatgcaggaggtgcttaagggaccgaaagcgcctctttttttttttttttttgagacagagtcttgctgtgtctcccaggctggagtgcagtggcacaatgttggcttactgcaacctccgtctcccgggttcaagcgattctcctgcctcaccctcttgagtacctgggattacaagcatgcgtcaccatgcctaattttgtatttttagtagaggcggggtttctccatgttggtcaggctggtctccaactcctgacctcagatgatccgtccgccttggtctcccaaagtgctgggattacaggcgtgagccaccgagcctcgtcctaatttttgtatttttagtagagacagggttttgccatgttgaccaggttggtcctgaactcctgacctcaggcaatccgcccgcctcggcctcccaaagtgctgggattacaggcgtgagccaccactcccggctggaaagcacctcttaaacctgaattgggccgggcacagtggctcacgcctgtaatcccagcactttgggaggccaaggcgggcggattgcctgaggtcaggagtttgagaccagcctggccaacacagcaaaaccgtgtctaaactaaaaatacaaaaaattatccgggcgtggtggtgggcgcctgtagtcccagctactcgggaggctgaggcaggagaatggccggaacccgggaggcggagcttgcagtgagccgagatcgcgcccctgcactccagcctgggcgacagagcgagactccgtcttgggaaaaaaaaaaaaaaaggagatgggggcaggaataggcattatgccgggagcagaagggaatgctccctgtagttcagaaaacaaaaccaaacaaaacacactccaacacaaaaaaatgacctgagggcagtcaggatcgaaaagttgagaattttcacaatgttttgtatcctgttggactgtgtttcctgagagaatgataatgaagttttcaatagagggcttagaaatacaaaaattgtttcttgaatacaaatatgtttactaagttgccttaaatatattcatgtatttaaactttattttctgtacctcaatttggtcaccccaaaattaggtttagagtaattttttgagatatgctgtagtggagtgaggagaaaattcgtttggtgctgcctaagagctatcccaatgcagagctttgcaatgagactggaattccatgcaggaagggattctccagccaaacggggtttagaatatgcctcctcctagctcccatcattgctgcaaatctataggaatactgatcacacagagagaaaagaactaactggtagtgtcgccgcagactagagagtttggatgagaaaaggcgggcactgtagggtgcatagcaccgtggaaggaaacactcagtgatacgataatgacagaaagaataggcttgaagcaagtatatatgcaaacactgaaatttgcaggggttagaaattgccctgaaggaagaggtggacaactctgccagacactgggaagatcagtgcggaacacacggccaggatccagccagtcagaactgactcccccatcaatcacatctttgcagaaaaatctacaccagagcttgctagattcctaggttagtgaaaaagattttttcttttttttttttttttggtaactaacattgcaaagtaaacattatatcatgttcattatacataagtaatgatttcagctattgtttgaaatccatggtcaacatcaaaaagcctgtaggttctgttttctaaaactgataggacaagctaagaaaccttacccccatccccttatgcaatcttgaggagtcatgctcagaataaattagatgaaacacttagatgtattagatatgagtcatttctgcttctcaggttgaaagttttttgcatttaaactgtgagaccaagctgaagacaaaaactatctaaatatatcttaatattatgaaaactactattgatatgacaggatcaacctaggatcaacatgctcagaacatttattttaaatttcatgtaactttcttatttgtaatacatcgggcaggtgaatggttcaaaattcaggtacaataagacatacaatgacaagtaaatatttgacttttttttggtactattgagaggtgaaaatgtgctgcctgccctcgctcgctctcagtgcctcctcggcctcagcgtccgctctggccacacttgaggagcccttcagccggctgctgcactgtgggagcccctttctgggatggcctagactggagctggttccctctgcttacggggaggtgtggaggaagaggcgagggcgggaaccggggctgcccgcggcgcccatgggccagcgagggctcggcgggccctgcattcagagcagctggcaggcgccgcccgccccgggcagtgaggggcttagcacccgggccagcagctgcggaaggtgcgccgggtaccccagcactgccggcccacccaggccgcactccaattcttgccgggcctcagctgcctccccgcagggcagggttcaggccctacagcctgccatgcctgagtttcccctccgctgcgggctcctgcgcggcccgagcctgccctacgagcgctgtcccctgctccatggcgccgggtcccatcgactgcccaagggctgagaagtgcaggcgggcggcatgggactaacgggcagctccgcctgctgcctcgccacgggatccactaggcaaagtcaggcaggctcctgagtcaggtggggacttggagaattttatgtctggctggaggattgtctgtgagctaaccagcactctgtgtctagcttaaggttcgtgggtgtgccaatcagcactctgtatctagctaagctcgtggggacttggagaacatttatgtctagctagaagattctaaatgcaccaatcagcactctgtgtctagctcagggattgtaaatgcaccaatcagcaccctgtcaaaatggaccaatcagctttctgtaaaatggaccaatcagctctctgtaaattggaccaatcagctctctgtaaaatgggccaatcagcaggatgtgggaggggtaggataagggaataaaagcaggctgcctgagctaacactcccaacccactggtgttgccttccacatttaagaaagtttgttgtttcattctttgcagtaactcatgatggtgttaactgttggggtctgtactacgtttatcagctgtaacagtcactgctaaggtttgcagtttcctttctgttgccagcgggatcacgagtccaccgggagaaatgaacaactccagacgcgtggtcttaagagctgtaccactcaccatgaagctctgtggcttcacttctgaatccagggaggccacgaacccaccagaaggtagaaactgtgaacccgttcaaacatcagaaggaacgaactggacacgttgttcttaagaagtgtaacactgatcgtgagggtctgtggtttcattcatgaagtcagtgagacgaggaacccaccaattacagacacagtatgatgaaccaaaaaccccaacacttccctgccataaaacaggaatcaaatgaggccagtaacaaagacagtttgagtccagggcactgagtgaaggcactagatatgctgggactcatcattgctttggaacagggacaggatctgggtacgaagtttctaccgctcttgtggtggggagttgggttgggcatcactttcatacggcgagaggaaacggtggtgtcatctatgttagcactggctgcagtggagcttaaaaaacatgttgcaagctctcacatgggttcaagtctgaatttccactgctacgtggtctgaaaactgcaagcaggaatttacatttaaagcacatggagtctatagtatccccaggtacttcagagaagcaaatatcaatactccctcgaggagtaagtcttcaaacaaggcttccaagcaccccacagggttagtggcaccaacttttaactactgtaactaataaggagaagccaagggtacatatgaagaagttgtttatgagcatttgccaacaaaaaaagacctgcaaagacgtcagatactgtaagaacagaatacagaatataaaatgggtattcttaatatgtttcaatgagtaaaggcagaaataaggtgaagagtcaggatgaagggatcaccgaagatgagcagacaaatttgggcaaaactagaaatgtaaactataataattgaagtaaaaagaaaactcaatggaagggttaaaaaattgctggagatgagagaacaattagtaaactcagttattcaaaaattatactattacacaaagagatcaatacattaaaaatagaaaagtttaagagacaagtagaaaatccaccgtacatataatcagaatttgagaggcagattgttgaaaaaaaatgcaaggaataaatttttttttttttttttttttttgagatggtctcaccctgctgcccaggctggagtgcagtggtgtgatctcggctcactgcaagctgtgcctcccaggttcaagcggttctcctgcctcagcctcctgagtagctaggattacaggcacacgccaccacgcccagctaatttttgtatttttagtagagacagggtttcaccatattgtccaggctgggctcgatctcctgcctcggcatcccaaagtgctgggattacaggcgggagccactgcacctggccaaaatatttcaagaagtaatgaccagtgtttctggaatgaatgaaagacccaaatccatcgtgtgtctttcattccatttgatttctcatttggtttttctttttgcagctgggaagtttcagggttattggctcatcatagtaccaaatcatgacagatccaaagaaagacaaataaaagccagtcaatattaggacatattaacagtgcaacagcagaacaacataaacaataagggatcgtgaaagaagagacactttgccaccgggcgtggtaaataagcatatgtaaagatgatgtcaacatcttgtatcaccaagtattacaaatttttaaaaaaggaaatagcactacacacctattaaaaaggggagcaggcagggtgtggtggctcatgcctgtagtcctagcactttgggaggccgaggccggcaggtcacttgaggtcaggagtttgagaccagcctgcccaacatggagaaaccccgtctctactaaaaatacaaaagtattcgggcgtggtggcaggcacctgtaataccagctacctgagaggctgagtcaggagaatcgcttgaacccgggaggcggaggttgtggtgagctgagattgcgccactgcactgcagcctgggcaacaagagccaaactccgtctcaaaaaaaaaaaaaaaaaaaaaaaaaaagggtgagcatcccaaacaccaatgctggcaagaatgtgtagcaataggaactctgattcattgtgctgggagtggatgtactcataaaatggtactgataccatggagggcagttcggtggtttcctataaaactaaacattcttttactacatagtccggccattatgctccttggtatttacccaaatgaacacatcaatgtttatagtagccttatttgtaattgccaaagcttagaagcaactaagatgttgttccttaggttaaaaaagaaaagaaactgtggcacctccagacaataggatattatttagtgctaaaaataaataagctaccaagtgacaacaccacatggaggaatgttaactgcgtataaatgacagaaacaaaaaccaatccgaaaaggtgatgcactgcatgattccagtcatgtgatgcttcggaaaaggcaaaactatggaaatggtaaaaaggtcagtggttgccagaggttaaggataaagagagatgattaggtggagaacagaagatttttaggatagtgaaaccattttgtctgataatataatggtggatatgtgtgattatacatttgttaaaaaccatggaatgtacaaccctaagagagaaccctaatataaaccatgaaatttgaataataatgatgtatcattgcaggtctgtagatttgtcaaatatgcaccactgtcgtgggggatggtagtagtggggtaggttgtgtgtgtatagggaccaagggtatatgagaactctctgtactttctgatcaattttgatgtgaagctaaaactggtctaaaaaataaagtttattaaattacaaaaatctaacagggttaaaaggaaatgggaaaattaatttaaaaatgtatatgggccaggcgcggtggctcatgcctgtaatcctagcactttgggaagctgacacgggcgaatcatgaggtgaagagatcgagatcatcctggccaacatggtgaaaccctgtctctactaaaaatgcaaaaattagccaggcgtgctgcaaggtgcctgtagtcccagctactcgggaggctgaggcaggagaatcacttgaacccgggaggcagaggttgcagtgagccgagatcgcaccaccgcactccagcctgggtgacagaatgaaactccatcttagaaaaaaaaaagaaagaaaaaacatgtatatggcagcataaatatcaagaacaaatgggagaaactcttcaagtggaatgaggtgggaacatatccttcctcagacatcaagacgcattataatccatagactataagacagtggcactagcacaacaatagaccaacagagaaaagaaatttgttagattgtctggaaataacacagtgaaagtgtggaggtttgataagtggtgaaattatcctgtatgtgaatggggataatatgcgctagtccattgaattaatcgtctctctctgactgtttctccctctcactttctttctgtgtgtgtgtgtgtgtgcatacatgagtgtgtgtgcatgcgtgtttgatggggacaggaggcagggaaacgctgggtagaagaaggtggttcttcagcaaaggccccaccttcaagcctggaaactgtggctctaaatgaaaacagttatctctgttttcccgtccaattgttgctttattcaaaaccaccctggcccgccaccctcatgcccctccccccctgaccccgcatcctgtactcataaaacccccaaaccccaggttcaatgagcaggagggcggcacagcagcagagcagcagagcggcagagtggagaaggagagaagagaagtgtctgaacatggggaggagtttggctgggggcggtcatagaagagattcgccatgagatggctgaactccaggggacaatcatcttcccactccatcccctctccacctccccatcccactgagagccacctccacctctcaatgaaatccctgcattcaccattcttcaagtccatgtgacctgattcttcctggaagctagacaggaattcaggattcctgtaccaattccattgggtacaggaaccaaaaagactgtcacgttgactcttcactgagctgttaaacactttagctttccctgggtggcagggctaaaggacattgtaatacccctagccactgctggggggtcagagcccaaatgtgctcaccccagctcacctgtgtgctctccctcccttaaagggtttgaacacgcaccagccgaataaatgagccacatgccatcacatgttccgcgaggggtcagagaactctcctgtttcatgttgacggatgttgtaagcattaatggttttaaatgcaaaaggaaaactcggaaatgttaaagatagtatagaataatttcattatggcctttgaataggaaagtatttctgaaacagcatgtaagatgtacaagccacaaaaacatcttgataaatttgactacattaaaattaaaaacttcttttaatcgaaagatacaataaaaaaagcataagtgatacacatgcagggaaaataatttttttctttttttttttgtgatggagttttgctcttgttgcccacgctggagtacaatggtacgatctcggctcaccgcaacctccctgtcctgggttcaagcgattctccagcctcagcctcccgagtaacggggattacaggcatgcgccaccacacccagctaattttgtatttttagtagagacaaggtttctccatgttggtcaggctggtctcgaactcctgacctcaggtgatccacccgccttggcctcccaaagtgctgggattacaggcaaaagctaccatgcctggcctaattttaaaaaatacatgaaattaatgaagcattatgatccagaatatataaaagtataatatatcagtaaatcaacaaaaatggggaaaagatgtgaaaaaatttcacagtagaggaaataacctgttagaaaaatctgtaaaaggtactaacaagtactttacagaacaggaatataagtggccagtagatatatataaaaagattctcaattcgtaataatcagtaaaaggcaatttaatatttaatgaaatctcatgatacacctaatacataggtaaatatgaccaggatatagaacaaggatgtccctggggcagttgctaagagtgtgaattggtgcaatgactttcaaaatcaatttggcattatcttgtaaactgaatgtgagtatgcccaattctagtatgtgctgtaggaaaaatgtctacccctttgcacaaggaatcatacaaaataatgtttctaggagcattgttaataatagcaaaagacaagaacaaaaccttgcaagtaaccaaatgtctattgggtctatttgtgggaaaatggataaagaaattgaggtttattcatgaattggacactatataatggtgaaaatgaataaacttgaattacacatgtcagggtgatcgaaactcagaaagttaatacattgtggaagcaagttgtggaaagatatgcagcatgatactgtattataaattcaaagccaagcacactaggcagtgtattaacagctgtgcaacacgtatgtgaatggaactcttggagaaaacccagggccagggatgaagtaacagaagcgaacaggagcttcagagataacagtgacgttccatgtcttagtgtgggtgaaggggtcaatggtgtttgtttcatgaaaatctatctctatctgctatctgtctgtctgtctgtctatctatctatctctctatctatctatcttctatctaatcttatctatccatcctatctacagatgtatatgtttgtgtgtatataaatatacatctgtcacaaacattctcttatgtgtatcaaatattttcataataaaaacatttacaaaatctcctactctttctagtcctgttattccatagtttccccttctgtgtcttgttttgtaaacttaatgtgtgggccaggtgcagtggctcacgcctatattcccagcactttgggaggctgaagcgggtggatcacctgaggtcaggagttcgagagcagcctggtccaacatggtgaaaccctgtctctactaaaaatacaaaaattagctgggtgtggttgtgggtgcctgtaatcccagctactcaggaggctgaggcaggagaatcacttgaacttgggaggctgaggttgcagtgagctgaggtggcaccactgcactccagcctgggggacaaagtgagactccatctcaaacaaaaataaaaaaagaaaataaaaaaataaacttaatgtgtggatgttgttccttcccagtatacattattttcctccagctttatttaggtataattgataaattaaaattatatatattcaagtaatacaatatggtaatttgagatatgtttacattgtgaaatgaccacagtcaagttatttaacaatcatcatcacacatagttacctctgtgtgtgtgtgtgtgtgtgtgtgtgtgtgtattatgtgtatgtggttaggacacctaagatctactgtctcagacaatttcaagtattcactgcctccttgtatatatggatgcagtgtatacttgaaattgtctaagagagtagaagctttttatcttctgtctttctttttcttttttttgagacggagtctctctctgtcgcccaggctgaagtgcagtggtgtgatctcggctcactgcaacctccgcctcccaggttcatgccattctcctgcctcagcctccgagtagctgggactcaacgcccggctaattttttgtatttgtagtagagacggggtttcaccgtgttagccaggatggtctctatctcctgacctcttgatccggacccttctgctgttaaagcttgaaacttgtattcattttatctgagttaggtcctcaggaaagaaccttcagtcctctcaaaaaaaagtgtcgaagaactgaaactcaccagatcatatgccttcttgttttcttacacattgttatatttatttcctgctgtataaatccctagttgtagtcagtcagggagaggatttgagactgagctcccatctccttggctgcagcatcccattaaaaacttcttccttggcaatacttgttgattggctttctgtgcagtgagaacaggacctagaccaaatccctggtgttttggcaacaaaatgatgtgtaaaatctctatgcagatagctataaaacattgctcagagaaagaaatactgcacaattttaggtttttttttttttttagatggagtcttgctctgtcgcccaggctggagtacattggtgcaatctcagctcattgcaacccctttctcccaggttcaagcaattctcctgtctcagccatgcaagtagctgggattacaggctcccactatcatgcctggctaatttttgtatttttagtacagatggggttttaccatgttggccaggctgatcttgaactcctgacctcaagtgacccacccaccttggcctcccgaagtgctgagattacaggtatgagccacctcccccagccaggtctttcttaattaattcaaggtggactatatatccaaacataattgctaaaactataaagcttttcaaagaaagcataggagaatatctttgttaccttttagtaggcaaagattgcttacacagaacttgggaagcacacacacacacacacacacacacaaacccagataaattagacttatttggcatgtaattatttactttgaatcatagtacatttatgtactgtaacggaaaagggtctattgtctattcctgaggcactaacttccctttcttatggacgtttaagtctgcaagtgaattttgtatttttcaaaagctattttaaacctttatgcttttccacactaaccctacctttaacccactttcctctgttaatttttttcacttaatgtgtcctagtgattgttcatattactacataaaatttctttgttttcttttttttttttttttttttttgttgagacagggtctctccgtcacccaggctgaagtgcaggaccttggctcaccacaacctccaccttccagttcaagccatcctcttatctcagcctcctaagtagccgggactacaggtgtgcacaaccacgtcgaactaattttttgtatttttggtagagacagggttttgctgtgttgcccaggctggtcttgaactcctgacttcaagcgagctgcccacgtcagcctcccgaagtgagccactgcgcctggtctagtacataaaatttctgtatttgttagttttaattttttcaaagttgtaaatgtacatatttcaaagcctcaagtagttctataaggattaatatgtaaaactgtactactatatttggccaggcatgatggctcacgcctgtaatcccagcactttgggaggctgaggcaggcggatcgtgaggtcaagagattgagaccatcctggccaagatggtgaaaccccgtctctactaaaaatacaaaacattagccaggtgtggtcgtgggcgcctgtaatctcagctacttgggaggctgaggcaggagaattgcttgaacccgggaggcagaggttgcagtgaattgagattgcgccattgcactctagcctgggcaaaaagagagaaactctgtcttaaaaaaaaaaaattaaattgtactatattcatctccttctagttcttattcttcagagacaataattaagctcacatagcttttcttttggtatttaatgtaatcgcatgattttaacgactatactgctagttctgtattttgttgttgttattgagtcctaagcttaactactgacttctcactagatcaaatttattttatttcatcacatttcacatacatttacacattttcatgtaccattctaccaatttacttatatttgttagataagtattcaatatttgtattatgactatataagcatgatttacactacagatatgtagaatatggactttaactctcccaaaagagggctgctaataatttctcccatctttatatgtgtaaagtctattctttcccacatgaatctggactgatcttgtgactagctttttctcagtagaatgtggcagctctaagccttgtccctcagagtcatggcaacttccatgttctgtctttgggagacttatgacagcttgtaagaagtctgactattatcctggacagagaagcccagtcagtcctcagccatgctagctaccacttcagccagggcaccagacaatatgagtggagtggggttttgatggagagctttttcgtgattcacattcctcctttttttttttctttttttcttggactaaggaattcttttttggattgaaagtctaaaatccttgtaactttcatattttattttgtacttcttagaatcatgctctactttttgggagatctaaattttaatttttaattaatttctcggttaagtttttaattacagacatcatatttttctctttttctccaaaataattctcctcttcctccttatccttctagacctatttttctttcagggatgccatatatccttttatttctctgtggacattagtgactattttacagagttttggcttcctgcatagtctcaattttctccaagttacttattattgtttgtttgttctattctatttttaaggtgagaggctgtcttcagttgcctagagacacatggttgtctgctcataattaagattggggtattagtggctgggcgcagtggctcacgcctgtaatctcagcactttgggaggctgagggaggtggatcacctgaggtaaagagactgacaccatcctggccaacacagtgaaaccctttctctactaaaaatgcaaaaattagccgggcctgatggcgcacctgtagtcccagctacttggggaggctgaggcaagagaatcacttgaacctaggaggcagaagttgcagtgagccaagattgcactattgcactccagcctggcgacagagcaagactccattccccccacccctcctaaaaaaaaaagattggggtattagcaaattgattgggcaaggcttaagcctagccccattgcagagagatttagtcaggctgacttgttgaagcctcactatgccagtctctaaattttcttccttggataggtcagatttctcagagaagtagcttcttgtctgcttggaggacaagatcctggatatcaggcaggcattctgcatatcaggtgggggaagaaggctggatacgtgaaattctgtatgtgagcaaaatccagtgtgatccctttctgttaatgtggcatctcaggtcttgtctggtgatcctctgatctacagagaagaaacctccatccagccttctgttggatgacgtgagccaattgctcaaacagaccttcagcttcttggaaacaatcctgtgtttaattgcacttcctaagattcctggagccaaaaattactgagccttttgggaattctgcaagctggttacttctggccttttcctaccactggcttagtatttattatgttcggatttgctcatttaaatattacttccttttttcctttcagaattttggtgctttttatttcttttccaggtttttgttcttgtggggttttatcttcaaaataatccctctgtatcatttcatggtatttttggaaagatttggtatttagacaactatcataaaatgaagtcacctttgtttaatggccttataaaaacattatgctgtgaatatataagaatttacttatccagtcaaatattttgtttttttaagtatgttgttagacaattagaaaatgtcccagttgaagactaagaaatgctatttcaaatttgtgtttattttactatgtgaaccttgagcatatttttattagtttagaaaacatttgtttttcttcacttgatcttagccaaaaggctgagaagaaatgacatttgtttttctttaatgtgaactacctatcatgctttttccctcatttttctgttgaaattttggtgtttctcttctgaaattttatgtcatgtgctattagtaacacataattcctttaggctgactctgagcacactgcctatgagttaacctgctctgcaaggagcagcactgttcagtcaaagctgctgtctaggccgggcgcggtggctcacgcctgtaatcccagcacattgggagcccaagacaggcggatcacctgaggtcacgagttcgagacctgcctggccacatggtgaaaccctactaaaaatatgaaaaaattagccgggcgaggtggcgggcacctgtagtcccagctacttgggagcctgaggcaggcgaatcattggaacccgggaggcaaagcttgcagtgagccgacatcgcatcattgcactccagcctgggcgacagaacgagactccgtctcaaaaaaaaaaaaaaagcctgctgtctgacaccaaaacaatggacatattacagtttggttttggtcttttggcttcacttatgttgtatgcttctgtgtgtttgtaaagtagaactctaataaaatttacttttaacttcttcaaactgaatatttattggatgagaaaattataatatcacttgaaaacgttgtaatgtttcaatagttttcaattttgtctccatattaaaaatgttttctaataacactcctaacatattctgaaataagacatcaataaggagcacacgatcttgtgaacactcatgacgtgatgcaccagcccgttcccttgtctgccccagcttcatgccactgctcctcagtctcctcctcaccccccaggggctcccctctttccgcctttcaggtcctctcagctctttcagaggcgcagagtggtgtagaatgaagattctgtgggggagtcataacttagagtcttccacttgaaacccaaacgaagaagtgtggggagagaaggctggggacagattactggagattgccagtaccctagagtcagggggagcaagaggagcccctgggagatactgaaaaggaatgattacagcagtcagaaaaaaagttgtcaagacagcaccacagaaattaaaaagaagagagttgactgggcgcagtggctcatgtctgtaatcccagcactttgggaggctgaggtgggcagatcacgaggtcaggagatcgagatcatcctgggcaacatggtgaaactctgtctgtactaaatataccaaaattagttgggcatggtggcgtgtgcctgtagtcccagctacttgggaggctgaggtaggagaatcacttgaacccaggaggcagaggtttcagtgagccaagatcacaccactgcactccagcgtggcaacagagtgagactccatctccaaaataaataaaaaataataataaaataaaaagaagagagtttttagaagaatagttggaagaactaacagttttagagatatcagataataataccaccagcagtagtctgctggagaattctatcctgatcagaggagggtcattccttttgttctaaccgggccttcacctgattggatggggtccacctacagtctaaaggataatcctcagagtttattgatttaatggtaatctcaggcaaaaccaccttccaaatagacacacaaaattaactgtcatggagtggtagagaaaaaatgtaccttttcagtgagatgaatagagaaagaaaggggaatggtgcaataaatgagatgatcaattggggaattaagtggactagagaaaaaaacaatactatgccagaagtttttcttttttattattttgttttttaaagatgaatgaaacataagcatgttgttttgctggggagacgcattagcagagatgaagagcaggaaggttttcagggtcgtagtgtcggctgtcacttctgagcctcaattttcgcagattctcacaagaacttctggccctgattcatggatttttgctagctatatctactagtatctcccaccattccatatgcaatacagttaagtttattttttccatttccctttatcaaaaccttcccctaatttcacctttcacatgtctgtcagtgacgtcagtaaacgtccaaaggtctatgaccttgcagaagaaatcacaaacgcacgcgtgaacatgaactgtttccccttaagaactctaccttgttattagccgaccgtggtggcggccgcctgtagtcccagctactcgggaggctgaggcaggagaatggcatgaacccgggaggcggagcttgcagtgagccgagatcgcgccactgcactccagcctgctgggcgacagagcgagactccgtctcaaaaaaaaaaaaaaaaaaaaaaaaaaaaaagaactctgccttgttgattgtacatacttactggaatcttttattttttattaccaggatttgcggtcgcaggtcttttttcctgatcacagtattgatatatcatgagaaccatcaggatagctccctaaggaaaggtttctcaggaggttttgcagagggggagtgattttcatgattcttagcagttcttgaagagagaatgcagaatctcagctccggtattccatggaatctctgttgttttattcgcagagtcgctttgcccatttttcctccttgcatttattagagagaaaggcatctggttatcaccattggcctaaaaagatttagtaattaaggatcttcttaaaattcgcattctatagcattaagatacacagatgagaaggtgtttcatggaaaataaactttgcaagcaaaatataaaaacccatttatagtaggaagaattgtgagtcagctagctatctcaacccttcaaggcacacagagcaccacagaagtgaattacactgaattatccaatatttgaatcttgccgctgattgaaaaatggtaatttttacaacaaaattgactaaataaagtgttgctccatttgtacactggagaatatacagctattatagaaaaggtggaacatctatagagatgctcgtcagccaacagtgggattacttctcagtaaatccattataaattggaaatactgtaagtcaaaaatgcattaggtacccccaagtaacctgacttgatcactacacattctccgcacataacaaagtatcacacgagccccataaatatgtacaaatattatgtatcaataaaaaaatgcctttaatacccctagcctcctgaacatcagcgcttagcctaccttaagtgtgctctgaacactcacagcagctacatctgggcagaagcatctggcaacacagtgcactgcagagtactggctccttacccaggtcatcacatggctgacagggagctgtggctcgttgccaccacacagcattgagagagtattctgcctctttctactgaagcatattgcttttgcatcatcttaaagtcacaaaactgtaagtcaaaccatcatgtcagggaatgtctgcacacattgataaagaaattttcccagggccaagcgtggtggctcacgcctgtaatcccagcactttgggaggcccaggtgggcaggtcaccagttcaggagatcgagaccatcctggccaacatggtgaaacctcgtctctactaaaaaaaaaaaaaaaaaaaaaaatacaaaaattatctgggcatggcagtgcatgcctgtagcctgtattcccagctacttgggaggctgaggcagaagaatcgcttgaacccaggaggcagagcttgcagtgagctgagatcgtgccactgcactccagcctggtgacagagcgagactctgtctaaaaagaaagaaagaaagaaaaatttccaatatccactggaatataaaatgtgcaaaaggcaaaagtacatggtataatatactccatgtactggaaaaatatgttcatacattgaaaagagatttctgaaaaaatgtcctagaaactggcagcagcgcttgtctccaagtagagggaactaggtggctgggatgtggagaaaggcaggaaatctacttttccttatatgtgctttggattttttgaattatgtacattttaaaacatgtacttccagtacatgttttaaaaggaatgaaaattttcattatcaattttggggaagaaaagcaaagaagcagcagagacacaggggcaagaacataaggtagtttgcgaaaggtgggattgtgacgtgctggacctccagcatccgtagtgatggtcacccacacgaataaggcgggcctggtctgggctccaagccagaagtaaaggctgtcactgagccaaatcctttagaggccattcaaaacttccctttatgtagcggcacagtacctgagatacaacctgtcctctatgaatgccattttcacctaatgactgctgtgaagaagagtctagtgatcttctagaagagtctacagcttacagtggcctgcaatgctggctatgcaacaggctgtcctgtgatgtcttaacaatatagcactgtgcggtccctccctggaattaataatcaaagtttccagagctgaggtccaaaaaccactggattgcagtttttaacaggcaggtaggtagcaggcaaggagaaggggttggcttagtaccaggaaaattaaatgaagaaagtgaggcatctactctaaaattggatccttctttcctgacctgccttcagctcgggactatgaacacagtctctgaagagccctatgtgcttcttgccagaacatttttctgaaaaaataataatagctgccattcattgagcacatgttttattccagcactgagcaaggagttttagattgctgactttcattctcacagtgcctcagcgaggaaggcatatctgttttacagataagcatcgcaagctgagaaaagtaagataactgcccgaagtcaggagagcagtggatctctgtattaattactctgctggactgcctttaagtttcagagacttgcgagctcagaggaaatcccggactctaggaatcgggtagggggattggatttggagggcccaggaagctggctgcatgccgcgtgctcgggggtgctctctgccagagcctgaagccttgagctccacttctgcacggcagcatctcagactccagggccgtgctcacctttgcacaacacctttactttcacattagtgctttgcccttacaggggtcggctaggctagcagagagattagggatgtttactggggagagaagcacatgatcacagttaagaggcttaagttacattcccctccagttcctacccactcacattgagatgtgagagggtcagggaagtgctgggtagagaaaggtgggtccctggctaggggtccaccctcaggcctgtgcccacagacctaggtgaggacaggcactcctgtcttcgtgcccaaatactgcattttccaagaccaccctggcccactacggccccgacctgtgcctataaaaaccctgagaccctagcaggcacagacacaacccactggactttgagaggaacatgcccgtgttagagtacacaggcagctggacgtccagaggagcagagtggggaagaacacgctggcaggccatcagccggcggagatggggggccgaggggaatctggccggggccgttggaggggagtccggccacccagcggcccgactaaaagggaaaatcaccttctaaatccatccccttccccctccccacccacctgctgagtgctacttcctccactcaatcccactccatccccttcccactccccacccacctgctgagagctactacctccattcaatcccaccccatccccttctcactccccacccacctgatgagagctacttcctccattcaatcccaccccatccccttcccactccccacccacctgatgagagctacttcctccattcaatcccactccatccccttcccactccccacccacctgctgagagctacttcctccattcaatcccactccatccccttctcactccccacccacctgatgagagctacttcctccattcaatcccactccatccccttcccactccccacccacctgatgagagctacttcctccattcaatcccactccatccccttcccactccccacccacctgctgagagctacttcctccattcaatcccactccacccccttctcactccccacccacctgctgagagctacttcctccattcaatcccactccatccccttctcactccccacccacctgctgagagctacttcctccattcaatcccactccatccccttccccctccccacccacctgctgagagctacctccaacattcaatcagaccttgcactcattctccaagcccacgtgtgatctgatttttctggtacaccaaggcaagaacccagggtacagaaagccgcctgtccttgcaataaggcagaagatctaatcgagctgatgaacacgacacctacagatgacgaaagctgagagcaccctgtaacacacgcccactggggcctcaggagctgtaagcattcacccctagacactgccatggggttggagccccacgacctgcccgtctgcatgctccccatacaggtctgagcagcagggaactgaagtcagccactccccgtgttgcacgccatgtgagggggacaagggaacttgtcccgtttcaacatgaggaaaactctagaattagtccatttgaaaaattgaggccgtggtgcctggcgcagtggctcacacctgtaatcccagcactttgggaggctgaggcaggtggaacatgaggtcaggagatggagaccatcctgaccaacatggtgaaaccccgtctctactaaaatacaaaaaattagccaggtgtggtggcgggtgcctgtggtcccagctactcgggaggctgaggcaggagaatcacttgaacccgggaggcggagcttgcagtgagccgagattgtgccactgcactccagcctgggcaacagagtgactccatctaaaaaaaaaagaaaaagaaaaagaaaaattgaggctgtatctcctcaccatctctgacagccctgctctccttggtcccctctcaggaagcccatgcatcaggacccccaccctccagaggtgttctgcccatccctcctcacacagctccccactttcccaactcgccactatgaccccagacagtccattgtttggtgcacaatttatcttaaacttttgaaatcttcactgaatatttttttttctatcctcttgctttaactaaaacttggatatccactgagcacagtgattgcctataattctttttttttttttttgagttggagttttgctcttgttgcccaggctggaatggaatggcgtgatctcggctcacagcaacctccacctcctgggttctcctgcctcagcctcctgagtagcagctgggaatacaggtgtccacaaccatgccctgataatttttgtatttttggtagagacggggtttcgtcatgttagccaggctggtcttgaactcctgacctcaggtgattcacctgccttggcctcccaaagttctgggattagaagtgtgagccaccgtgctcagccagttgcctataattctttagattgaagcagcttattatttcacaaactaaaaacttcagagtggctactttcataaaattgttctgctgcctgagcgtgaggcccgttccttttgaggctcacagcctccaggaagcctgcctgtaacttccctcatgctcatccaggactccttgccattctacactactcactggagatttaaaagccagggtcacttttttctccaccctgaaccctgttgcatcatccgaaatgacttcagtgttcatggggttgccacattatgcacccgaatttctaagttccttggcctccttatcttgagagacaatggatttcatttcatttcagccacggcttcccactggactttgccataagaaactgtactatgaaatctgaagtttaagttactgtgttcacaatttatcactccgaaaactctcctattatatctcaaaactctgtcatgcccaaatccctgtctgttataaattaaatgtctaccttttctgccttttcaaatgggaggatcagaggtactggtaaagaatttcacagctttagagatgagtgccgctctgtaactgcatggtatctaagctcgataatcaggagtccctgtctccttagccaccttgatctcattctcatcaggagatacttcagacattttctattctcttctgaccaccaagctcatttcatcccctgcagttaaccttgcagacacagaaaaggattgcccacgctgttctcactcccacaaaatcagccctgcagaagaatccctatccacgcccaccctttcccttttctccccttacagtgacacggcatataaagctaatgctttctacttcattatatttttttaaagcctgtgctctgaattgtatttccttccactaactcagtaagtgtagtcttaatgatgacatctccctgctatgttttcaacctttgcttactcatcagcatgaaagcgtatttatttccttcccaacttgaaaaaacaaaactccggttccttggcttcatacacctttttaaagtgttgtctatttagttgtaactgttgtctccatcatcccattaaactgttttcccaaagaatgaaaacctacttgttgctgggtccaaccctttaaaagctttacttctatttttactctatcttaacagctaaattgttttgaattcctagacaccactgctgtctctacaccacaccaagctctcaggctatacttctccatcttctttctaggcatctctttctctaatatatatatatatatattttctctaatatataaatatatatatatatatatatattttttttttttttttttttgagatagagtcttgctctgtcgcccaggctggagtgcagtggcatgatcttggctcactgcaaactcctcctcccgggttcgagcgattctcctgcctcagcctcccgagtagttgggattacaggcacgcgccaccatgcccagataatttttctatttttggtagagacgggttttcaccatgttggccaggatggttgcgatctcttgaccttgtgatccgcccgccttggcctcccaaaatgcttggattacaggcatgagccaccgcgcctggcctttctctgttctttaaaagctgttcttcaggttttggtttcagcacatcaatctcctttctttactgcattaaacaaagtttatggggggccgttgttgggactgcgctcctacactgggccccacagacccgtccaagccacataatcaagctgaacttcaaaaccgtcggctttccaaaaacaggagacttgcagccaccaatcagaaggggcccagttgacctgagccggcctggtaaacaagtaccctttgctttaaccttatgagaaaagtaacttttgaaattagcagtctgctttcatcccagtttctgccttcctcagtccttctctgcctataaagctaaacccacacgttcagctcatcacagcacccacgctattttgtaaaatgagatggtgtctggtcctataatagctaataatagccaattaaatttcaactaaatttgttgttaatttttttaacaaccaatttatttttatggcttcaatttcatcgctcccaaatcattttctgtaactaagtcctttctcctgaacttcaatcctacatatccagcaagtcctgtagacttcctcccaggaacctccaactaaatgttgcaaaatattaacttacagtcttttccctctagcctgtctttcttttttttttttcctttgttttttaatccattttttagctttattgaggtataattgacaaattaaaatcgtgtatatttaaggcgtacaacatattttgacataatacacactgaggtaatcactacaatcaagttaattagcatatttaccccactagcctttctttttcctcttctaatacagatgaatgacatcaccaacaatccagtttccaaagccaaaaattcttcttctcttacattatatctaattcattctgaaaatttgaaaattcagtctctgaagctgctcttaaaagaattcccttcctagtcaggcatgatggcaagagcctgcagtccaagttactttggaggctaaggcaggagaatcccttgagcctagagttcaagtccagcctgggcaacatagcaagacagttactgaaacacttcagcctctgtgtaggtcctgctgctcgccacacagaaagtcaatgactgagacgatgagtattgccaaggaagatggctttaatctttgctgcagccaagaagatggaactcagtctcaaatccatctccctgtggtactaaaaccagaggtttttatagcagggaagaaatgtaacagtgcgtaagaaaacaggaaccagggaggggcaaggaagccatcatgatgaatgaggcgttcagcatctcattggatgtgctgatctggtgactttcagttctttgatactctttttttgagaggcctgaaggtcttttcctgagggataaactcagaaaaaaaatatgttaataagtttcaagctttaagaccacgcgggtcaatttctgtgtttatataaaaaaaatgtctatgagacaattgggtcagtttcaaaaccacatctctaaaaaacaaataaatacatgaataagaaaagaatttcctttctgtctaactgcactgtcatttccctgacctaactatggtcatttctcaactggatcattacattaatttccaagttggttttgcttccagtcattctcattccaattcattctctagaattttcaaaaattaagtcttatagatgaatttcttccctataaattttcaatggcttcttaaagaggtcccatatctcatgatccatcagcctgtatcttgagaggccatattgcactatcttactgcttctatctatacacacacacactctctctctcattccacacttcacccatattggataattcatgttctcttttgatgtcaacccttttgctcatgtctcatttgctcagaaaacttccctgtttgtcctatgcctcttctcttgcctccaatacactgccttgtctgaatggggtcatcttttaatcaccctttagcctcctctcagacacctttttacctgaaaccttcctagaatctgtaccaataatattaattcaagtggagtctgctctttctcataatcactactcacaccgtcaccatggccactccacaaaatacactggggtggagcggtgggatggggagtgaatttaatttggaacattaggtgtctgaagtacccttgtttatctatgaataaatttatagatataacggtctgaagcttgaagagatctgggattgagatacagatttgagaatttttggaatatagatgagaactaaaaccattggaggggatgagatatttggagagtgtgtgcagaatgggaagaggcgagaagagaagacagaagaggagaagggaggataggaagcaggacagaacactgagcgtgaggagggttcgttggccccacccaggtacgtggttggttctttggataaccagcattctgatctcttggataattacatctttccccattgtgttcagccttggtgtatcaaaaatcaattgctgtgccctgctgtagctgaggaatgtgattaaaatctcctagatcattttgtcttgagtagagtagcacaaggacaggaaaaggcacaatagttgtagagtatttattttagatcaggaaaactgttgaggctctcgcatgagttcttgctgctcagattcctgaggcttcatggtttcccatcctcttataaataattctacttcttttttttttttttttttgagacggagtcttgctctgtcgcccaggctggagtgcagtggcgggatctcggctcactgcaagctctgcctcccgggttcacgccattctcctgcctcagcctcccaagtagctgggactacaggcacccaccaccacgcccggctaattttttgtattttcagtagagacgggttttccccgtgttagccaggatggtctcgatctcctgaccttgtgatccgcctgcctcggcctcccaaagtgctgggattacaggcgtgagccaccgcgcccggcccataattctgcttcttaagccttcccttacagccagggagttacagatatggttccaacaaagtcctttcctgcttagaatgccggagccagcttttttcttttttcttgccttgcaagaactcagttacactaaggaaaaacgacattcatgcgatgttagatactaggaggaaactccaaatgagatagaacagcttctaagggtgccattcaagatgtttcaagaaccaaagaattgatgtcaaaaggaaaacgagtatttcaagatgaaagtcattattaatagagtggtttaaatattttactagttttattaaataaattaatgaaaaatataaaattaaattaaatttaaagttatatctcacttgtatttttagttactcatcaatttttgttttttaattgtgttcttatagattgttttgtatttttcttttctaaccttttaatgtatgactatttttattcgtattttctatgctagtaatgaaagcatttaaagtgtattttaaaaaataaagctaattcattccatcattttagtatttgttattgctcctttaaatatattcttttattttagttttgatttcatctttgacccaggagatccttaagagtgagttttgaaaatattaatgtataggaacaggaaacgaaacaccacacattctctcttattagtgggagctgaatgaagaggacacaaggtggggacaacacacactgaggcctgtgggggtgtgtgggtggagggagagcatcaggaagaatagctaatggaggctgggcttcctaccttggtgatgggatgatccgagcagcaaagcaccatggcacatgtctacccatgccacaaacctgcacatcctgcacatgcacccctgaacttacacaaaataaaagttgaagaaaaaaaaaaacaaaacaaatttaacatatttggccagttctattttatcttctaggaatagtttctccttttttgtattatggttaaagaatgtggttatttatttcattttggaaattatcaaagtcatgtttttatatgtaatttcagatacactttaaaataaatgttctgcagacacttgttttcagcttacagaattgaacagacacaaacataaacaaagtctttttcattataatatttagtcagttgtatccattatttctggtctctttgatctgttacagaactggatgagtgtgttgaaatttcttaggatggttacatttccattgattcctgcagttttactttagtgtgggagatgaaaaagtaaagattcatgagagttacgttctccactgtgaattatgctccttataaattacaaagtgcccttctcattttcttttcatttgccttgaatccaatgtggtctagtatcagcagccgaactgcggtttgtttccgtgtttaatcgtctgcaatgtattgttgactagcgtttacatgctgccctgctttgtcccttccttctaggcagaatatttttttactgcttcgtcccttccttctaggcagaatatttttttactatagcttttttaaaaaaaatacgaaacttgttcccccttttttaaaaaggtgagtttatctacttaaccttatagttatgtttggatttaatttagctttattagattttctctttttaatgactgctgtttggaaaccgcctggttacttgatagccagggcatcactgaggtcattctttaacccttctcattaccatagtacttaaaattatcaccatcattttaaagaataaacaacatgataatctctgtctctctctttgtgtatatatatgtgtgtgtgtgcatgtatatatatactttctctatatattcatatagatagtctacctattgacacaacatgaatacactatagatgtgtgtgtgcgtgtgtcagtgtatgtttgtatttcatatttataacatcccaacatgacacatgctttttacttaggtacacatgttaacatagttttagagatgagaaattgaggagaagcaaaattaagaaacctgttccaatgtaacctggcaagttggcagatctggcatattaattaatgcattatgtgctattactttcgcggcctctgagcactttttttttttttttttttttttgagacggagtctcactctgttaccaggctggagtgcagtggcgcaatcttggctcactgcaacttccgcctcctgggttcaagtgattctcgtgcctcagcctcccgagtagctgggatacagctggccaacatggtgaaacccatctctactaaaaatacgaaaaattagccaggcatagaggtgcatgcttgtaatcccagctactcgggaggctgaggcaggaggatagcttgaaccaaggaggtggagtttgcagtgacccgagatagtgccattgcactccagcctgggcaacaagagtgaaattccatctcaaaaaaaaaaaaaaggagattttatttttagaacaattttagatttacagaaaaatagagagatgcagagttctcataccctgcacctggtttctcctattatcaacctcttaacctttgttacaattaataaaccaattttgatacattaaagcagttccttgaataacatgtttttcccaatgttagtttgttacaatgttaatttttttttttttttttttttttgagatggagtctggctcttgttggccaggctggagtgcagtgagcagcataatctcggctcactgcaacctctgtctcccgggttccagcaattctcctgcctcagcctcctgattagctgggattataggggcccaccaccactcctggctaattaatttttgtacttttagtagagacagggttttgccatgttggccaggctggtctcgaactcctgacctcaggtaaaccacccaccttggcctcccaaagtgctgggattacaggtgtgagccacagcgcctggcctacaatgttaattttttaaaagtggcttcccagcaaggtcacctgtgtggagtttacaggttatccccatgtctgtgtggattttcttcaggttctcacggttcttccagttcccaaagctgtgctcattgggttcaccagcacgtctccatggtactggggtgagtgagtgtgggtgagtgcgggtgtgggagagtgagtgtggatgggtgagggcgagtgtgggtgaatgagggtgagtgagagtgtggctgagtgaatgtaagtgaatcagggtgagtgtgagtgtgagggagtgaatgtgagtgaatatgagtgagggagggtgagtggatgagtgtgggtgggtgtgagtgagtgaatgtgagtggtgggtgagtgtggatgtgagggtgagtgtggatgtgagggtgagtggatgagtgtgggtgagtgtgagtgagtgaaagtgagtggtgggtgagtgtggatgtgagggtgagagtgaatgtgagggtgagtgtgaatttgggtgagggtgtcatcttgccctgggagagcgtcctggccaggaagggtcctgcctggcaccctgagctgcagggatgggctgtggccacccgcgatcctgaactggataagcaggtaagtcattatctcacttgtttttattaatctttcttaaatgtacatctagctgacatttatttcaatgtttaatatgagaactgttttggtctttacttagaagttcagtcatgtttctgtgaccagaaatacactacaggaacttcaccctggtctgtggcattagcctacgggaaaatttgttttgttacagtaatttagcttcaaatcacagtttccacgaacctatggccaaggtggacttaccttagagaggatttgcatgtgtggttactgagagctgctgcgcatgaggaactgggccagattccatggggatggcaaaaatggatcaagaaataattctgttctccagctatttataatgtaacatagaaaataagacacacataaattaactataaggtcatttttgctcagtgtggtggaagtagtttaaataaatactagaatatggccagacacagtggctcacacctgtaattccagcactttgggaagccaaggtgggcggatcacgaggtcaggagattaggaccatcctggccaacatggtgaaaccccgtctctactaaaaatacaaaaaactagccgggtgtggtggtgggcgcctgtggtcccagctactccggaggctgaggcagagcgagactccatgcccccacaaaaaagtgtgtgtgtgtgtgtgtatatatacacacacatacactttatgtttacatatttatatttatttagtttatatatatataaactagaaaatagagagataattaatgaagagaaatggtagtttggaagaaacagaaaaaaaacataaaagtaggctgggtgcagtggttcacacctgtaattagcattttaggagcgcgaggaacagctgaggccaggagttcgagaccagcctgatgcagacggtgaaaccccatctctactaaaatacaaaaattcaaaaattagccaggcatggtggcgggcacctgtagtcccagctattcaggaggctgaggcagaagagtctcttgaacatgggagacagagattacaatgagctgagatcgcgccacggcactccagcctgggtgacagagcgagactccatctcaaaaataaaaataaaataaaatactagaataattgatagaaggatgtttttgtgaccagaaatatgctatagaactgaattcttctctatatcaattagcctgttggaaaattggtttcattattccaagaacctattgaggaggtctaaggtctcctcctctattgaggaggtctaagtgaggccttactgtcctattaactaaagtctgtgttttattctgacatctttagttttacctgatgtctttttcagttccaggatcccaccttgccctgagttgtcacgccccgcaggctctccttggctggggctgtttctcagattttccttgttttcgaggaccttgacagttttgaggagtactggtcaatcattctgcaggatgccctctgttgaaatttatctgatgttcttctcatcatttgatcggtattacgagttctggagaggaagacaagagcggcaaagcggcgttcctctcgcctcacatcagaggtgcatactacaggattcctcacagtggatgttgacctcgatcccctgccgagaagcgttggttaggtttcttcattgcagacccactccccccaccccacactgaactcctcagagggaggtcactgtgtgcagctcacacgtacggagcagtgactcacgcttcccttctgcaggtgcagtgtccatcgattgctaggaatccttctgttaaggagatttgtctcttctccccattcatttatttacttgtgctgtgcagtcatttatttatgttggtggagactcactccctgccctttccgaagtgctctgtgtttaggtgataaattacgtacccattatctttgtttatcacccacagctccagctcatcttacttcttacttttgttttgctttggcctcagatttgccacttatattacattttcatggttgtgcttgtggcacattccgtgtcgcgtggtgcaatcctggaatattgtggggaatacataattctgtaggtcacgcctgagtacgggaaagagaagtgcacggaagtgtgtatggtggtctcatgctgcacaggtgtggcagcagccttgtgtctctgggtatcagaagtaatacatggagtagcataaattggaaccatgcaaagaaatttatttacgaatcgtgtggccgggcacggtggctcacgcctgtaatcccagcactttgggaggccgaggtgggcagatcacgaggtcaggagatcgagaccatcctggctaacatggtgaaaccccgtctctactaaaaatacaaaaattagccgggcgtggtggcgggcgcctgtagtcccagctactccggaggctgaggcaggagaatggggtgaacctgggaggcggagcttgcagtgagccgagatcgccccactgcactccagcctggcaacagagcgagattccatctgaaaaaaaaaaaaaaaacaacaacaaaaaactagaatcatgtactttcagctttgctatcagtcatctcacccttggaaagccagaataagttactctgggcaatgtcaaggaagatttaatttcagattgatgttgtttcctcagacagtccattcttctttcctttcagtcagtctcacaggcgtttccccaaacaaacatccctgcttgcaactgtatctcctaacacaaccgatcacaagagcacgcagccaagctgagggcagaatacggatgcgtgcatcctattcactaacctgctaaggcactcatgctggataagaccctcacatcttcccccattcctaaatccctaatgcatctgtccccccaatcttagcaagcttaatgcttaaaataaacagttttatgtagaaagttatcccattgacttttctggtcttctcctctacaaagaaacttgatataaacatttgtggatagctttttcaatgagcatatacttttatctttcttggataaatacctaaaattggctgggtcatacggtaggtgtgtatttaactttgtaagaaatcgccaaactcttttccaaagttccgtgtattcgacattcctactaccagcatgtgagagttttagtccctccacatactgggcaacacttggtacagtcagttgttttagctttagacatgctagtgggtgtgcagttgtatctcattgcagttttaccaaatggcttttttggtgatgtgtaatatagtctgatggaactctttcaacttccttattttttaaaattgatacataataatcatacccatatatggggtacatgtgattatttatttatttattatttattttttttttttagacagagtctcgccctatctccaggctggagtgcagtggcgccatctggactcactgcaacctccgcctcccaggttcaagtgattctcctgcctcagcctcctgagtagctgggattacaggcgtcccccaacacgcccagctaatttttgcatttttagtagagacggggtttcaccgtattggccaggatagtctggatcttctgacatagtgatctgcccgcctcggcctcccaaagtgctgggattacaggtgggagccaccgtgcctggccataggtgatattttgatctctgcatacaatgcagtgaacatgtcaggatacctatcatcgcaaacctcatttctttgtgttggaacattttatttatttatttatttatttatttatttatttatttatttatttttttttttgagacggagtctcgctctgtcgcccaggctggagtgcagtggcgcaatctcagctcactgcaggctccgccttctgggttcacgccattctcctgcctcagcctcccgagtagctgggactacaggcgcccaccaccacgcccggctaattttttgtattttagtaaagacggggtttcaccatgttagccaggatggtcttgatcttctgacctcgtgatccgcccgcctcggcctcccaaagtgctgggattacaggcgtgagccactgtgcccggccgttgagaacattttaaatctagttattctgaaatatacaataaattattgttaactactgttactctactgtgctattgaacactagaacttatgccttctgtctaattatgtttgtacatgttaagcaacctctcttcatccttctccgccagttcccagcccctggtgacctgcattctgctctctctttcaatgagatcaactttttaagctcccacatatgagtgagaacgtatttgtgtttctgtgcctggcttatttcccttcacataaagtcctccaggctcatccatgttgccgtgaatgacaggacatcattcttcttatggctgaatagtattccattatatatatttaccacatttaaaaaatgaatttagtttataaattgtcataaatttaacaaattttaaatctgttcatttatttaacaaacatgtattaagtcttttatatgccaagctctgtgttaatgcggcattggttatacaaagatgaattagatatttatttttgttttggtaaagtttgcagtctaggagcagatgtgttggacatgttcaaagtcaaattacagtatattgaggtgtgaactaggtggaaatttgggttttgaaagtgaaaataaggaaaacataaaaacatgaaaggatctcaatattaggttatatagagagaggggaggccaaggaaagaaagtgggaagtagaaactggagattggaggaaactaggagagagaaaattctgaagatttcaaaagaagaaagattctcaaagcaaggcatggttaacaaatacaaatctgaggagatgcctactggtgtgagatctgaaatgaacaccttgggtttggaaaagggagtccacaaatgatcttaatatgagtatttttttgtgttgtaataaaggtgaaagtcttttatctagcagtaagctagaaaacttttactgatttttaaacagaaattctctagaaggttttgatttttttctttctgtaggtcacatattttactgttactttcattctcaacatttctaatacaaatactatatatatatatatttctttttttttttgtgagatggagttttgctcttgtcgctcaggatggagtgcaatggcgcgatctttgttcactacaacttccgcctcagcctcccaggttcaagcgattctcctgcctcagccccctaagtagctgagattacaggcacctgccaccacgcccaggtaatttttgtatttttagtagagacggggttttgccatgttggtcaggctggtctcgaactcctgacctcaggtgatctacctgcctcggcctcctgaagtgctgggattacaggcataagccacagcgcccggccaaatacaatattaatttggattatatttagctgtgtgttgctgacagtcatacacactattgagattttatttattttatatcattttctttttgttaaagtcaattttagaattcgtatagcatttttgaatttttgttgttgttgttatcaaacaacaatgtttcgttcatttgtttttcactatttgttcccagtgtttttggttatatctaagtgtatcgtctgaattcttaaaacactaacatttgtggcagttgttgccgtactgatttcttcccagttttaaaaagaatgactgggattttggaggaagtttaacattaacttttagtttaaaataattttgtttcatcagaagagaaactattttttcctttttcaaaatatttaaattgggaacgaatattgttcttttaaaaaatattcttctggccggttgcggtggctcacgcctgtaatcccagcactttgggaggcctaggcgggtggatcacgaggttaggagatcgagaccatcctggctaacacggtgaaaccccgtctctactaaaaattaaaaaagtagccgggcgtggtggcgggtgcctgtgatcccagctactcaggaggctgaggcagtagaattgcttgaaccctggaggcagaggttgtagtgagccgagatcgcaccactacaccccaccctgggaaacagagcgagactgcatctccaaaatatatatatttttctgatattagttgaaagtatatgtgtgtgtgtgtgtgtattgtgtgtgtgtgtgtatatatatatttgttttcttctttcagtctttttaacctatggtaatggtgtctattcagattgctctattctcactcagctgtagatgcttaagaccgtcaagctctctatcttgccctgttcgagtggaggcagcgtaggagtggatttggaccattcccggtgtctgaaacgattgttattcatccagcgtgcccgcagtgaacttccggcgtgtatgttctttccctggccctctgcttcttactctctgtagtagagtgtagcagatcctgtttgtgacttgtccatattcttttggcccactgtggaggtctgatgcagcttggtgacaactccttcttcgtccacctccatctctcagaatgatggtgtgaggcttcctgaaatacacctcacagcttatctgaaaagctccccaataaactatttgaacccaattcttgcctcagagtttccagttgaaaaaacacagaccaagacagtggctatggttttgctttcctgagtgcacgttgatttctcttaggagtaccagatcctgcctggaaccacgctcacctggctgtagtctgaagtcttccattcttttatattgaccacattttccatttctactttcctctgactgatcccacttcccagaaaacccacagagcagatcctgtttgctgaaaccttgctccagaatgaatagactattttttcctccgcagcttagttgccagatcgtgctccttcggctataggatggagttgaaatttgctacaggcctttgcacacgaattcgtctgttgcaaaatttctgaggaggctgtgatgacttgtgtgttagtcccacttggttggccccatccactctggtttttttcctcccctttcacatggactcatttattacattctagaatgtctccaatatgagttttcctgcagaatggtgcactttataataataggtggtttcttgttcttgttgctgaatgattatgttcctgcaataaattcagtttgttcacagtattttaaaaaattaaatctattactaaaaagtcttcattagtattttctttgatttttttttacagatatattcaacatacataggtgtataatttttagacattattttattaaggtttggaaatatatgtttgccaacgggaatcaattaggtaacatttcaacttctacaatgttacacaggggtttaatttttagaattaattttttggacacgaacattgtagcataaaatctaatttgctgcacatatttcaagtgctttgaaaatgttttatatttcactttatttatgagtctaccttatgaaaactgtgggtttttgttacatcaatttttatagtttactttttggatacagttagaataatgaaacaactcccttgactgtaccacagatacacagaatacaagtatctcccatacctaacggtagtacaaaatggggttgtggaaaagttgcggcagaatgaaatttctcagtccttagatcttcgtcattgctgagtcatgttgacatttttgattaaaggtcagttggttctttcatcttcgtccttgaatcctcttctgccttctgctttaaccgttggctcactttgagtaaggcctttgcccaattctggaaactgttggcttatattattttcccactctactaaaacttcaaatctttctattcatacacataagcaagaatgaccccagcctgtttttgagaaggttcttatagcggtgtaacgagaggtgcatacatgctgatgggctgcaatgaggttctaaaagggatgcccacatcacttactggaaacaaaaaggcaggagtgttgcccttgtgcagaaaataaatacttcaatgctgattaggagtggctttacttcaccagaaagtcacagggcaaggctagtggttataattatctctatgattttatataaatgtaaaatcataaggctgaattataataaattgtcatttttataggttaaaaagatgattcaatgtcagcaatttaataggattcaacttaatactatttcctttgtaagtgagaaaacggaagcacagggaggttagacgacttctgagatcacacagagctggcaaatgaagtaatacacgttagcttgttacactgtgacacttcccaacatgaaatccctgggagaatttttggcatactgattttgctttgataaaaccattcttgcttttgtaacagctaactgttttaataaattaggaaatggaaaaaatgggtgccaattccaaccattgaaaaggtttatataatttaataatccccattaaactaggtgatacagagtttatgctttatacattttaaagttacgtttcactttctacctgaccctagatttagatatcaatcgctatacattttgcaagaaatatagaaaatatattgattcgtcttacttgtttttacttcctgtcttttccctccctccctccctccttccttccttttccttccttccctcttttcttccctccttccctctctccttccctcctccctccttccttccttccccccttccttccccccttccttccctctcttcttccctccttccctccttccctgtctccttccctgtctccttccctccctccttccctgtctccttccctccttccctctctccttccctcctccctccctccttccttccccccttccttccctctcttcttccctccttccctccttccctgtctccttccctccttccctccctccttccctctctccttccctcctccctccctccttccttccccccttccttccctctcttcttccctccttccctccttccctgtctccttccctccctccttccctctctccttccctccttccctccctccttccctctctccttccctccttccctctctccctccctccctctctccctccctccctccttccctccctctctccctccctccttccctctctccctccctctctccttccttctttctctcttttcttccctccttccctctctccctccttccttccttacccccttccttccctcttttcttctctccttccctccttccctctctccttccctccctccttccctctctccctccctctctccttccttccctcttttcttccctccttctctctctccctccctccttccttccttccttccctccttccctctctccttccctctctccttccgtctctccctccttccctctcttcttccctctctccctccctcctttctttgctctacttggggtgtgtgtttaaaacgttctttaattaatcgcttacttattttaactttcttctagaaaaagtgtttaaatctaaaactataatgttaagcactgctttgattagattccgtgggaaatgatacaaagtattttgattttcacagttttctaaacaatatgtcatcaagtattcaattttctcttgaccaagttattatttagaaaaatacttttaaattttccagtatatggtatttggtgtttaaactcatacaattaattaaaaaattctacagattccatttggaatttaaaaagtggtataattacattaaaaattatgcagaaaaatgaaaaagccatccccaccgggctaaagtaaaactttaggtccatttggtaaattaatcttttctcacatgcatacttacatttatagaattgtacaaataagtttttttgcaaaatttacagttcgttttaatgtatttctaccaattactccaaaaagaaagctattcatttaccatttatgccgtgagcattttccatattgcttgcataaatgtttgtaattattaattctattgggaagcatagtattctaatgaccgaatgtactaaaacaattttttaaatcattggacatttaatttatttctatttgagggctatgataaacaatgctcagttgaatttataactccttccctgttttagattattttctaaagacatatttacataaatggggttctggcccagaaagtatgaatatttttatggctcttaatgtaatgccgaattgcttccctaaagcactggagcatttaaaaacacaatcagaaacgtgtgagagtacccatttctttattcccttgccagcatgagaaattatcattttaagccatttttttctaattgaagagatcttaaagggtaatgtgttttaatttgcatgcgttttaattttttgtaagtgtttatatgtttcattcctacttctgaatcttttgttcatgtcatttgaccctttatgtatttccctgttataacgtatatcattatggctgactttaataattattattacatcagtgcaatctgtttttgcatatactgcattttattctcttcagatactactcatgatacaaatattcattggtatagtgagaacaatacttaatgtttgctgttcaatacagaccttcgaaggcatattcaatatcacctacattctatttgattaaatacattcagacactgcattacactgacaatacatgtaaaaattataacggtataatgtctgaggtagccagaaaaacatgaaaatcacccgtgtagccaggaaaacaataccatccaccgtcacctctcagtgttaacatttacgcattaacaatggttttcgtgtgattagcagctgctttgcaggatgattacatgcaaaccacgcctatctgaatcttggggaacactaaatctatttttaaactaacagggtagaaaagaaagatggcccagtgttggctccaagcaacctccatctggacctcttcctgtgcatagaagcgctcccagggtgtggaggtggggccgcctggaaccaggggctggagcagcaaagacagttgctgtgttctggaccgttgttttgaccacggcaattagcagacctgagacggaaaacgttcccctgcgaccctagcaggggcgcggcgtgggggtggctcgcttcttcagagctgctcaaagccccgcgggcgcagacagagggcggtgcggctcctccccacggcggtgtctgcggtgagtgttgacggctcctgaagccccgggggcgcgtgttacaaggcgcccccttagtttgccgtctataggcggctcgtgttaagcagctcaatagacccccttccttatcgcaaggacagagggatttctgcattccgggttcttgctttggggtacctgaagaatcggggcacacgtgggcttggagaatgagtgtcaagtgttattgagtggaagtagctctcagcctatgatggaggcagaagggagatggttttcccctcgcgtggggccgctcggtggccccggccaaactccgcctcgtcctgccagtggatggccaccagcgtgctcctcccgaggtcccctccacgaccagccgcttgcaccttcttctgtccatgtgctcctctggacgtctgtgtgattgcctgctagagtctcggttttgtgttgttgttttcttgagacggagtctcgctctgtcgcccaggctggagtgcagtggcgccatctcggctcactgcaagctccgccccccgggttcccgccattctcccgcctcagcctcccgagcagctgggactacaggcgcccgccaccacgcccggctaattttttgtatttttagtagagacggggtttcaccgtgttagccaggatggtctcgatctcctgacctcgtgatccgcccacctcggcctcccaaagtgctgggatcacaggcgtgagccacctccccaccccgcccacggtctcggtttttataggcccgggatgggggcgtggcaggccagggtggtcttggaaaatgcaacatttgggcaggaaacacctgtcctcacctaggtccgtgggggtggagccctagccagggaccattccctcctctacccagcacttcccttcctggcttcggtattatttaaagggaccacgctcttcctttcccagcacttatgtatcagatccagtctaaacagattcccactgagtccagatggggggattactaccctcaggcctgtgtgcctggtggctgtctctggagtggagtctgttcccgccatgaagctgtcgaggcggtccctccaagctgattgcgttgctgttgtcgctgctctttcatatttctcctgtgtctccttgagccccagatcgggacctgctcctttcgcagagcgtatgatctgaggggttgtaatctgggttggaggctttatcttcttttagaacttggtcccctgctgccctagtagtcccctttccccatctaccagcacccagcagcaccctcctctgtggcccctgagctgcttacagaaaaccaaaaccaaaatcaggagtgcttttggaagcagagtcagcctccaggtctttgctccacattcggcttaccctgtggatggctgaggggagtgaaaccagggagctcaattaacatctggaccctggcccaacctggaagagatctcttggacttgtgagaattaatttaggttcagaaagtgcttagaacagtgcctggaacaacgtcagctcttaataaatggaagctattatcttctatatataggttagttctgtttctcaagttctccctggataaagttttcacgtgatcaacaatggctgcttgttagaaattgttggaataaaataaaaagcatgcccagttggactgtgtgtttaatgtgtacggtatttttaaaaaataacttttcctattaattcttttgaacctttttgatttttttttcactgagagcagaggaaaaagctacattcttcatcagttctaaatactataatcaagagttagactcattagaatggaaggctatgcaaactttgactttagatcctgtagaatgtctaatgtacaataggtgcttagtgagcagtaatacataaaacttatataacttttgtaccaagtagagttgtaagtgcttgctttacctatattaactcatccatcttttaactcactcctgtaacattagcagcaatgtattttttaaaattttctaaatgaggaggccgggtgcagcggcacacacctgtaattccagcactttgggaggctgaggcaggcggatcatgaggtcaagaccatcgagaccatcctgaccaacatggtggaaccccatctctactaaaaatacaaaaattagcctggcgtggtggtgggcgcctgtagtctcagctactcgagaggatgaggcaggagaatcgcttaaacccgggaggcggagcttgcagtgagccgagattgcgccactgactccagcctgggcgacagagcgagaccctgtctcaaaaaaaaaaaaaaaaaaaaattgtaaatgaggaaaactgagaaacatggccaaggtcattgagctggtaggacacatctggaattcaaaccaagatatatattttgaagaatctatatgaataaaagccccacttttgaaattaaaaaattctgacagaatcaagtaaatgcaaattaaaatagtaaccagacaccattttacttctatcaggctaacaagaaagaaattatgacaacactcaataaccatgagaatgtggatccaggtaatgcgcaaacattctggtagagtgaagtaagtgaaaccactgtgtagagcggtttggcagcatctggtaaagctggaatgtacactcccaaaacctggcagtttcactctcaggtaaacacctgagagaaagattcttgcacaagtgtttaggaaggtgcacagcattgcatgtaaaagcaaaataattgaaacagagtaaatttcctttgtcagaataaataaattaattgtatcattggtatataatgcaataacatatagaagataaaaggaatgaagtagaactacatgtctcatgctttcagagaaatctcatacaagttgcagagcaatggtaaaagcaaattacagaataatacgtacagtaggtgtggcaccattctacaaaaattatagtattaatcactttattgttttcaaaaaacatccggtgaagacatgggtacacttcaaaaatgactgttaggactaatccatgctgacggacggcaataccatagtgatgaaatatcatagtgattaacatatgagtgaaaagaaaaagagtgatacatttcattgtctttctaaatgcacactttgttatcaataattaaaattttctaaaagcttccaaattggaagcttcaggtctttcaggtctatccatagagtatttctttctttatcttttttttttttttttttgagacagggccttgctctgtcacccaggctggctggagtgcagtgactcaatctctgctcactgcaaccactgcctcctgggctcaagcaatcctcccacctcagcctccgaatagctgggactataggtgcacactatcacacctggctaattttttgtatttttttgtagagccagagtttcaccattttgtccaggctggtctcaaattcttgggctcgagtgatccaatccacccgcgtcggcctcccaaagtgctgagattatagacatgagccaccacgcccagccaactgagtaattaaattgaatacttataactgatttgaaaaaatatgaagctacaatccaaagaactcatttatcaaagtgcttccttctaggttgatgtataaaatagttctctgggctaggtgcagtggctcatgcctgtaatcccagcactttgggaggccgaggcagtggatcatgaggtcaggagatcgagaccatcctggccaacatggtgaaacactgtctctactaaaaatacaaaaattaactgggcatggtggcacatgcctataattccagctactcgggaggctgaggcaggagaatcacttgaaccaaggagtcagagattgcattgcaccactgcactccagcctggcgacagagcgagagtctgtctcactaataataataaaataaaatatttctctggcctggtgtggtggcttacgcctgtaatcccagcactttgggaggttgaggcgggtggatcatttgaggtcaagagttcaagaccagcctggacaacatggtcaaaccccgtctctactaaaaatacaaaaattagctgggcagtggtggctcatgcctgtaatcccagctatttgggaggccggggagggggtggataataccttgaacctgggaggcagaggttgctgtgagtccagatcttgccactgcactccagtctgggcgacagagtgagactctgtctcaaaaaaaaaaaaaaaaaaaaaagttctccaagttctcaaatatttctaaactctgattgatgatgggtagcaaagacagaatgtgtatacttctagcatgctgactgatttgtgtgtgtgtatttcacattaagcttcatcctggaagttttgtagttcaatcactctgattgtatggcaatgtgactgtgtaactacagctagtacagcttcaattttgattggtggaatacagaagctggtttggatgaaattacaatagtcactcagcaaatgtgtgggcttggttccaggaccctggcagataccaaaatctgcagatactctagtccctggtgtaaatggtgtaggatttgtgtggaacccatgcacaccctcctgtatacagtcatttctagatgacttacagtacctaatacaatgtaaatactatgtagtgcttatactgtatccatttttatttgtattgttttttgctattgtattgctattttttattttacttttttcaaatatctgtggtcagcagttggtcggctacaccagctgtccttcaagggcagcaatatgcattacatctatcaacactaagcctaggaatcgctaaccacagctgctgattagagagcattttactttatcagagaaccaacaaactgctcttgaaaggaaggaattacttacaggtgcatctgggaaagacgggaaagaggtgggtcacaggccttcagatgtaagcacctgttattgggaggacggctcattgcacatgggtctcccacagttcagatgggacgttggcagaagctggaagtacagagtgaaagtccaccaaagcattctggcttctcttattgcaactatgaataatgattatttggctgggcacggtggctcacgcctgtaatatgagcactttgggaggccaaggcagttggatcaccaggtcagaagatcaagaccatcctggccaacatggtgaaaccccgtctctactaaaaaatacaaaaattagccaggtgtggcggcatgtgcctgtagtcccagctacttgggaggctgaggcaggagaattgctggaacccaggaggtggaggctgcagtgagccaagatcgcaccactgcactccagcctgggtgacagagcgagactccatctcaaaaaaaaaaaaaaaaagataataataataatgattcttcattaaataaataacaatttctaggacaaatgtaaagccagctgggtcactgtacaatgtgagaaaccaggactctcttaggcaaagaacttctgtagtccccctattaatgaccatctatgggtctagcattttctacacgtggatgtttctaccagtgtactcgcctgttagctgactaattgcatttcctggtcattcctctttctgaattgatttctgacattatggcatatctttaatttccaccttctaagaactcttttctttttttctgagacagagtctctctctgtcacccaggctggaatgcaatggagcgatcttggctcactgtgacctctgcctcccgggttcaagagattctcctgcctcagcctcccgagtagctgggattacaggcacccgccaccatgcccagctgatttttgtatttttaatagagacagggtttcaccatgttggccagactggtctcaaactactggcctcaggtgatccacccacctcggcctcccaaagtgctgggattacaggtgtgagccaccgcgcctggctagaatgcttggttttcattatttccttgaatagacctgtaggagctttgccatcatcaagactgccctgttaatcaaacctcatagtaataaacagacagcctggtttcccagccaacaaagatgcatgcatttgacggcttttgaatattaatgttgttgaacacctcctggggctaatcgacacaggcacagaagacttctccaggctcttcagtacaattccgaaggtctacatgtccttcattagcatcctgcaagactttcagaatgttgtatgaagatgaatctttatttacaaaataagctttgaagtgatttgaagaatatgtgaagagcttcttctgagccaagtattcaaggtatttgcttcttggatccaaggatgtcattcatgtggggtgcttaagtctcaagtttccttacatctcaggaaaagtgagtggaatactttcctaaattcattccttcatggatgttgtgccggagagtcacaactgcctctgcacattgtgtatgactgatttcctgatactgattttcttttaagaaaaatcctagcatttggaggtaacagttctatgggaagctttcataaattcttccagtcgggcacggtagctcacatctgtaatcccagcactttcggaggccaaagtgggagcatcacttgaagctaggagtttgagagtagcctgggcaacaaaacaagaccctgtctctacagagaagaaacaaacaggccgggcgtggtggttcacgcctgtgattccagcactttgggaggccaagacgggcggatcacctgagatcaggagtttgagaccagcctgaccaacatggagaaactccgtctctactaaaaatacaaaattagctggacctggtggtggatgtctgtaatcccagctgcttgggaggctgaggcaggagaatcgcttgaacccaggaggcagaggttacggtgagccaagatctcatcattgcactccagcctgggcaacaagagcaaaactccgtctcaaaaaagaaaaagaaaaaagaaagaaagaaaccaaattcttccaccttccattccaaatgcctaatactgcgtaggtctgctgctatttacatacgcaggagataaaagacaacagcaatgaacttgtattgatgagctctaattaatcctaaaatgctggtttatcttctttgatactgtaactggcaggataaagtccttctttctccacaaggcaaggattgcggagaaagctggtgcttattcaagaactcaagagggtcccgacaagcaaaaaactgttgtcgacggtcacttgagagttctctttgttttgcttattcttttgggttttgtttttcttctgaaactgtattactagttcggtgccaagagcttttcacaactaagtttttgttccatgtttctcccttcccctgaagtagctttcatcattcatttattctttctttctttcatgtatgttctcatcaatgtttctcatgatgcaccgactccttcccaggcacaggaataaaacagttacagtctctgatcgcagagtcatggttttgtggagagcgagggcaaagaggcaagacctgggcttgacacaatgcagccattaggtttggtaaatatttggttaatatcatccgtgtccaaaactaatgtaaaacctgatagctttgctgcttctagaagaggattacgaagactgatagtagtacctatttaatcttttatttttattttttttattttttttttttgagacggagtctcgctctgtcgcccaggctggagtgcaggggcgcgatctcggctcactgcaagctccgcctccctggttcaggccattctcccgcctcagcctcccgagtagctgggactacaggcgcccgccaccacgcccggctaattttttgtatttttagtagagacggggtttcaccgtgttagccaggatggtctcgatctcctgacctcgagaccaacccgcctcagcctcccaaagtgctgggattacaggctatttaatctttatgtttgcttctcaatatcatgagaatcctgtcagactcttgttagagaatgaaattaattaaaaacatggagttttaagaatccttagggaatcttcaggcaaaaaaataaaatttgtcttttacagtagtggtttcacccttgctctctaagtggtacctataattcgcattagaacttgtagccaaccatcgtctaaactgagtatctcttgttaatggaagtagcatatctgcgtctcaagtggtaattgaatgaagaaaagcacacacttgattctatgaaattctatgaaaaagttttcaaaaaataaagcatatcgtttaaattaagggaactctatgaggattgaatttttgagtagattaaatgttgcctggggaaattaatgaagaatatatcacaggaagaaatcctgctttgggaagtcggccccaatttacatcgtctgtttccggttaccccctcatggaactgacctggggcaggtgataactgaccctgcctccaggtgttcattcgcctgttcgcaaatccctagaggaatatccagggcacccatggatccagtggcctctcccacataacgatgagtgtgataatatgttacctttgagttatttctggtattttcacttatacatgaacctcttcattgactataaattctttaaggacagggacagcaacgttggtctattttatacctcacttaataaatttcaaaaagccgactgaaaacaaggctagggccaggcacgatggctcatgcctgtaatcccaacactttgggaggccaaggctggtggatcatgaggtcaggagttcgagcccagcctggccaacatagtgaaattccatctctacaaaaaacacaaaaattacctgggcttggtggcgcacaccggtagtcccagctactccagaggttgaggcaggagaatcgcttgaacccgggaggtggaggttgtggtgagccaaggtcacgccactgcactccagcctgggcgacagagcaagactctgtcccctccgtggcaaaaaaaaaaaaaaaaaaaaaaaaaaaaaaaggaaaacacggctagatgatcaatattcagaaaaatgattttacatttaacgtatgctttttttttcttattttcaacctttttctttcttccaaatctcaggaattcgttaaactttattatttatgagcttaagtcaaacttttaccagctcagctataaaaaatactgaataataacttaattaaaagcttgaaaacattttagaaaatcatgacagatggcaactattccacagttaaggggcattttaaaatcactgacgagatatagcactggaaatagtttgcaacttcgatcaattctctttttatttgcttaaaagtgggtgtcagactcattataatgcttttagaaggttggtaataattgatatttgattgtaaaaaaaaccttgtaagcaatctcattttattcagaaaacaataattgtctggaaattcaatttaatgctatgattatagtcagaatgctttatttgaaattgcagactcaatagaaattaagatttcactttcatacactcattatttttttctttaaaaacaaaagaaaagctttccccaaatatatgaagctattacagaagagaagggggtaatcaatttctaatatataacgccatggcaatgaaatgaactataatttaaataaaagcatcttctgttaggtcagcaaaaatgcaaagaaagcattttactagcatcccatttctctcacagtcagaaagatgagactaatgaacagactataaaggttaataacaatctcattttgttctatttattctctcaaaacatattgccatatttttacaaagtcttcttaccccttgaaaaaacaatttcaaagtaactttaggaagtcaatcaatttctccagacaagaaaattgtatgtttggttaaaaaaaagcacttcataccttggattaatttggttcgatttgtaactctgaagagcacatgccacttacctttcataatctctgaacctcagttcacaatctgaagaagtttagagtgtcagaccaatagcacatgtgactacagtggggtgattactgaagtgagcgagatcacccaggagctcgtgtgcaatgcattttagaggttcgttcatttttggcagagataagaggtcacagtctttttaatacacattttttgtggcttctctaacatattttccacagtgactattccaagcctcctctcctcctcagttttcaattgcatgtttcttccgtgtttagcttttttatttggaagaatataaattatttatttaggaggttactaaatttcccccacattattcttggcttttttttttgagatggagtcctgctctgtcgcccaggctggagtgcagtggcatgatcttggctcactgcaacctccacctcccgggttcaggcgattctcctgcctcagcctcccaagtagccagaattacaggtgtgcaccaccacacctggctaatttttgtatttttagtagagacggggtttcaccatgttggtcaggctggtcctgaactcccgacctcaggtgatctgcccaccttggcctcccaaagtgctgagattataggcgtgagccaccgcgcccagcatgttggcgtattttttgtcagctatttttctggtctcctttctttaaaaaaaatattagagtggggtagagggaagagcagaaatttgagattgtgctaaacttggctaagtaagtcggtaattcaaccttgtaagcttcagttttctcatttttaaaatgggcataatggtctgggtgcagtggctcacgcctgtaattccagcactttgagaggccaaggcaggaggatggcttgagcccaggagtttgagatcaccctgggcaacatggcgagacccccttctctttggaaagtaaggaattagccaggctccgtagtgcatgcctgtatttccagctacatgggaggctgaggctggaggatctcttgagccgaggagttcaaggattcagtgagctgtaatcacaccactgcactctagcctgggtgacagagtgaaaccctgtctctaaaacaataaaaataaaaatgaaaaagggcgtaatggtacctacttcactagattgctgggagatgccttatagaaatgcttagcaaaatgtctctattcagctggtgcaaaataaaaatcaacattcgtactttttttaatgaaaaagtacaaatctctgcattccttattactcctttcttttgcatcttaaatctttctcctgcccctggcttcttcctgcgggccttcagacatacagcagcctttctccattctcccaacaacctgcccctcatttgattctctgatctgatcaaaagccgccatcctatcttgctgccttccttctctggcatgtcaacagccactgcctccatttcttcctccttgttctctattcattcactgcaatgtatcctctttccacggaactcctcagaaactgcactttcaaagatttctaacaatctattaaatgtcacattaaatgaccttttctctgtcctctgactatttaatatctgcagaagggttatactcataccttctgggagcaatcttctttcttgatgaatgtggctctcgttggaatttgtggttattccagacgatgcaaaatatatatatatatatttatatatatttatatctatattatatatagatatatcatgacaatagcaatttctgtcaaaaaatgttttcggggagaaagtgagcatgcattttagtacagactatgtactggcttggtaatgtcagttattagatgatttaaatcctcaaattaaactctaattatcaaagtagcaagtacattttctctaggaaattacacaatagagcagtggatagaggtttttttattttgttttgttttgtttttaaacttcacctcttcttctagtcttgccatatagcctcgattcatcaaataaaatactcaggtcaagaaatgtgaaactctgagcttggcttggccataaaacttttcttctcccagatcagggctgctgcaggctggaagtgtgctctgtgaaaggggagtctgcttgtcccctccacatctttgccttgtgcatttcttcctctcttccttagcgaaccggagcttcagctggtgcagcacaggtggaaaggtgggcaaagtgggagaggccagacctgaccagcaccgagtcagcagcacagaaacgctccccagtgccatcaccacttgtcagccattccctttccctctacatcttctgggctagctccaggccccaggccaccagcaactcaactaaaaagcttgcaactaaaagcaagctctccattggcccccttgcagccggccctctctctccaatctagaggacaggaggagggggcactgccctccccagggaatgacttggggttggtaactcagggatgctctctaaagaaataacggcacggatagtctcctccttcctgctcagatctctgaatgtccttggcccgattgaagagtccaatagctgtggagatggtgctcaaaaactccctttgaatatctgcacacattgacataggatctcacttgggagcaccaacataattgccttttggtacctagcaaatcattactttagaaacctgtagcacatactcacatgcatatactcacatacacacactcacatacatatactcacatgcacatactcacatacatacactcacatacacacactcacatacacacactcacatacacacactcacatacacgtactcacatacatacactcacatacacacacatacatacactcacatgcacacactcatacatacactcacatacacacactcacatacatacactcacatacacacatacatacactcacatgcacacactcatacactcacacacactcacatatatacactcacatacatgtactcacatacatacactcacatacatatactcacatgcacacactcatacatacactcacctacacacactcacatacatatactcacatacacacactcacactcacatacacgtactcacatacatatattgtggacatcttttcatcttaggatattcttctctttttatttatttatttttttggagacggagtctcgttctgtcgctcaggctggagtgcagtggcacgatcttggctcactgcaacctctgcctcctgggttcaaatgattctcctgcctcagcctcctaagtagctgggactacgggtgcgcaccaccatgcccggctaatttttgtattttttagtagagatggggtttcactatattggccaggctgctctccaactcctgaccttgtgatccccctgcctcagcctcccaaagtgctgggattacagacgtgagccacccacaccctgcctcttcttaactttttgtaagggaggatactgggtctcagagatgttaaggatcttgcttaagtatatacaactagagaaatttgtaaaagtgggatttaaccctatgtctgcctgatgtcaaagcccatgtctatatcctaactgtgtatctctttcctacatttatgtagtatctcccagcttctcaaaaattgccccaacctcctaggcagtgtagatttaggtaaagcttacaatttttgtttaaatgttactgtgtctccagggcagggccgtgaatgttgacacattcacagaaagtatgtaaacccagctagttacaagtatgtcgcctacacacataggaaagaagcgtgaacagaccgggcttctgcccaggagaggttgtggacctctgagtttcttattcattcatttcttcaattatccagtgaagggaactgagcactctgccatagtaatgaacaagaaagacaaagtctatcatcgtgtttattcttctgctgggagagatgaatacgtacaagagaattcaggttgttacaaagttagatgtctataaatcaaggtaatgggggtaatatgtcactgggatgttgaaggaatcctgagctcctgcgtgaggggagccaaggagctagtcctgtgaaaagtcaagggaagaaccttgcggtcaggagtgtgtgggagccgcattgagactggatgcacgtggccccacttagcaattgttggaaggtgggttcagggctctgggttgcaggcagcccatggtggacccctgggctggagcctcagaggggggtgcctgcattggcttccatcatttaaagctcctgaggccaggtgtggtggctcatgcctgtaatcccagcactttgagaggccaagacaggaggatcacgaggtcagaagttcgagaccagcctggccagcatggtgaaactctgtctctactaaaaacacaagaaattagccggacatcggggcgcatgcctgtagtcccagctactcgggaggctgcagcaggagagtcgcttgaacccaggaggcggaggttgcggtgagctgagatcagaccattgcactccagcctgggtgacaaagcaagactctgtctcaaaaacaacaacaacaaccagaaaaaaaaactcctgaaataatggggtgggggctgtccacagacatcctcttccctgtgcgtcccaccagtgcctggggggctgctccgttcaccccaccccttcaccatcatacctaggtagaatgcccgaccttctcctttgtctcatgtcatacttcacaacagttttcaaggcctgatgatctccatgtttcagatgaaaatctaatgcttgaagcgggtagagggacaggctttcctgactggatttctgattctacttgcttgtaatttcagtcatagtgtctataaagagacttacggattgtgcctggtagagttctaagatggacccccaagactcgtggcccctggaacctccttccagttattcagtcaaatactcatctagttactgctgggaagggagtgtgaagatatcattaagggtctaaataagttgattttaagaccgggagattatctacatgggcctgacctaattacatgagccccctctaaaagaagagaattttctctggctggtcacagagagaaagtcagaaacgtcctccggctggtctgaaagagccagcattcacatacacactgcccgtggagtaggtcatgtggtaggaatggtacctgcctctggggcataggaggcatccctggctgacagccagcaggaaaataggacccccatcccacagctgtggggaaatgaccccatccatgccagggaggttggaccaggacctcacgctcccggggagtgccacacctggccaacacctgatttcagcctggtgagaccgggagtagaaaatccaactccactgtgcccggacttctgacccacagaaactgtgagggaaccggtttacattgtgtaaagccactatttgtggtgatttgttaaacagtattagaaaatgaaaacacaggccgggcgtggcggctcacactgtaatcctagcactttgggaggctgaggcgggcagatcacctgaggtcaggagtttgagaccagcctgcccaacatggtgaaaccccgtctctactaaaaatacaaaaaattagccaggtgtggtggcaggggcctgtaatcccagctacttgggaggctgaggcaggagaatggcttgaacctgggaggtggaggttgcggcgagctgagatcgtgccattgcactccagcctgggcaacaagagcaaaactccgtctcaaaaaaaagaacaagaaaacacatagactgttcacagattttaggagctcagcttatatgaagaaaactattatggctttaaagagagggttcggaagcaagtcttcaactcaggaatcagatggtcaaatcatcatgtgaaatcacagttaaaatcagtaatgtgatggtttatggacggcatgtggagcccattctgtatcttcttataactcctttattactgcaaatatttgaaagcaaataaaaatactgtatcataaacaatacccttgggccaggcttggggactcacacctgtaatccaagcactttgggaggccgaggtgggcagatcacctaaggtcaggagttcaagaccagcctggccaacatgcagaaaccccgtctctactaaaaatacaaaaattagccaggcatggtggcaggcacctgtaatcccagctacttgggaggctgaggcatgagaattgcttgaacttgggaggcagaggttgcagtgagctgagatcgtgccactgcactccagtctgggtggcagagcgagactccatctcaaataaataaatacatacatacatacatacatacataccacccttgttctgaatgcttgtgcccacaaatccctttattatttatcaggaatgcacattttatcagaccacacgtttcaagttcaaggctccacctaaatactgacatgttaacactcctgccatcctccagaaaatgttaacattcagcatataaaagataatacggcagcacaggcatagatttcttgttagcctgcagaattgtaagtatttagcttgataagctgcagaattataaaatggtaaaatattaaataactctgagtaaaggagaagcatcaaaaacctgtaccaattctgcctatcttcattagctatatgcatacaacacaatgtgaatcactctttggcaaagatgcagttcatttgatcggtggaggacaccagcttcagatggaaaaactataaatttcacctaaaaatcaaatacatctggtgcatcatcagagtgttgaaatgtaaaagatgtgtcttatactgatgttcattttggggaagctaaaatggaggagcttgccagtgtatccatagaatgttgaaaatatactgggtgttaccattaggaaatagcacctttctgaaggttctcctgagttgctttcagtagcaagtgagtacaagaaaacactggcaggtgagcaaggtggctcatgcctataatctcagcactttgagaggctgaggcgggcggatcacctgaggtcaggagtttgagaccagcctgatcaacatggaaaaaccccatctctactaaaaatacaaaattagccaggcatgatggtgcatacctgtaatccagctactcaggaggctgaggcaggagaatcgcttgaacccgggaggtggagattgcagtgagccgagatcgcaccactgcactccaacctgggcaataagagtgaacctccatctcaacaacaacaacaacaaaaaaaaaagaaaagaaaagaaaagaaaacactggctcctgtttctgccatcacaaattgggaagaagctaggaagatgtgcagaacattttctgggtagggtgggctgggccatgtccacataacaaaaaggaagccgacctttgaaaattatctagctcaggcgaccgaggaagccaaaccagataactcagactcaaaatgaatctcttccagagtaatttgtactgccagttcgtcagtgcttacacaaaacagatgttatgaaatgcagatttcagaggtcaataataaaatatctgcagggtatttccgtgatcatcgatacaagatttgtgctgaggaatgtggaatcttccaggacctaatcatgcactaataatttcagcctattcttgaatgtgatttaacctagaaaataaaatgctaaatggaaagccttattcaaaccgaaattgtacatgatggaactggtctattttctgtgacagtgcacttgcacattttggtgtcgcactttgctgaaaagttccttagatgggtttcagtcgaaggtgctatagaagtttatttgtactgtactcaaagtaaatgcattctctccagactgcaagactgcaagcacagtcaataagatgaatgagtttctcgaactcatttagtgccttgtctataatagtcccattaccaagtcccatgtaacttggcaacttttcatcgaggtggcctcgggaccgaataagcaaggagaaaatacagcttcttgccttggcacttcacgtaggacctgatgctcctggcgggctgtgattgaaagtaggtcttactgcccggccctctgaagccgccttttctaaaaatgttgtactttggaaaggcacttccgcattacaactgaaaaggcaaagccggactcaaatatccagttccgcattaacctttaggattttgcctctggatttccgaaccagttaactctattccctttctacctggacattttaatggaaaatggttgtggctggtttcctgtactttgtgtactgcccaagggataatagcttgacataggcaaataacaacggaaagagttaactctaagctgaggttctgtgcttcagttgccagaaagaatgcattaattagatgtggttcactagaataatttatctagaaatctaaaacctttcttgcataaagattcaagcccaaagaggcttctgccataaagaaaaacaatatggactttcatatggcttgtgagggagacgtatacatctcatcaaatgcatcgggctgaaccagctaagtatacacaggctgcatttaaacgggagaagtatcttgactctggcagtcaaatttggccaaagcaccactttatctgttcagatgtcaggttggtggagtaaacttgactgggctacggtccctggtccacgcatccacacagtgatggaggcggcctgagtctggtatccacggatgaattctaaagcctctgtaaatccccttaaaactagaagcaaatttttgtatctgtgtgcagatgtgggcttttgtgggaattgggtgcttagctttcatctaattctcagacaggacaattgaccttaagtgtttaaatattttctaattttttatgactataaacacagacataaatacactattttcgcagatgagctatcaatgctagtctttttccgttgttcccttgctcctgcaatctttccacattcacctgtattatcctcccttatcccagctgtcattccaggtaacccatagtaacaacatgatgtggatgattctgtacttttctcaaaactcatagtatcacatgtaaaatttgtttatttatactaatgtatatgcatatatttgaatttatagagtatttctggtcattgtttaaaaatgtgtcttctattatatacactctgtattttatttttcttattcagtaatctgtaatggaaatctgtttaagttagtacagaaagcaatttcttcgttgttttggctgcatggtatttagggcacggatgcgacgttacagtcctgtgctgcttagtgatgggtatatatttggagaaatgtgtcctttagtagtgatttttgttatatgaccatgataccgtgtactcacacaaacctagatggcagagccttacacacctgggctatatgacatacctattgctcctaggtaacacacctgtaccgcaggttactgcactgaatactgcaggaggttgtaacacaatggtaagtacttgtgtgtttaaacatagctaaacgtataaaatgtgcagtaaaaatatggtattataatcttatgggatcacggttagatatgtaggtgggccctataatcttatgggatcacggttagatatgtaggtgggccctataatcttatgggatcacggttagatacgtaggtgggccctataatcttatgggatcacagttagatatgtaggtgggccctcactgaccaaaatgtctgtagttaatcagtccctgctgcggtgggtgttcacttttcttcttgatcttgttttgtcagtataaacaacgtttcagtaaacatcattgcacgtatatcattatcaactgttgttctcattgttttggcaaagattcctaaagatggcattcccaggagaaaaagcatgttctaaaatttaatagatgcagtcagatgcaaagctcatatgataccagcattagataagaacacttttttacctgccaggttcggtggctcacgcctgtaatcccagcactttgggaggccgaggcgggcagatcacgaggtcaggagatcaagaccatcttggctaacgcagtgaaaccccatctctattaaaaatacaaaaaaatttagccgggtgcggtggctcacacctgtactcccagcactttgggaggccgaggtgggcggatcatgaggtcaggagatctagaccatcctggctgacacggtgaaactccgtctctacaaaatatacaaaaaattagccaggcgggttggcaggtgcctgtagtcccagctactcgggaggctgaggcaggagaatggcgtgaacccaggaggtggaggttacagtgagctgagatcgcaccactgcactccagcctggaagacagagccagactctgtctcaaaaaaaacaaaacaaaacaaaaaacaaactcttttaccttctcacaataggtttaatgcttcttttaattttttgcatgcataggtgctataaaataatatttgtgttttttgtttgtttctttgttttttgagatagagtctcgctctgtcgcccaggatggagtgcagtggtgtgatctcggctcactgcaacctctgtatttttagtagagatggggtttcaccatgttggtcaggctggtctcaaactcctgacctcatgatccgcccgcatcagcctcccaaagtgctgggattacaggtgtgagccactgcacctggccataatatttgatttttaatttaatttgcattttgtgactactagtgggttgaaacatctggtgaaagatctaccggccatttggaattgtctttttaggactttccaattcacaccctttgcccattttcctattggtttctgttgtctttttcatattaattttagagctgtttatatatttattataggttattaaccattaagtatcatctgcagaaaaaagtacaaaaattattttccaatattttaaagttgtatgacatattttggtgcaattttattttttggaaatacaattaaatatgtcttttatggttttttttctctttttttgagacagagcctcactctgtcacccagtctggagtgcagtggcatgatttcggctcactgcaacctccgcctcccaggttcaagtgattctcctgcctcagcctccccagtagctgagactacaggcacatgccaccacgactggctaatttttgtatttttagtacagacagggtttcaccatattggccagttaggtctcaagctcctgacctcaggtgatcagcccacctcagcctcccaaagtgccagcattacaggcgtgagccaccgcgcctggctgggtttttagtttagaagttttctccaacccccagaatatttttatggcaaatttttaggataaaatctttgtggaaaatatgtggagagtgaagatgtggatgaggagactttctacctatttatcttgaaggcttaatctgtaaaatgcgtcattttattaaatattaaatgacttacaaaaagttttatcccaaatttactgccactgtcaaaaaatcaccataaaaatcttacatatgccctactcaaaatgaacgcttcacctcagtactggtgaggggttcccaagggtgctatgatgtctcgtgctgacattttaaaacctactgaggccgggcacagtggctcatgcctgaaatcccagcactttgggaggctgaggcaggaggatcccttgagcccaggagtttgagaccagcctgggcaacatagtgaaaccctgtctctacaaaaaacaaaaaccaacaaccccaaaatacccaggagtggtggcaggcacctgttgtcccagattgtcaggaggctgaagtgggaggattgctcaaacccacgaggcagaggctgcagtaagtcgagatcatgccactgcactccagcctgggcgacagagagagaccctgtcttataaataaataaataggccgggtgtggtggctcatgcctgtactcccaacactttgccaggctgaggcaggcggatcacaaggtcaggagttcgagatcagcctggccaacatggtgaaaccccatctctactaaaatcacaaaaattagccaggcgtgatggcacacgtctgtaatcccagctactcaggaggctgaggcaggagaatcgcttgaacccaggaggcagatgctgcagtgagctgagatcatgccactgcagtccagcttaggtgacagagggagactctgtctcaaataaataaataaataaacctattgcgcatttgtttatcatcacccctgctttccctagcagcttagccctccatatgtcttagtgtttgcttctgccgggcttttggggatacaatttagaaagtatatttagtatcttcactccggaaattacatagcaatgtgtgtttactgtggtcgagaaagaaacaattctggcctcttaaatataaacttccacagaggatcacccatgcaacggagtggtcagcatccccttcattcactttaacattttcacaattatataacttagcatcacactctgttgttgttatagctctttggatccatgtaggaatttgtgtgtgtctgtatcttctgagaataactgacatattttgcttgtaatcaatgttaatgtatgaaatccattgagcaaaacttgctaaaaacaattgtttgtaaaatttttctttaaatgttgaacagaaaaaaaaaacacacagaaaattgtgttactctctttctttcccttttttttttttgggagacggagtctcactctgtcgcccaggctggagtgcagtgatttgatctcagctcactgcaatctccgcctcccgggttcaagcaattctctttcctcagcctcccgagtagctgggattacaggtgtgcaccaccacgcccagctaactttgtgtatttagtaaagatggggtttcaccatgttggccaggctgatctcgatctcctgacctctgggatcagcctgccttggcctccgaaagtgctgggattacaggcgtgagccactgcactggccctctttatatatgcatagatattgacaatctcattttttccctcatttttgggggcttaaaaataatgacatgggaaatatacagttactgggaaaataaaaacacgtcagaaacgtaccacagaggagggaaataaaattgctctccaactgaggaatgctaaggctgaggtcagagattgttaaagctttgtttgggaagttgaagaagagttttaaggctttgactccttcttccctttgaagacatcagagtgaacagagactgttttgtttcagaccctaataaaggtgacatttaaaaagctgtataaccacagagcttaggcttattcctgggagtgcaaatgggatacaccagtatttaatgcctgcattacaattatgccaaggtcaaggacagcttgacttctggatattcccaacccttgtgaaatactacctactggaatttcccaaagtgatatggtgtgtactatgggcattcacaggccagcccttccagcatcgttcccatgattggagccacagtctcttcccaagccccaggtggctggagatactgtcactgtcctcaaagctgcctgaaggagcaacatcactgcactgttccatgcatgaggctgccaaggccatgccaaggtttctccagtgcctccacctccatatgcttcccttgacgacagggctgtgagcacaactttcttgcagtgataggcagagagaccctctgccctgccgggctgtgctgccagctgggtgcagacctagaacactgggatcagagtcccccagggctctgctcatgcgcccgtagcttcctcaggactcttagcttcagattttctactgacatcagcttgaaaagataaactcttcacttgaacaattaatactttttttttttttgagatggagtttcactcttgttgcccaggctggagtacaatggcgcgatctcagctcactgcaacctctgcctcccgggttcaagcgattctcctgcctcagcctcctgagtagctgggattacaggcatgcaccaccaaacccagctaattttgtatttttttttttttttagtagagatgggatttctccatgttggtcaggcaggtctcaaactcctgacctcaggtgattcattcgccttggcctcccaaagtgctgggattacaggtgtgagccgctgtgcctggccttttttttttttttagacggagtcttgctctgtcgccaagctggagtgcagtggtgtgaccttggctcactgcaacctccacctcccaagttcaagtgattcccctgcctcagcctcccaagtagctgggactacaggcacctgccaccacacccagctaatttttttttttgtatttttagtagagatggggtttcaccatgttggccaggatggtctcgatctcttggcctcatgatccgtcaaccttggcctcccaaagtgctgggattacaggtgtgagccaccacgcccggccacaactaatagttttcaggagcgtggtggtctcagtttatacctaatgcaaatttcagtttgttggtaacaacagcagcagtgtgcatagatgcaattcagcccactactcacgcaacttctccccatgcttgtgcagagcagtttttctccttggagccacagatattgctccttttcatttgcatagctaaattattcattcgagtgatttcccagaacaaaggtatgatgtgtgtgtgtgtgtgggtgtaccaaatgttaaatatatatatatatgcgtgtatgtatatacctattatatctatgtctacatctaataacctttggtcaacagagcattgctctcagttttgaaagtattttcttcttgtatctccattcatatttcaaagatcaaagtgttttggacttctccactctccacttcataatcttccttcatttgcttaaacctgcttcacagattacccctgtgaagatggtatggcaggtcaatatccctattgaaaaaatttgttttcagctttcttgaaatatgattgacaactaaaaatcctatctattgaaggtgtacaatgtgatgttttgatatacattcacatgataaaatgatgaccacaatcaagctaattaacatattcatcacctcacaccatctcttaatgtgtggatttattctttcagctattttcaagtagataatgtattgttattaactccaagctgtatgtttcaatgtccagaacttaattatctgatgcctgcaaatttgtccccttggactaacacctctccattcccgccccacctcctggcctctggtatcaccctctgctccctgtttctatgagttacacttcttgaggttccacgtacaagtgagatcaagcagtatttgccttatctcactcagcacagcggcctctacgttcatccctcttttttttcttttttctttctttttttttttttttgacagagtcttgctctgtcacccaggctggagtgcagaggcatgatcttggctcactgcaacctccacctcccggttcaagtgattctcctgcctcagcctcccaagtagctgggattacaggcctgcaccaccacacccggctaatttttttatttttatttttattttttgttttgtattttgagtagatacagagttttaccatgttagccaggctggtctcgactcctgacctcatgatccgcctgccttagcctcccaaagtgctgggattacaggcgtgagccactgcgcgcagccggttcatccctctttaagtgagttactacgtgaacagtacttaggagagtgcctggtagcaatgagcgttcacataacttcagctcttgctgttccctttctcatctaggtctttgtagggatccctgccccatcccaccacacccctgctattctctcacacaagcattatgcagagaaagaagactcagctagaaggccttgctctgagatgcatcatgccagttctggaatccaaaggtctctccagtctttcccatgtacctggaactactggaaagagataccttgtcactaggtagcacacacagccaggaagtcaccgtgcgggggttagatgacagcatcgggctgtctgtccagacaatatgttcatggggtcaaaataccgcgctgtggtgtggctcagaacggcaggtctataccaggatcctgcaatgagcattgtgccacgattcggcaataaggattacaggggcagaaaggcatgatctctttcctcacctgtcataacggtcatggctgacattcctacagcaaaagacaggttaacaagagaggagcataacaaacttatttaatccaacttttatgtgacgcaggagccttcagaaatgaggatccaaacactcaggaaaaaccatttttgtgcttcagttagatgacggatggacagccgtgcagcagtgtgaccggacaggagggtctgatctgatggtaacagatggagacctgtcggtgcaggctcttcctggcctctttgcacagcgctccttcctcctcgtgtggggcaggaccctctagaatgagggtcttcaagggaggggagagagaacgactgtttaaggttttaaggctgtcttttggggagaggggtcctagtttgtgagacctgccttggggaagaggaattctggttgctctgactcgctttgggggagaaagagcagtgggaggcaggaggacgggagaaggtcagagagccactttgctgctgaggctgctcctgaggccttccaatctcctttagttcaatgtactcccaggccaagcaccacaattgcgggattgtttcctgagacctgtcaggacaaaagacccagtccctggtgccgcatcactcctagatcaaaagacaatataacagcattcactcattccaaccggttcaaatgccagtcctgcttcttacttatgtgtgacctaatgcagtgtctaaactgtttcctcctctgtaaacaagggatgttaacagtgactacttcacggggttgtagtgaagattaagtgtatgttatgtatgtaacatgtggtggattggtgcatggcatgttgtgaaagattaacgtgttaacatgtcaagtatgacggggtcttaaagagagcagggacgcagggcaggggagagagctaccaacccggtcataggataaaggtctggatggaagaggggggcagaaactttgtggaaggctgcagttgggcagcgctgcagttgggggaggccggttcacaggggtggacccaggcagcggtgcatttcctgcattaaccatgtttacttaagggaaatctttatcttaggcacctgctgatgtgaaccaaggtcccctcacggagcccttcctgctccccgtctgaacttcaaacaggccctgtccccagctcctgcggtttgtacttcctacctctgcgttaggcacttcttgcacctgccactaacctaatattcattttgcccgtaggacgtgttgattgactgcacggaagcttcacaaggagaggattttgcatctgtttcgttcacggtgttgtcactgtcatcatcagctgtataatggatgctggcacagagtaggtgctcagtatgtcttaacagggtgcgtggctgtgtgaattagtgggagaattgtgacaggactctgagtcaacttagggaggcacaagtatgcccctcgctggaagaattagggagggcaagtaagataaatgcactcctcttctgtgagggcttatctgtcaatggaagagatgccgtttagtttaccatatttcttttcagctctctccacccagagttaaacaagctggtcctcatagccaccatccaagattccaagtttcaactgccccatctcaggtgtgatgtctgtggaatattgagcctgaaacatttaacctccaaacctaaacttgaagaatgatgatggctatcacaggaaattacattctaaatggaacatgatacagaggaaattaagtctgtctcgctgtcttgacacatagacgccaccagtatctcctttagaaaatgtgcacttctaggctctaagctttatgaggacaagcaccacatctgcgccattgtgacttcggtacctggtctccttcactgctcgttacataggaggtgacaggaatgatttgattaatgaatatatgcattttagggggtcatctaactcaggtggtatattgagaaaaagacaggtctttttcatagcaggctattagtggcaaaagcctggattagaaatcagaaagaaaactttggctttagtcaaaccaattatgagaagttgactaaattcctcagtctcttcaacacttttatgtttgtggtataaatgaaccataaaattatagtttgtaatttaagatggaaaacatcacttatttttgttccttgagtgagtcagaaggtaagtgacctaaagcattgaaaattattacttttgttgcataaacgatattttagagaaccattaaatagtttatctgtaaagtagtgataatttctgttttacctagagtataaaagtaacgtgaattttgtaaactgggaaatactaataaaaagtaacctgttatattacatttcaactttctttatttgtccaatgattagtgcaattgcagaagttttgctttaatactctttcacctttttattggttttgttttgtttttgcctttagtactttgactttgttgctttgcagttacacagagttaagtttttctttgtgctgttgtctgtactaaattttggtgaactctctgtgcagccgcagttttagtggttcttgggttgctatagttaaatactttaggccgaacactttataggatacgcttattccaagtaaataactcagtaggaagctcatttctgcatatttctttactgcttgctcatctagtgtgacaaatgccctttcaaaagtttaataacaccgaatgcttaataccttgggcgaggtaaaaccaaattagctggaaccgcagattttgaatatttaataaagcattaatgaacaaccaaccaaataagaaacatacagtttgttgttttgacagacctcaaaccaaaaaactctttttaaattgctgcagtcttttcattttcaccattatggttaaaaatctaccagtaatttcattataaactctatttccagagagattctatttggcaataaaaattaattctgatttaagaagtttttttatgttgctgtaatataccacaaaattacagtttctaaattcatatgactgtagggaatatgagtctgctagcaattccctcccctccccacttttttttctcccacagtatggaagacaaatgaccagagagatttttaaaatttttctttctttggggctatacaaaatatttaatcagtgatatcgtttgttactcctgggcatatataaatatttgatatgctttcttaaaggaagtaacaacctgataataattactttcctgtgtaggtcttatctatataaataaattcaaattattaatataatccacaagaatgaacacattttgcataactgagagatactactctaagccttggatatttctgatccaaatccctacataattgtgtgcatatgttagtcatcataatgctagctgctgtaacaaaaaaatcctcacaaataacagttcatttgaagctcatgaagcagtcctggatgggggtgtctattgggaggctctctcctatataatcgcctaggcagctggtgtggaagagactgtcatcttcaaagactgtcataatggcttcaaagattgtcctaattgccttcatccctagtatctggaagagaaaacaaacatgggtgagtgtgtttgtgagttttatagacaagatctggaagtggaacgtgtcccttgcactcagatgtcattgactagagctcgtagccacaagggaggttgggagatgcaggctcgtttcttacataaaaagaaaatgagccaggcatggtggctcatgcctgtaatcccagcactttgggaggccaaggagggcggatcatgaggtcaagagttcaagaccagcctgaccaacatggtgaaaccccatctctactaaaaatacaaacattagcagggcatggtggcaggtgcctgtaatcccagctacgtgggaggctgaggcagaagaatcgcttaaactcaggaggcggaggttgcagtgagcagagatcatgccattgcactccagcctgggggacaagagagagacttcctctcaaaaaaaaaaaaaaaaattagccaggcatggtggtgcacacctgtaatatcagctacttaggaggctgaggcaggagaattgcttgaacccaggaggcagaggttgcagtgagctgagattgcgccactgtactccagcctgggcgacagagagagactccatctcaaaaagaaaaaaaaaagagagagagagagagaaaatgacaacacagatttgggagaacaatgattaacctttgccatagtatgcatgcttgattcactagttaagatcaaagtagtattgctacgtttaaactttcgatgtaaaataaaggcattggtgttttctgtctgttttttgtaaattatctactgtgggcaaatgggtatctagtccaaacttaagcaaagttgaattagagaagaagtctagttaaatactgtttatttgaaaatatattcaaagttaatctttttcctaggaatactgatttaaaaaattaaagttaccatgattgaatggatatctttgaggaaacagataatttaagatgtatttcatcagccttccaatactcctctgtaattgatctgagccatatgacagtgactggtctgtaatacacttaacttgtcatagtcaatgtcttggaaatcaaagtatttgtttatgctatagcttcctaaattaagtattataatggaagtcacatgggatgagacaatgatccctaatttataaaatatgaaaccaataactatctctttaaaaaaattgattggccaggcgcggtggctcatgcctgtaatcccagagctttgggaggccgaggcaggcggatcacttgaggtcaggagttcgaaatcagcctgggcagcatggtgaaaccccatctctactaaaaatacaaaacagctgggcgtggtggcaggcgcctgtaaccccagctacttgggaggctgaggcaggagaactgcttgaacccagcaggtggaggttgcagtgagccaagatcgtgccactgcactccagtctgggtgacacagcaagactccatctcaaaaaaaaaagattattataatatggttttgtcaagtagatcatttcagaaattgtgtctctagtgaccttggtaaatcaaatccttatttttagcaaattcattaagaacagaaacagaccttggaagtcctggaagctgctccatttgcttctaggacctgcatttcaccatgatccattaacctcctctgtaacattaatgagtggcttgtatgcatcagaaataggggcacgatgatgaataggagcttacggtctagtgaagggacacacatatggcaccatcaccctcttccactgcagagctggcactgcatacattcgtagcaaagagaaaagcaaaggatgcagggtgggctgcctacctttagtagcagaactgaaaatcagttcctgagtagatgtattggcgggaatgacacctagctgtgactggcgaaagattctcagtcctgggcccgtacatgctgaacaatgcactgttgtcatcctgagttcgctaacccagtcaagcatgcactggctgtttggtaaaaattaaatattcatcataggcagaaccatttttaaagcactaaatgataattcctaaggaaaactgtaattggcatttctattcttgaagctctgacaccactcatctctctctcttcgcttatagagtggggcatgataaagaagctcccccatggttccaaattctacccatctaatcaccagtgacaagcatagaggcacgagtggcagaaagaaataccaagggaccacggccaagctggttttaggggtagccttatccttcatatctgtatcagacagtcaataaagacttcaggctacctctcctcccatttcccttcctctccataggctatgctccaggcccattctctcagccaccatctcgtattccatgatacatattttttttttgtcactgcatctcatcaaaggttttctttcctgtgtcccacagcttggcacttactggagagctaatagtctaacctagccactgtagtatactttcaaaataaaggacgccttagaaaacgcaggttcacagtgctccaaagcgactccgctagtcaagatcttagagagcatggattactggtggtaaaagtaactgtgggatggagatcatcttagtgcctttggtagacagactcctaaaacagcctccagtaatctctacctcctggtatttatgcctgtgtaatctgcccttgtgggtggactgtaagtaataattcaattctaaaccaatacatacagcaaaataaatgaaatgctgcttatgtggttagtttatgaaaatccatgatttccagcttgttagcaggctttctctcccgccttcttggcttgcatgtaataatgaagaaagctgctgtgtaggaggggcccacatggcaaggaaccgagggtggcctctgctagcagacagcagacactgcagccctcagtctaggagcccacagggactgattgctgccaaaaatcactgagtaagcttagaagggaatctttcacagttcagtcttcagatgaagctgcagacctcgggctgaccttttttttttttttttttttgagatggagtctcactctgtcacccaggctggaatgcagtgtcatgatatcagctcactgcaacctctgtcttccaagttcaggagattctcctgcctcagccttccaagtagctgggattacaggcacctgccactgtgcttggctaattttttgtatttttagtagagatggggtttcaccatcttggccaggctggtctcgaactcctgacctcacgatccacccgcctcggcctcccaaagtgctgggattacaggcatgagccaccttgcccagtcgggctgacgttttgattgtaaccttgtgagagaccaagacacaggacactgctaagccacagagaaactctgagtcactaatgtgtgctgttttaaatggctgcgttttggtgtgatttgttactcagcaattaatagctaatccatgccttacactcctgcattgagatggctacacactctgctaacttgggagtgatctcctagaggcaggaacagtgtcttttgtattttaatatcattactacctaacaataaatacttgttaattgaatgtatgaacaaatatacttgtgtatgtaaagccactgatctccagtcctctgtactgttcagcttgggacaaaagtgtgttcttgtggtctccttttgcttgtggggggcgggtggaggggaaaggctggtaattccattatgttggaaagctaaagggatatgaccatgtggtcttctgcgtcttcataccagttcctgtcagaagccgtggcccagctcctgttgaagctgttctgcaggcctgtgtcctataacttctctgcacagcaaagttcttcactgtgtggtttctatcaatctaactgtcttttataattcacaatgttttagattccagaagcactttattggctgtatatatcagtgttttatctgcttaattatataataattacaaagctttatcactctatagatgtattatatgttgtattacagcaaaggaaaaattgtaaattcggaggcacaatacatgtgcaagtgtaaaacctggggcctgtgcttgtgttacttcatgtttattgttaaacagttaaattctaaagcccactctgctgacgttgatagagtgtgtaaactgataataacgaataataatggcaaaaatcaatcgctaggctttagggcttgcccaacaatggaagctcttgatattttgaaatgagggtatgcaagaatgaagcaaattcaaaccgatgtgtttgctttcagcacgaagaatatgaattagaaaaatctggaggtggagaaatggcatttgctgcctctctctgaagttaatattcattcagcaagaaaccactccattgtaaagcagatgtctggaggaactgagagatcctctggttttccaagcatggtgtggacacatcggcattgtaagattcttagctcttctgtttttcttgtattttgtagctgttttgaaatactttatgaacaaagaaagtaaaaatagaaataggtagaatataagagtaaaacatccaataattattggcatcaaggaattgaaatatttcctaaagtagaaaagctagaatgctctctgggggtttaatttaaattatagttttagtttttttaaacctgtaatcagtatacctaaagcaggtgtttgttttgaagataatagtttaaaaaggcttttctctgtgcatcgtaatcagggtaatatttgagtcattttaatttattttatatggtgattattagcacattacatgaacgtgctatacattcatacagaatgtatgacagaccaggtctgtattgttctttttattatagatttaactttgatataacaagttttgaagaaagaagagggttgccaattacttttctcattgaaattgaacatttaaatttctagtacttaataccatgaaagctgcataatggcaaaaagcttcattattcaccagaaagaatccgagagcagaataatacatcccttgaaaggataattatttcaacagaattagtgcatattttgtctctaaactgaggatagcggtagaacttaactcatatggctggagtgctagatggtacttggtattaaatcaaatgggggttataaactgcttagagcagtgctaggcacacagtaatggcttgctcacttcagatgccattcttctgcacaagcgtcctcatcttgctcatgcaatactcagatacacacaattacacctctgtagctcatctgatcttctctacgaacccttgagttcattttccagggcttctgtaacaaaataccacacgtgtgtggcttaaaacatcagaagtgtattttctgacagcactggaggccaggagtgcaaaagttagtcatcagcagggccacgcccacctccaagactctgggtagaatccttcctttcttcttcctagctcctggtagtgaatgttaattgggggtgttccttgactcacagccgcatgaccctaatctttctgtcatcccataaacgttctccctgtgcgtctctgtcttcttacaaagataccagttaattggacgaaggtccatcctactccagaatggcctcattttaactaattatatctgcaacaaccctatttccaaataaagtcacattcttaggtaccagggtttaggatttcagcatatcttcttggcagacacaatttaaccagtaagagcccccatctgctgacaaattttttaaagcatatataaaaatataaagtacttttggggccaggcacagtggctcatgaccgtaatcccagcactttgtgaatctgaaggggaggattgcttgagctcaggagttggagaccagcctgggcaacatagtgagaccctgtctttaccaaaagtttttaaaaatcggccaggaatggtggcatgcacctgtagtcccagctacttgtggggctgaggtcagtgtaagcctagcaggttgaggctgagaatcaagtggccatcaacggatggtttatttctggactctgagttccttccactaacctgtatgtctatccttggttggtgtgtgacactgaccactggaatggtgattctggctattagtctccactcctaaatccacataaactgcagtctcttctcccagtctcagccacaagtcctcaaagtctgtttgcatctttttttttttttttttttgacagagtcttgctgtgtcactaggctggagtgcagtggcgcgatcttggctcactgcaacctctgcctcccgggttcaagtgattctcctgcctcagcctcctgagtgcctgggactacaggtgtgcaccaccacgcccagttcatttttgtatttttagtagagacaaagtttcaccatgttgggcaggatggtctcgatctcttgacctcgtgatccacccacctcaacctcccagagtgctgggattgcaggcatgagccaccgcgcccagcctgtttgctttgcatcttttttataagaaaacatgccttttttttttttttgagatggaatctcactctgttgcccaggcaagagggcaatggcacgatcttggctcactggaaccattgcctcccgggttcaagtgattctcctgcctcagcctcccgaggagacgggattacaggcacaccctccgcacccagcttttttttttgtatttttagtagaggcgggggttcaccatgttgtccaggctggtcttgaactcctgacctcaaatgatccacctgccttagcctcccaaagtgctgggagtacaggtgtgagccatcgtgcccagccaaaatatgatattttagattcatttatttgtcaccctttgtaaccaactctttgtcctttgtttcaacttatagagatgagctgggatctaagtagatctgcagcctccctcttgtactatcttgggaaattgagctgaaaatccagaatgccttgtttttccgttcctcactggatgtttctaaagttttgactgcctttcgaacaatgacattttcctcctgttctactttcttcttttcctctcatcacttttcctactccacaacctgccatgcagagtggaaaatatggatggaatatttttaatttgtttagagtgcttatatgatttagtgtttaacagcttaggttctatagctagtcaccctagcataggaaactgactctgatattttctagttgtgtgtcttggaacaaattatttaacttctgttttccagtctttcatggcaaactaatattaatgaattcagtgaaaatataggagcagtaaatgattctgtacatgtaaagcgcttggaagagccctggaaaatggtaagtactcagtcacctcaggctgatactaactagcatttctgaatgcaactgaacttcatagcctcgcccgggctttggctttttgttgtcttgacagcagatcttcctcctgactccaaggtattcattgtccagttttattggaagacagggtaagggtaagagagatggaacagctaactacaaaggaaaactaaatcaggaggttatgtaatcaagaatacaaaactgttctccaccgggtctggtggcacgtgggaaaagtacaaagaaccaagaagaagccttagagtctagagccacaggaaaggctgtgctgatatattcagagggaaatcagtaaagggaaagagtgggaaagagtctacattatctttaaggctcttagactctttttaaagacgtgcacatgtagtcagtgataggccacctaaatagtatggtcctatacgattatacagagagctgcacattttctattacctcatggcatcatagctgtcataatgacatatcacaaagcattaccttttctatgttgagatatggtaatatgcacaaatatttaccgctgtgttacagttaaccacagtgttgagtacaggtttgtagcctagaagcagtagactgtaccacgtaacccaggtgtccagaggctgtaccatctaggtttgtgtacactctgtgatgttcacacaaggacaaaaattgcctaatgatgcatttcttggaatttgtccccatcattaagcaatgcatgagtgtatatggtgttgaattttttaacttcttgaagtttgcagttaagcacaatttataaaataagaacttttcgactcagatgaattatctatgcaacataagcagcaaatagttaaggtttcataaatagcaaactcaactgtcgatattttaaatgttatatatgtttgtttttgtctccattcagatccaatttttggaactgaggaagactcattaaagttggaaaaagttctaaatgatttgtcaaatatattaacatgaactgtggtgaataagaagaattatatctttatttgttgtacaaagggccttagaatagatcagtagaggcagttatcaggaattggagtcacatctgagtttctcttctgaggaacttgctttttaggagggcttgtcctaaagccctcatttagccacattctgtgattttttatttgaattccaagagtacttgtgtaatcagatgcctgtgtgacagtaagaactctgggttttcattagtagtatcaggactttctttcagaaacaatggtacttggagttagcaaagtaaagactgaagcctatctactcttcatttacgtacggtactcccccatcctcatgctttcactgtggtctcaagacacaagcaatgtgacatcttaacttacataaaaggatggtagggagcattgttggaataaatggaaagtgagtagccgctgcaaatgactgtgactttaagttggtgactcttcagaacagaggtctccttttatcttctttttatattacttggtattttgtgcagctacttagcacctgtccatgaggactgaaaactcttggcttaacattgaagaccagatttatgcatgacccatatctctacttggggaaagctggaaagtgtctgaagattgttactgggaggctctgttcgatagataaaaaaattcaagctgcatattgaagagctggggagaggaaaataaaaacaaaacaaaaaaataccctaaaagatacaaaatattaaaaaaggaatagaaaggaaaagaaaaatgcaggctgcaatcagcctgggacattcccttgttcaggagagtaatggtcattatcagtatcaaccgcagtagctatggctctcaatacctcacttaactgggaagtttaatccaaatgtttgcaacccctttattaagccaacttagaagcatcctcttgaactggaaaggattgccaaagaatattgtaattttttgattgaaggaaagtttgtatacaattatttccttatattgatctcaaggcacatactagatggtatggatatgtcaataaagcactcctggccgggtgcggtggctcacacctgtcatcccagcactttgggaggccgaggtgggcggatcacctgaggtcaggggttcgagaccagcctgaccaacatggagaaaccctgtctctactaaaaatacaaaaattagctgggcatggtggtgcatccctgtaatcccagctacttgggaggctgaggcgggagaattgcttgaacccgggaggcagatgttgcaattagccaagatcacaccattgtactccagcctgggcaacagagtaagactccatctcaaaaaataaaataaaataaaataaaataaataaagccttccatgtatccctcaggtagaaggcaaactttatttagtgtcagacaaatgagctacattactttttcccttgattattctgtgtgcaaagatgtagggagaagttatttttatctagttcaatctcaagtcacaatgtaacgcactttgtctcacagctatgtgctatttattctgtgtattaaattcttgtaaaccacgacgtgactcctaaactaagcaaaatgcagcatgaaatctctagtgcctttctcatttctacgactacaagattccaactcttcacatttttctgttgggaaatattcatagtattcatatttagctatttgtataaaaaatagcacagcctctcttgagagtttcaatcaatattttttagctataagtttccaagaatgaaatcctttacttaacagaaaatgttttcaggatattataccaagttacgtgaacataaatttcatggctaagtcctggtggtacaagggacctcagacagtatccaactcaattccctcctggtttagggaaagaaactagaccacaataaaataactgcatttccttaggtcacattgccagctgaaaagctagggcatttaaaatgaaaatctagagtggtactttttgggattatttattatttctatgtttaataatttcctgcctcatttttgcctttctctacccaagcattttataaacaagaacatatgcaataaaatattaaattataaatgagtaaaaacaaaaatataaatagaaagtcaaaaccaagaaaaaagaagaatataaaatgcatgctgaggtcaagagtttgagaccagcctgaccaacatggtgaaacccatcttcacaaaaaaaaaaagaaaaaaaaaagaaaaaaagaaaacaaaaggcctggtgctgtggctcacacctgtaatcccaacactctgggaggccgaggcgggcagatcatgaggtcaggaggtcgagaccatcctggctaacacagtgaaaccccgcctctactaaaaatacaaaaaattagccgggcgtggtggcgggcgcctgtagtcccagctacttgggatgctgaggcaggagaatggcgtgaacccggcaggtggagcttgcagtgagcagagatcgcgccactgcactccaggctaggcgacagagcgagactctgtctcaaaaaagaaaaaaaaaaaaaaggaattatcgtccacatcggggctcccaaacgggtttgctggaagctcttgcaaggccattgcagttccttctgccatcgctcaccctcgcttctctccctgcgaccgctcccctgactgctgcctccaggggtgagtttgggctgtttcagaactttatgtgtatggaatacagaaggatgcttcctctttagctgggctgctgttgctcaatagtgtgcttttggggatcatgtgcagcagtggttcgttttcgtttctgaataatatttctattgcatggggcatctaagaatctatcggcagtattgatgatgaatagagagctttcctccagtttcttttactgttatgcctaatactagtatggataacttttgtgcatttctttgggttcccattagcacacaactcagttgagcatatccctaggactagaactggtgaaccacaggaaatgtatattttactttggtaaacaatgccaacattttccaacatataattagccctcctgcagcagtgtaggagatttagttctaccacatgctaggcagcacttggtatgactttcttttaaattagatattctggtaatggtattacattgtggcattggttgacattttactgatccctaattaagttgagactcttcatatgtttgccggaaggctgcccaagagagttccgttgacatcagttgtcatggtaaaataatcaaccgctcctctttccacgtcctaaagtgtccctgattggccatttcggtcttctctttggggtctagccaggtttatgtctttcgtttatttttatataaggttgtttgcatttttcttattgatttgtgggaatttcttgtatattctgataatgaactttcagttatattgatgacatatatcttctcctactttgcagcaggatcttgataaacagaaggttttaattcaattctaattctcagtagtgatttttgggtcctgtttttgtccactttatggacacatgatatttttctattttcttctcccttcaaattgaggtcttttattcttctgcttatggctaacgtagaagtcaatattaacttttttcacatagatttccaatttatgttcacttattaaaacactgcttttccccacaataccatctttgctatacattgaatatctatacctgttttttgtgtgtgtgtgtgtgtgtttttttattttttgaactctctcttctgttcctgtggtctatttattactctttcaccaataacccactgatttgaatagttcaactttaaaataaggtctgattgtcagttttgtaagccctccaactttgttattcaagattttcttagccattcttggcctactgcattgggcatttatattttagaatcagtttatccaggtgcacaaaaaaggtggagcttctcattggcgttgtggtgaaatttgtaaatcacattgggaacattgatattttgcagtactgggtctcccagcctagaaacaatgtatatctttgcattgattttggtcttctttaatatctctcaataatattttgcagttttcagagaaaagatgttttatacctttatttttaaaattatttatttattattattattttttgagatggagtctcactctgttgccaggctggagtgcggtggcgtgatctcggctcactgcaacctccacctcctgatttcaagcaattctcctgcctcagactcccgaatagctgggactacatgtgcacaccaccacgcccagctaatttttgtattttttttttaagtagagacggggtttcaccatattggccaggatggtctcgatctcttgacttcgtgatctgcccaccacacagtcccacagtgctgggattacaggcgtgagccaccgcacctggctgttttatacctttttttaaagcccatcatagactgcatgtatgacagcagtcccataagattttaaaatactgtatttttgctgtaccttttctatgtttagattcttttagatacacagatactgaccattgcgttacgagtgcttacagcgttcagtgcagtaacctgctgcacaggtgggtgtgtagcctaggagcaataggctgcaccacacagccgaggtctgaggtgtgtagtgggctacaccatctaggtgtgtgtaagtgcactctatgtttgcacaatgacgaaactgtctaatagtgcattgctaagaacgcatcttcatggtgaagtggcacaaaagtagcactgatattttcaatgctatttttaatgaaatttaagaagataattttctaattgttaattgctggtatacagcagtcacttggttgtgtgtattgacatatccagcaacttctccaaaatcacttattaattacatgttcatctgcagagccttttgattttctatgtgtataatcagtcagagttaagcatgccaataccaggagcttgaagggtggatattggaccggaagggtctaaagacgagccgcctgctgctggatagtgcacggttcaggaagtttgcctgctctcactgctgaggaagtccacagccctggcgtggagggtaggatagtcctatgcacctatgatgtgatgggattcatcaccctgaagggagcccgcaagtgctcagcgctgaattcctttatgacacacagacctgtattttctgtttgagtcattacagaaaaatattatttcagtggaaagcttgagattaagcaacttcttctgttgtttattttaagtaaatggaacttgacagaatgttttattacagaggcccagtaactaccagactagtgaataaatttcgtgacgatcaccgtaggaaagtctagagtctttgaatgaaaaattgtcatttttacaatgagaagcaagaattttgaaacattaagtcacaattttccagtctataatcatcgatcaactgcctaattaataaataaccttttaaatggtttggacttcattttggttagaatcacttaggcaaatggcaaatattaatgtgaaattagagctcgcaagtaagtagttatgaataatttgatagattataacagcccttttgtaatattttaaatcactcttattgcagttagcagacaataattgtcagagtatttgcatattactttagttaacacatgggctgttttaaaatgaagtatttttgctcttatccttccactggaattaatgggtgatgtcatgtatttgctttgcttcttaccattgtattgattttatcacctgattgtatactgtacaacataaaattattattatttttgccatcaataagaaatttacttgttttaaaaaaatccaaatgctttttaaaactagtgtaggggaagaaaatatacctaatgatgcctgctcacttggaacctgctttttagaaagcagcacgtagggttgagataagctgctgtgactagaatttgtaatcttactcagctggtattcaaagacagtaaatgtgaaggggctactgaaagcaatgaacttaataaccacataccagagaggacattagctgtgatattacagatgaatgcaggctgctatgtaactttgtgtctttgctttttaaagtgataaatggaagccctgcgaaaatccgtgaggtgagcataagatagccgctgactctagaatgaacagtattaaccccactggtttggcgcatgatgaaatgaaggacagatccattgtgttttcagtaaaggacaggatggtatgtaaattcagtgtcagatcttgatatttaactcaacagctaaaatatttccacaacaacttcagctctcagaaaaaaaatgtaatcctaatatttccttcaattaatctaaattcttctttaagacaaatataatttaaacttgccataaaaatgatgggtacttgtgggaacattcaatcactcctattttaaaattttgtaattttttgtgtcttattatttataatcactttaaaataactataattatttttctcaaggtttgacacattatagctatttttaacatcattcaatctttactgtcaggtaatttttgtaaaattgaataatatacaacatatgagctcaagatattgattagaaaactaaattattataattatggttactcgatttgcaatgagatgttaaatttcttctttggtatttagtgagacttcaaagattctgtgttctgtatatggtatattatagctcacgtgtcttaattttattgataggtttcaatacctctgttttttttgcctgcttgatataccactttctgaaaagggtattttgtaatctccaactacaattgttgatgtcatgatttctccctacaatttaattgttgcttgatacactgtaatcctatagttagttacatatgtgtttgtttgtggtaggcatggtggagaatcagttctattattccctgaaatattttatacatatttaacattcttttttccagcatgacatttttactgtaaaatctttgtcagatactgagatttctactcctgccttcttttggttcatattaccttagtctctctttttccatcctttgagcctcagttatcctgtttttgatatctacctcttccttttcctgaatcagaaaatactttaacatatatttatgtcctatggtctactggtccacacccccaccacagctatatcatattgataatgtcttcattttagttttggattaacttgaatacattttcttttattttgtcctggctttattttttttttagacaacaatttaaaaaataacttctactttccatattactgggtataacctctactttctatatcacttataacatacttgaatattgtcttcaatttcttgaggatactcttaagtacatatctgtccattgcaaacattttaaaaactgtatgcctgagaatatttttattacagtcttacaagtaatggactaaatagctgggtagaaaattctagctaaaatgattctccttcaaaatggtaaaaatgggtttccattatctgtttgcattcaatgtgttggtttgctcatttgtagatgatcttttctatttaaaagttttttgaagtttgttcttgtatacaatattttcaaattttcctagaatttatctgagtgtgcttttttttttcctttcagttgtttggtcctctgtgagctcttttacttaagatcattcatctttcttgaattctgagaaattcatttccattatttcttatatacttcctcagcttcatttttatttctctactcttgagactcataatttcgatgctggcacatttatttctagcctgtatttctcttagattttctgttctatctcctctgtgtcctttattgctgccctctggaaggtttcaccacttatcttacgtctatcctactatttatatgaaccatttcttcttcatttcaactgtgacattgttcatacttacatttttacctagttcaggtttagagatgctttgctcctgtttgataccgttattgtcctccctatctcataagcatatttaccatgcttagctgagctccttgatctgtgtgttcttgtaattatgtttctgatgcatagattgtctcaaggatcagttttgaacttctccttctgtcttttttttttttttagacagagtttcgcttttgttgcccaggctggagtgcagtggcacaatctcggctcactgcaacctctgcttcccggattcaaacgattctcccgcctcagcctcctgagtagctgggattacaggtgcctggcaccacgcccagctaattttttgtatttttagtagagatgaagtttcattgtgttggccaggctggtcttgaactcctgaacctcaggtgatccacctgcctcagcttcccaaagtgttaggattacaggggtgagccaccgtgcctggcctgaacttctctttctatctatactctttctctggtgatctcatcctgcttcatggctttaaatattattgctatggcatgattcccacatgtttacccccagttggaacctctcactgagttccagactcagatatcccactgcctatttcttatctctgctgtctgtataacaggcctcttcaacctcaatgtgccagactgacatccaagcattctgcacatgtgccagctgacctgtcgtcttctccatttcagtgaagacatttcattcttccagttattcagaccaaacgtctttctaccttccacattcttgattcctttctttcgtacatattctgcatccagtttaccagaaagctgttggctttacactcacagtatatccaggatgtgaccacattataccactccactgccttatctctgaccccgaccaccacgttttgcctgcgttggccccgtagccggtcttcttagtgtacttttgcctctttctactcaacacagcagacagaggagagtctgttagcaggcaggccagatcatgtcagccttttgctccaaacagtctaacagctgtgtctcactcacagtgattgtcaaagcctcgctgtgacctatggggctctacctgatgcccatcccccttcacctctgactcaaccctctgacttcagcctctacctctctcttttactcaccctgttttgcccacattgatcttattcttcctcaatatgccagacttctttcaggacttctgtcaaaagtcatctttcttccctcacccccatctaaaatttcaccaacattgttgaccattttatagctcccctccctaattcacttttctttcttagcatccatcacaacctaatattatatatacctgtttatcctatgtatcaattaaggtacatttacatacagtaaaattctccctttttcgtatacagttttgtgtgttttcacagatgtatacagaagtcgaaacaccatcacaataatgatataaacagtctcattgtcataacacactgccagactctttctgaaactggctgtaccattttgcatttttatacaaaacgtgtgagtttcaggtgctcaccgctgacagctgcaattggcattatgagggttttctttttttttggccattctaattggtatttagtagtatcccatggttttaatttgcatttctgtaatcattaatgatactgagcattatttcatgagctcgtttgccattttgatgtttttcttgataaagaatctgtttgaatattgtgcccattttcttacttagggtttttcttattaaatttgagagttctttatatgctctggatgtaaattctttatcagcgaaatgatttgcaaatgttagttttcagtctatagattgtatttttactctttttgtttttttttttttttgagacggagtctcactgtgtcgcccaggctggagtgcaggggcgggatctcggctcactacaagctccgcctcccgggttcccgccattctcctgcctcagccccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccatgtctggcctgtatttttactcttaaaagtaattttcaaagaacggagatttttacctttgatgaagtttaattatcacctttttcttttatggatttaatcaaagttcaaccacaaatgtaaacacagtagaaaatctatctatctattgtctatctatctatgtatctatcatctatctttctatctagatcatctattctcgacagcaagagagaaagagatttattacaagaaattggcttacataactgtggaggctggctaagctagttcaatatacgtagggcagacagtcatgaagatgaagcccctcaacaagttgaaccgtgggcacgggcgtgggcagtatttttacagaatttctactctccaggtgtttattcctgatatatagaaatctgattgatgtttgtacattgaccttgtgttttgcaaccttactgaagtcacttattttgttctagcagcttttattgcaagttctctgggattttgcacaaagacaattatgctgcctacacattgtgacgtgtttctttctttccaatctgcatgccttctgtttctttttattcgcttattgtgctagctaggacctccaatgtcatgttaatttggagcggcttgattagcgtccttctgttgttatatatcttatgtactgacttcccccgttcctcgccagggttagcaccacagggagggatgtggaggtagggctgtttctttttaggattcttggctctttctccaatgccagtaacaacgctctagtaagcagtcaataaatatctgatctttattatgctgtttagtttgttttctttctcttgagggagttttagttcttgtcttggaatttgggcctgtgaacacatatttgcaaggtcataccacgtcctaaagaccagaccccgcttggtgggtttaggaaagagagggagggtgaggcccagtgtggagagcccaggcccctggaactctggtggaccactgccatctgctgccactgcttccagcacatcacggcccttgggaagaagtggtgctggaggaggccccgcctcaggggaaatgcaccagtctggggacttggaggaagaggatggaagggaaaggtctaagagcaggtggccattctcgctgatttttgccccagctaggatttcctaaaccttcacgttaccccaaggacacctgcataggtggtgtgggctgtccttagcatttttgcagtgtagcgtcacgcaggaatcatcgaaaagcattttctcccaccttttgactgctccatccagtgactatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctgccacagcttttacttttctcaggtattccctctctttccttttctttcttaataactttttttttcttttttttgagatggagtcttgttctgtcacccaggctggagtgcagtggcgcgatctcggctcactgcaacctccacctccctggttcaagcgattctcctgcctcagcctcccgagcaggtgggattacaggcgcgcgccaccacgcccggttaatttttgtattttagtagagatggggtttcaccatgttggtcaggctggtcttgaactcctgacctcgtgatccgcccgcctcgaccttccaaagtgctgggatgacaggcgtgagccaccgcgcccggccttaaataacatttttaattgcaggaaattccaaatcgatgtgcagagaatattgtcatgcccccatgtccccttcctcccagttaaacactatttgctcgtggccaacactgctaggctcctgatcgatgccgaaagccacctcggggcatcacaccggtggtgaatttgcaccgcgtcagtttagcaaagccgctattgcacttcctagaatttcttctgcggcacagttccagggagcctggcccacaggggagctgcgtgagatccggaaggccgcagagcgctgggccaggttgatttgatgcgtggggggtccgtgcggggcatgaggctgccgcttccagacatgctgttgcttctcttccgtcacaggcagagcgggccttgccgctccccgtgctccgtgagatcctccttcggcttctctggtttctggcccaggccagggtctagctccatgtgaaaagtcaccttctcctgcaggcacctgcgcattgagggtgaaggcttgaacgtggcgagagatgaacccggctcacagcttgtccttgtgtgggctctggcccattctcccaagttccagtgtcgcccctgttcacccgctgtacatcatgttccctgcccagctacccgcctgaacactcagtctccagcaccagcagcagcagccccaccagcaccagcagcagcagcagcagcagccccaccagcagcagcagcagcagcagccccaccagcaccagcaccagcagcagcagcagccccaccagcagcagcaccagcaccagcagcagcagcagccccaccagcagcagcagcagcctggcataaatggtgtgaccagctcccctaggacccttactgtttacctctcctaggggttctgcttctctcattgaacgcttactggaaaaatatcatttcatctataaatatcagtatggatctccaaaaaatacaaactcatttaagtaacgaaacctgcatgtccttttctaaaacacacacaaaattaaaaatgatttctctcgagtctctttcaccctcccaaacacactttgagaatctattttcccagaactgatctttgggggagaaactcatgtaactcccatcttcctggcccactaaaatataccatctgatgaaattctattagcatattattgttttaaatactggtatctccgatagagggcagatatcttgtaaaaagataggctattataaattatttgtgaaaagcattggcttgtctagaatatcttttgattgttttatggtcactttaaagtcacttttaaatgtatttctttctttcttttcttttcttttttttttttttttgagacaaagtcttgttctcttgcccaggctggagtgcagtggcacaacctgggctcatagcaacctctgcctcctgggttcaagcaattctcctgcctcagcttcctgagtagatgagattacaggcgcccaccaccacgcaaggctaatttttatttttatttttagtagagacggggtttcaccatgttgaccaggctggtcttgaactgttgacctcaggtgatccacccacttcagcctcccaaagtgctgggaatactggtgtgagccaccgcacccggccctcccttcttcttcttttttttttttttttttttttttgagacagagttttgctcacactgttgcccaagctggagtgtggtggcacgatctcagctcactgaaacctctgtctctcagattgaagtgattcttgtgcctcagcctccctagtagctgggattataggtgcccaccaccactcctggctaattcctgtatttttagtagagatgagtttaccatggtggccaggttggtctcgaactcctgacctcaagtgatctccctgcctcagcctcccaaagtgctgggattacaggcatgagccaccctgcccggcctaaatgtacttatttcttaatgatattagaaagtttgtatattaatgtgttggcacagagtatgcacctatgctagtatagggacaattattgtgatggatataatttaaaaagccctgttattattagggaatctaatatattggtattggtgaaatttcttgataaaatttcctggattttactccatcatccattaatatttgactgaatttatgagccactagaaaagtaagtagattatatctgaacctgttgacgtaatgattgtgaatctgtttagcattggaagtgacttttgagcaaatcagattgtaattactaacttggtaatcaattgatcattgttcagggagattagtgtaagatgtccttccataatcagaaactgaagtagtcagtttcccagcatttatttttatcaatactagtagcaccaaatgatgctttatagcaaaagcaagtaaagaaaagagaaaatatatcctttttggaatttgaagagagttttaaagttagagcccaaggttgaaatagccatcacaaaggaaccgaggatgaaattaaggagtaggtcagggatgacattaaggttttgataataactgaaaattagaatccttgccctgcaagaaacattcccacacacaagcaggaagactgctacacaaaacccatttgttgttttacaagacacacatctgctaacatattgtatttggttgccagttaccaggaatagttttctgtttgttttataaccaaaatgtgatgattactctgaattaaggcaggaagaaagcttgttggttcaggttttatggcaaagaagttggtactaatagttaaggcccagactcctaacgcatactgataattcttaccttgtctatgtgtggtgaggagattcttccacagtcttagaatttaggataggattacaacgccagtgtgctgactataatgagcaatcatttatttttcaccagaaagggaaaacaacctttctgagaaatatttgctggaagcctggaaattaaaatcttatgggacaaagtaagatcattattttcctccaatatgcagacttgattatatttctagccctatttaaatgtatgaaaaatcagtcatgttattaatgattatttcaagttgttccatttttcagttaaactgattatgtgtaataattttagaagagtggcatcattaccgcagttaaaattcatagactcttcctgtttgcctgaacatttctaagcatatattttaaaaaataaaactattcaaatttttgctacaaagatgtttttctaattgattgtcttgtttctgtattgtaaaagcattttgaaaaacattttttagagtttaggtaagtttagctgtatattctattatttacttattggcaagatgttaaaaaagttgatatttcagaattattgaaacatagcttgtgttcttttttttttaaacagagtctcgatctgtcgccaggctggagtgcagtggcacgatctcggctcactgcaacctccacttcccaggtttaagtgattctcctgcctcagcctcttgagtagctgggactacaggctgcgccaccatgctcagctaatttctgtatttttagtagagacatggtttcaccatgttggtcaggctggtctcgagctcctgacctcgtgatccacccaccttggcctcctgaagtgctgggattataggcatgagccactgcgcccggcccatgtgtgttctttaataagtgaataaagcaaacataatatggtttttagaaagacatatttgtttagtttgtaaattaacttacatgaaagcattgcttaaaatgtcctaatgtcatgtaaagacttcaaatccatttagttattaaattcttccataaatatttaaattatattaatgtataatatccaacacccaatccaagaacatttatatataattggatacaagcattgaaaatgcttttgcaataaagtaaaaaaaaagtttttgcacattttccaaggctaaggaaaacttatatagaactggagaagacaatgttaagaggtgcaggtgaactaatataaaactgagttgtagttgtcttacgttttccatccttcctcactcaaggctacgggaattgcagccacttaattgagatttatttgcaacacactattgcaagggaaataaagagtttagctggagtcaccttttagtttcacagtttaatctattgttgttcacatgatatgtcttctccagctcatgacgtgtcctgttcttccaggtcctaaagtaggatccccagagaaaagcaaagtcagtccgggcacggtggctcatgcctgtaattccagcactttgggaggctgaggcgggcggatcacgaggtcaggaatgtgagaccagcctgaccaacatggtgaaaccacgactctactaaaaaatgcaaaaattagccgggcgtggtggcgggcgcctgtagtcccagctatttggcaggctgaggcaggagaattgctgggacccgggaggtggaagttgcagtgagccgagattgtgccacttcactccagcctgggtgacagagcaagactctcaaaaaaaaaaaaaaaaaaaaaaaaaaaagcaaaatcaaagaagataaatacctatgcccgtatttgcacatgggttaaattcctcctgggacaaagggagatcagtcagtcttcaacagtctggagcagtgtgttaacattatagggtggcagtcatatttatgctacaggtcaaaagctaatagccactgtagaattctatccattttaagggaaaacttagtcccataatataatatgatgtaacctagcacaaaatagcatagaataacacaacgtatcaatctataatccaagtaatagccaacaaaactaaagagtttacaatcttgttatattttcttacaaacataaaataattcaacatttctaacattttcaaatagccccttctagtgaatagcagctgtttcaaatattacactcttattgcaaagtgtaattttgtattacctaatgtcataaaatacagaaacatttgactaagcctgtcagccaattaaaaaaatatatacacctagtgttttcattatgtacaatggagtttataaataaatatgtaatgagaataaaatctaacttcacagtttgctgaacttttgaccaactgtttttgggtaatttggatatagactatctcctcattattaattcattcaaaataaaaattaactaaaaggtataaaagttatttattcatttaactggcatacatgtatgcccatgactgccaagcggtcgactaggcactgagtattacacaatggtaaataaacaggcaaaattgtagtttcctcggtggaaatcagtctaatgtagtgctacctactgtaattaactagtagagtgtatatgtgtgttttgttttccttgtttttatatagaacaaaaggaaaaatacatcaccatgataaagaccaagtctttcttctctctttccccgtttctagaggattccagaaaagtgatgagtgactaattttgggaaacatggcttcatcgcaggaaacaggtgaatacatccccatcctgtgtgggaaggaaacaggacagccattgttgggtggcagaacctacaaggggcattaccctgttgatttactcactacaggcaagaatcccaaatgcaggtgggaaattttactgggcaccgatgactcataagagtccattgtagttaatagaagtaaagccagaagtcaccttagatcatctactgaccacatgggaaaagctgaaataaaaatcataacactagaaacgctttactcaacctctgctgatctgatttattgaatcaaagctttcatttgcttgagatgtgaaacatactgatctcaacacactgaccagggtctacgcagtggtgcatacctgtggctcctggaacacgtcctctctaagactcccacatccttctattcctgcctggtgacaatgcttaataagaatggttgttcccaaactgatttacgttggttatatttcataattacaaaattttattaaatattatgtaagtaggcagggcatggtggcttatgcctgtaatcccagcactttgggaggtcaaggcgggtggatcacttgaggttaggagttcgagaccagcctggccaacatggtgaaaccccgtctctactaaaaatacaaaaattagccgggtgtcgtggcacacacctgtaatcccagctgcttaataggctgaggcatgagaatcacttgaacccgggaggcggaggttgtagtgacccgagattatgctactgcactccagcctgggggacagagcgagaccttgtctcaaaaataaataagtcaataaataaataaatattatgtaagtaacaaaatgagtgtggaaaagaaaattgtttctataccagctaagtaaaatggattggaaatatttgatgaagcaagtaggtaagaaaatcatgagtggtgtagaaggcacgtgttacgaaggagggtcaaaccccagatgggttctgcattcagatcgcttctcaagtggctccttttcaaaggaagctaaacttgaattcatagatcaagaattacggttttagtttaggtcagaaaaataatacctattgccagtcagaatcacatatgcaaaaggcctcagctctatggcaaatgttgggcaaatgaatgcaaatttatttgttttgagttaaaataacatgtttaggaaatgtaggtatatattttaaaaataattcatttaaccacagatcttgatagtttcaaataaaactatttctcatatttacataaatcattgagacagtctgaattattataacttaaacagtaaaagaagtaaatagattagaaatgtgtgaacaaatgaatgggtgtaatgagtaaatgtttctattctaaaattcaaactttggcagggtgtggtggttcacacctataatcccagcactttgggtggctgaggtgggcagatcacctgaggtcgggagttcgagaccaacctggccaacatggtgaaactccatctgtactaaaaatacaaaaagtagctgggtgtggtggtgcacacctgtaatcccagctactcgggaggctgaggaaggagaattgcttgaactcaggaggtggaggttgcagtgagctgaaattacgccactgcactctagcctgggcgacagagtgagactctgtctcaaaaaataaaaaaaagttactttcaaataagaattttaaattattattttctatagggacaatagaaaaaaatgccttgcttcttgcatggttgatcgaaatttgaatttcaaaaagaatttttttgagacattctaaaaaaaaataattttgcatgagttttcttaaagagtacctccaaaattgtacagcctaggctgaagttcactgttgcagtcacggcttattacaacttgaccacccggactcaagtgatcctcccacctcagcctcctgagtagctgggactacaggcatgtgccaccatacctgtttagtttattattttttgtaaagataaggtctcactatgttgtccaggctggtattgaactcctgggctcaaacaatccttctgcctcgatctcctaaaatgctggaataacaggcatgaaccatcgtgcccagcctagaaataattattttagctttttaactctttattggcaatgtgaaatttttaggattattgtcaaagtttggaaaacttctattgagttgcttttgcataagcactgtaagattgagaacatttttgctgtgttagtgacaattccacacctcttacagtatgaggtaggctaagatatgtgacctgaaacggtgggctctgaaaagcatgtggatgctcctagagtcacgcagctatgcctgctgaccgtagtgttgccacaatgcttcacggttgcaagaattcaggaagtcatgcttcacctgattcctttacaaaaaaaaaatcataacgtgtttatattgtttatagttggcttttttttccccctgagacagtgtctcgctctgttgcccaggctggagtgcagtggcacaatctcggctcactgcagcctctgcctcccgggttccagtgattctcctgcctcagcctcccgcgtagctgggattacaggcatatgccatcacgcccagctaatttttgtatttttagtagggatggggtttcgtcatgttgaccaggctggtcttgaactcctgaacccaggtgatctgcctgcctcagcctcccaaagtgctaggattacaggcgtgagccaccgcatcggcctatcgttggcttttggaagtggcttatgcaatagatggtcctgacgcttaagtttgactagattcacagttgacctagctggaagaaccaatcattcacagataggtgagggaaggaactgggtccagaggaataacatccaaagaaacttcatgttttcacagtgaaatattcgctcatgctgtgtgccaaactgtctaggattctgcactgctgttgatggccactgctgcactcccttctactctgtgtgctcaggtgtcattgtttattgatgttttcatctttatcataaccataagactaccttaagttacacagtgcttttgatttttgaggaatgtacacacacacacacacacacatacacacacacacacattatctcatcagtttttgcttttttgttacatccctatcaggcaagtggagtaagtagggttgactcgcccagggtcacctgtttcaactagaacattgtgataccacatattcagggtttgctccaggctgtatcaagttcttttctgtatcgtatttatgatattatgatatttgaacacgttcataagtctgctggcattttaggttagttaatgtgaaccgctgccacagacgacctctagtcatagtaatcacagtaaatgcttatttctcagtccaatatcttaaaggccaatgaaggtacttctgatgcgatggctctcacccttcctgaggggcccaagctgcttttgtctcatggtgcagccacctgaaatgcagtctccagtagaatgagaaggcatccaggagagggcatgcaggcatcaaccccgcgacacagatggctgctgtcacacgctgcggtagtggtcacatggctgtgcctacatgctgtgaagtagggaaacatattccctggcttggtaacaactttctgtacagggaagaagtaaggaaaaaatgtactttatttcaaaaatcagttatttcagtcaagtttttaaaaagacaaggccaaaagaagagacaaacttataaatagtttcttcttggctaccacaccaaaaccttacttttaagcttaaaccatgaagaaagatgctcaggatatgaaactaaaaagacattcagagggcagagtacctatatataattcttttatatttatattttccatatccatatcttgtgtgaatgcatttttgtttggaaacctgaaatataatttattatagatttctattctaatgtatattctgatttaacccccatatatttttagaagcatattattaaacattttgaattcattcaagagcattttttttgttttttcttgtgtgtttgttttgttttgttgcatgtggtatttcagaataccttatgggacatgaatccctttccagggagctgcagtttagtgggcagataaaccgcattcatgaagtcaaatgcagtgggaaaatgcaaatgcctgagagatgcatgtagagtacttgggaagtctgggcaggaggaagcgggaagggggttgaaagttgaaaaactttggtgatagcaagataggcttgtccgttcaatttttatgttttccttcatttaaagaaaaagttaataatccaagtgcatttttaactaccagaaaatagaaaacgatataaatgtttttgacagagtaaaaagctatttcttggcaaaacaaagttagtattagtttttcttttgtagaaatcattctcagtaaccaaaaccgtatggtactggtaccaaaacagagacatagaccaatggaacagaacagagacctcagaaataataccatacatctacagccatctgatctttgacaaacctgacaaaaagaagaaatggggaaaggattccctgtttaataaatggtgctgggaaaactggctagccatatgtagaaagctgaaactggatccgttccttacaccttatacaaaaattaattcaagatggattaaagacttaaatattagacctaaaaccataaaaaccctagaagaaaacctaagcaataccattcaagacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaagttttccaatctacccatctgacaaagggctaatatccagaatctataaagaacttaaactaatttacaagaagaaatgaaacaaccccatcaaaaagtgggcaaaggatatgaacagacacttctcaaaagaagacatttatgcagccaacagacatatgaaaaaatgctcatcatcagtcatcagagaaatgcaaatcaaaaccgcaatgagataccatctcacaccagttagaatggctatcattaaaaagtcaggaaacagcaggtgctggagaggatgtagagaaatgggaacgcttttacactgttagtgggagtgtaaattagttcaaccattgtggaagacagtgtggcaattcctcaaggatctagaactagaaatatcatttgacccagtgatcccattactgggtatatacccagaggattataaatcatgctactataaagacacatgcacatgtattgtattctagcactattcacaatagcaaagacttggaaccaacccagatgtccatcaatgatagactgggttaagaaaatgtggcacatatacaccatggaatactatgcagccataaaaaatgatgagttcatgtcctttgtagggacatggatgaaattggaaatcatcattctcagtaaactatcgcaagaacaaagaaccaaacaccgcatgttctcactcataggtgggaattgaacaatgagaacacttggacacaggaaggggaacatcacacaccggggcctgttgtggggtggggggaggggggagggatagcattaggagatatacgtaatgtaaatgatgagttgatgggggcagcacaccaagatggcacatgcgtacatatgtaacaaacctgcacgttgtgcacacgtaccctagaacttaaagtataataatttttttaaaaaaagaaatctttctcatttgctcaccaaaaagatttagtggagatatatgtatctccactataatatatgcagcagatatatttctatttcctatatacatataataggaaatagaaaaatatgttgataagcacagaaattatgtattatgaagagtttcaagatagtttttactagttttataaattaccaatgccttctcactgtctaagaatttaaactccgtagaaatatttcttttttttttcttttttttttttgagatggagtctcactctgtcgtccaggctggagtgcagtggagcaatctcggttcacttcaagctccgcctcccgggttcacgccattctcctgcctcagcctcccgagcagctgggactacaggcgcccgccaccatacctggctaattttttgtatttttagtagagacgaggtttcaccgtgttagccaggatggtctccatctcctgacgtcgtgatcctcctgccttggcctcccaaagtgctgggattacaggcgtgagccactgtaaactccgtagaaatatttcaaacatttaaaaattcaaagtgacggcaattagcccggcagaaacaaatctgactgtgctttccttgtcccttgaaagtgtcattgaagctcctgtctaatgaagattgtggcatcagtgttcaggcttgtcacctgctcctcgtaagaacaaatagggatacttagagggaaacagtttgctacaggtagtgttctcccagagagacaaaacgcgaggggccgagttgtataatcaggtgtgctgaaactccacggggcactgcttaacaaggttgctttttgtttttgtttttcctcagtgtggttagcaaattaattgactggagaaaaatgcacatttagaaacaagctaatgtgcgcggcatgcaaagtcgagccttctgcacctgccagtctctcctccccgctgctgccgggaactccccgcgatcccagatcggcctgcgctgccttcctccttccctatccccgggacgccccgtcaccctcagcctcgcgtgcacggtgcactcccgccagggccgctcacgccctggtttctgtcccggctctactcccctcccgctcagtgattaaacaggtgatggctgagcacctgccagggcgccggcggtgtgcagggccccgggctccaggccttgctaagcgggctggcccgctcccggggctcggtggaatgaggggcaggactcggtggcccgcaccgccactgccagctccttgtttgcagacactcctctgcgagtctgacgattgtgcccttgcttaatcctcggacccgttctccgttctcctccgcagtaggaagcaggggtgccgccggccccatctgcccgtgcccgacacggacgaggccttcacgcagccctgaccctttccatttcccagggacttgcttctcgttggctcagccccagggccctggattcctctgtcctcgcgccggcccgcggccaggccgctccctttgctcgcagtgggtcttgtagcttgctgctcggctgggacggccaccttgcacctgtcggtgctgcagggcgctctccctgggcctgggacatcggtctctgcttcacttcacctcacgggtgggcccggaaggcttcgtcttcctacgcctcacctgaagctaggctgtgattttttaatgagctcttccatacatttatggagtccctgctataggctcagaatcgctctaggtgtcagagatgcagtggtgaaaaagaaacgagtcttatcatccagcctgtgtgtggacagaaaaggtttaaagccaggccctgttgtgcctcattgctccaggagacattttcctggctgagtcaaaaacagaagctgcctggattgcacctatcataggaataaaaactagcatttattctgtatttactatgaatcagactcttgtgactgttatatgtattaatttaatcttctaaaagtcccacaaggtggatacccatgccatcccattttacaggtgagagcactgaggttcagaggggtttaaggccacccaggtagtaggaagggccagattcagtgtttcctcttaagtagtcttcatagatcctttatgcctagtcaagtgcctttgaggacaaaagaagagagaagcagggagctgtgaagaatagagaggtggccagaacaatttcccttatgctgggaaggggaggtaggcttgtgagcagggaagacccacatgccacatgctggtggtgcctgggaagttgacaggaccccagaaagagggtatgcccagggagactgcaggctgtcagcttctcagcactggccaacactctcatacatcacgcgtggcacagaaatagagccctcagatgcaagggtcctcatgatcttgaaccatgcagttgtcagtggtgaacaatgaggcttaagaataatggtcctttcccatttatttaggtggtcacaactgggtcccagtatgatccttggagggggagagggccctataatgtttgtacttaaatgtcctgacattcccagggatggaggctcagaatgaggactgcgttctttaaaggaataaagaaatggccgtgtcttgcacctgcatttcctgtttgattcatagctacaacatggcaaatgtcaatgaatacagaccctgtgtcaaggggtgtgctatttccttgatgcattgtggtgaataaaaaagcctgacttgggccgggcgcggtggctcatgcctgtaatcccagcactttggaaggccgaggcgggcagatcatgaggtcaggagttcgagaccatcctggccaacacggtgaaaccctgtctctactaaaaatacaaaaatcagctgggtgtggtggcacgcacctgtaatcccagctacttgggaggctgaggaaagagaatcacttgagccagggaggcggaggttgcagtgagccaagattgcgccactgcactctagcctggcaagactctgtctcaaaataaataaataaataaataaataaaaaagcctgacttggctgggcatggtggctgacacctgtactcccagtactttgggaggctgaggtaggtggatcacctgaggtcaggagttcaagaccagctgaccaacatggtgaaaccctgtctctactaaaaaaaaaaaaaaaaaattagctgggtatggtagcgcatgcctgtaatcccagctactttggaggacaaggcaggagaatcacctgaacctgggaggtagaggttgcagtgagccgtgatcacgctattgcaatctagcctgggcaacaagagtgaaactctgtctcaaaaacaaaaaaacaaaaaacacctgacttaataaagtccacagttgaatgggcaaagccaatattaagtaaatacaaaatttaaatacaagttgtgcattataagaaaccaggatgctctgagaggagataatggggagatccaccatgactggggtcagggaaagtccgtcctgaaaacttcccacagaaagtggaggtgaggagctcaggaacacagggtggggaggagagattctgagcacagaggacagacagcacaagcaaagagtagaaaacagtcacagaactgaaaagacacctgggtacccaaggcatagtaagggaggggcacgtgggattcagctgaagatgtaagtcaatcgggtgggggtcagtcctgtccaacccatggcccgtgggccgcatgccacccaagatggctttgaatgcagcccgacacaaattcataaactttctgaaaacattatgagaattctttgcgatttttctttctttggctcatcagctatcgttactgttagtgtattttatgtgtggcccaaggaaattcctcttcttccattgtggcccagggaagccagaagattggacacctctcatgtaagtagcagccggaaactgaagaacctcatgtgtctcatcaagggcttgtagtttaatcttacctgaaattggaaaacattgagggctttacaaaatagagaaaacaattagatttactttatacaagatcatttgaatggagagaggaaatggcaagatcaattgagaagctattgttataggtgaggaaaaagttggaggtggcttacggtggagacaggcagcgcaaagagaacaggatgcaccagcaatggattttagaagcataactgataggactgggggaagtgtggtgtgtagggggcaatggagaaggtgatgtccgggagatccctagcgtgctggaggtgatgtctactgagatggagtagaaacagatttaggatcaagattaagaattcagatgtgcggctgggagagatggctcaagccactttgggaggctgacgcaggcggattatctgaggtcaagagttcgagaccagcctggctaacatggtgaaaccccgactctactaaaaatgcaaaaatcactggatgtggtgtcgtgcacctgtaatctcagctactggggagggtgaggcaggagaattgcttaaatctgggaggtggaggttgcggtgagcagagatcacaccactgtactccagcctgggtgacagagcaagactctgtctcaaaaaaaaaaaaaaagaaatcagatgtgtgagctccaagaagacatttaatcatactgaatatctggatacttatttgtcaatttaaaacccacacttaatttacagatagatagatacatctagatagatcttatatacacatagataggtcttttatagtagatcctatgtatattttatagtggatcttttatatgtatcgatatagatcatatatatctgttgctatttgtctaaagcaggagaaatctgaagactaagctcatatgtgctgattttatcttgaggtattgacataaacaaccggaatgaatgcaaataaagtccacaatgcttctggaatgttctataaaggcagatctacatctgcagaataatatgcttatgttagtcagcagagctttaattatttaattgtcttaccacactagcccaagaaagattttaagcctaagcctttaaaataaaaataatttacagatgctatagagagagaagtaaagtcgtccactattgatcctgtgtccttgatctgccttaccctcatgatcataaaatagaaagtacataaattaaggttttcaaataaatattcatggcatggtgatgtctaggcaaatttctttgagtagaaaagctacatgctggcttcctctaaaatactgagaggctatggtcacgagctggagggaggcagtcctcctgtaggtgatcagtgatttttttaatgctacagacttggacaccattttcattttggttgtaaggattttcatttttcctctgtgttttacatattttctcttgtttctacaccctagataccagactgaaagctgtgagcaaatgagaactctaaagttctacctttcactgtcacacaccatttctgtagcctaatcaaaatgcggcatctttttcctaaggcaatgccatatttttctctcatcatgacacttaatttaaaggtggcagactggaagatgcagtgtcctgtgacaaatttgtaagccgtgaattgatccctgccccacacacagcaatatccaagcatggtctctggcaacttaccataaatcatcttttacttctttgctcttagactttctgagagctgaatggcaatgcggagacagatgggggtcagctcttcactgtcatccatagctgctggtaatttacgggcgatatagaacacctgtgagttatggtgtcttttgtttgcctgagttgtcctttgctgaggactgcaatgcctacatcataatgtttgagtgtttactatcatatactacaaaaaaatacctaagtcatagaagcatggcattatacccatgagctttaaggtttatccaatcaaaaagccatttctctttgggcttgataccctgcgtctgatgtacaaggatgctggaggaatacgaatgccagtaagccacatagagctacagcaagctcttcatttcatggtcattaagagagctgagagggacttcattatagcaggtcttcgacagatgaaatggttctgcctgttccccggctctccacaaacaaccgcaggaggaactgtgcccacgttgttatgaaaatgcactttataaaaagtaaacataagcaccatattaagaggaatggaagaaataagtaccttgctgtttggaaaatctcaagtgcgagtttattcctattagatccttttaatttgtggaagaaagtacagtcttaattgcatgaacattattatcattaattaatattaatcaaccagatatactctcccaatttttcaagtattttctgcactctttataatcattgatgtttatcactggcctaagaagtgaaacacaaacctgcaacatcaattaagagatgatggattatggccaggcgccgtggctcacacctgtaatcccagcactttgggaggccaaggcgggcagatcatgaggtcaagagatggagaccatcttgaccaacatgatgaaaccctgtctctactaaaaacacaaaaattagctgggtgtggtggcgggtgcctgtaaccccagctactcgggaggctgaggtaggagaatcacttgaacctgggaagcagaggttgcagtgagccgagatcgtgccactgcactgcagcctggagacagagtgagactccgtctcgaaaaaaagaaaaagaaacaaagagatgatggatgatataatagtagaaggatcagttattatgagtggcaaacatgaaggagctgtgatgggccataagaaaatgttagcatttatttaacaccggtctaatgatccccacctggcaagcataggcaagtcttcattttcacttttaatttacctggcacatacattcacttatcatactgtgagataatcataggtttatacatctgtacttctattgatataagttctgaaataattaagaacattagagatggggtggtgatttttaaaaaaaattagcattcaaaactaattctagactagttctcatatattaggcattcaccttttaaacaaataaaggaacagataaataaatggaaatggaaaaaagaaatagggtaacagaaatacatagttcaggggccaaggtgtaggtctatgaatataaaatcagtgttttcacagtttcgtataatttaataaatttgaaatagaaaccacatagggtgctacatgaacttttaaaattaaatgtacagtctctgatttgcaatggtttgattgaggatttttcaactttgcaatggtgcttaagtgacaggcattgaatagaaaccatactgcgaccattctgtttttcactttcagtagggtcattagtaagttatatgagatattcagccctttatttacacaaaataggctttgtgtcagaggattttgcccaactgtaggccactgtaaatgctctgaccatatctaaggtgggctaggcatggttgtgatgttctgtatggtaggtgtattcgtgcactttccacttaggttattttcaacttaggatgggtttaatggggagcagggggtgcacacaactccattgtaagttgaggagaatctgtgttctgttttcaaaatccatatgttaaaaatgattgatgtcaaataggcttccaaaacatactctaaaataggcaaatccgctgaagtatggaaagagcacgacacagttttactgcacattcccctggaaacctttgtctgaaattttccaaatattcaaaataaggtattataagttctctggagagggatttatttttaggaaaaggctgtcattgcttgtggagtccatattcataagtggtttttgtatttggtattaattcctctatactataagacccagaaagacatgttctgtagggtaagtatactaactctgatacggtttctttcaacagattgttctcaataattaaaatggcaacaatgacaacagaaaaatcagatatgaatagactctatgtcttctagtctttatcacaataacctgatattttaatcctgttaagtactatattattccagagtatacaaagagaaacagtggcggtgtgtaggcgggatagattaggctggtataaactcttttcatataaatgtatgcattgacgtgcaggcattgtgatgcttcctaagtcaattcaattaaagtcataaaaacttcacaaagctgaccacacctgtcaaaaaaatgtcaacgctcatcagccttctatttcttctttttttttttttctagcctaattcaggccactccccattttaggaatttctagattgcaagacttaaacttaatgatttcactgaactttgcctattatagtacattttccttctttgtgtcagaaaggcatataattgtgagaaatgtgatttagaataagggagagcagtgatttttaataaaaaataacatgatcgattccacaaaatacaacaccatttcagagagcttgaaggtataataaaattctagagtgaataattatataacggcttatgagctttcacaaagcaaatggtaatcaggctaagataaattaactaagattaagaaataccagattattaactactttttaaaatagtctttttagacaggaagatttggaaaatgctatcaacatgtcatatatgaatttcaataaaaaatgtgacaaagacattctggggagtattttgggcaagctagtgacttgtagattgtatagtcacccacgtgaatttgtaattgactgaaggccttctttcacagatgctgctgctggttcatggctgtcctggacagacgcctgcagagtgtgctcaggcccatgtgttcagccctgccgtgctcactatttcatggactggtgatcgaaaaaagagatggagccactctaatgagataaaacaataggaactgtatagaaacagagctgggtagatggagtgtaagagtggtacatgtggccggggaggtggctcacgcctgtaatcccagcactttgggaggctgaggcaggtggatcacctgaggtcaggagttcaagactggcttggttaacatggtgaaaccctgtctctactaaaaatacaaaaattagccagacatggccaggtgcggtggctcatgcctgtaatcccagcactttgggaggccgggacgggtggatcacgaggtgaggagatcaagaccgtcctggctaacacagtgaaaccccgtctctacgaaaaatacaaaaaaaaaattagccaggcgtggtggcgggcgcctgtagtgccagctactcgggaggctgaggcaagagaatggcttgaatctgggaggcggagcttgcagtgagccgagattgcaccactgcacttcagcctgggcgacagagggagactctgtcaaaaaaaaaaaaaaaaaaaaaaaaaaaaaggaatggtacatgtgaaaaggacttatagcccccccgcttttattcttttgtaattttgtaatttatatttacagattgtccttttctttttttaaaaaaaacacttatttaaggataagcaatctgtttgcttgaactggcagtgttgtagaaaggttccagtaaagagcgttttcctccagtggagctgactttgtgctcagtctttacaccacgaaagtaagggtcatgtggttgtggtatctggggaaagagaaaaatgtcaaattcagacatagctccgtaacttgaacgtaacttcctcttttaaaaattatttttaatataacatagttttctgtaaaataaagtaaaaatattaataatagtggatttaatgtcgagcaggatacataatttacactatctacaatacttacccactgataaactccacacgattacaactgattcatgaaaatgaataaataaacaattcagctcagttgagttagaaacatttccaaaattaaatggaaggcaagtgttataagcaaacaaaaagtgttacatgaaagtgaggataaatcttttgcagtaaattattaatagatacccattttttattttgaagattgaaatactaccacattttaaatatagtaagttcaagcacaatttaatgaggaatagtcaataatattcaatataactataaaaccagtgatgtataataactggtacataaaattctaatacagagtgttaatttttttggtaaaatatagttaaacaacaatcatattaaatcagattggcattacctacagtgccaattctttcctgagttagaggttaaataaacatgtgattgagaatttcaagttgaatctaaggacaagaagttagtctcgcccagttgtgttgacacaatctggccagatgggctggctggaactggatttgacaaaaagtagtggggactgctccaaacctccgtgtatgcagcaaaaggttaaaaatgcgtttcaaacatttctgctgaataaagttagaaacgagcatactgtgtctcgaagtcgacatttccatgaagatgaaggaggcattgagtgcctgtccgcgtgcctccatggccagtgcattgaaaggaaagttacacctttgaagggagctggtggacctttggctgattatagaatacaatcatggcgactcacagagccacataaattaaaataggaactgcctggatggttgtttaaaacctccagaaaaatacctcaaaggcgagatgttaaatgcttgaatcagacatctcttgttataagtgaaatctctgttcctgctacattttagtaacattattgcaggaatttggttaagtgtggatgcaaaggacagttgtatcgttaaacagggctaactacagttgcaatattttagacaaaggatcacgtagaatcagaacctggatttttacatactgtggccttatctgcagtccatcttcgtgtttgcttgcttagctttcacagaagtaaactacatttctaataagggctcataaatttgatcataaatgtattttctttaagaacttcgagactttcattggcaattgattatttatttttcgctgatcttatggccacacttatttaggtgacattctttaacctgatttgtgaatttaaacttggcaattaaaaagcggaaaacaaaacacaactttgcattagattgggtgtagtgaagtctgtgggttagcccatatgtaactttacctttcacactgaatttatgtttctatttctgaataattcagtaaatctatataaattatgtaaatgaccaatacctgaaacacaagctaaacctacacaatagatagtcacacacacatatatacatctgaaatgtaatgaataattcaaaatttgaattgtaaaaagcattacagaataaatttcaatgacaagagatttgatcgacacagcaaaataggtcaccacagtcaaaagtttgcccccatttaatgctggtgcctgagccgtcctaactggtccgtgaaaacttcgacagaagaccatgcttctttttatttgctttgagcagtgcgtatatacctgtcttgtactttttacggacagtttcagttagaaccactttgatacaagaatactactgaacatttacatttttagcagaggtgctttcttttcttcaaccagcaacaggcatagctgctgcaatggttctctctccaaggtagctggagctggcgcttccaggagggtggggatcaaagctgcgaagagaaacctaaagaactggtctcaggctcttgcccatgtgaagcataaaagtagagagaggaggccgggtacggtggctcacacctgtaatcctagcactttgggaggccaaggtgggcagatctcctgaggtcaggagttctacagcagcccggtcaacatggtgaagccctgtctctactaaaaatacaaaaaaattagccaggcatggtggtgggttcctgtaatcccagctactctggaggctgagacaggagaattgcttgaacctgggaggcagaggttgcagtgagccgagatcatgccactgcactccagcctgggtgacagagtgagactccatctcaaaaaaagaaaaaaagaaaaaaattttaatcagatgccatgtacacggagaacagaagcttggagcaaagatttagaaggggctaatttatgtctattcagggtaggcacagaagttttttggtaaggtgcattacttctggcagagctgtatattgtaaagtagacagaggatgatgtgctgtgtgaagaataaggtttcccagtggtcatggtagaaaataatataacaagtaaatgaatgttatcttcaggttgaaggaaatttttcatatggctttttttttttttgagagagagagaagggagccttgttatctttcccatgcttcagcctcctgagtaattgggattacagtcaccagccaccgtgcccggctgaatgactttttaaaagctttccatttagatcaccatattatttatacagtgttgggatgttcaagtaaattatctctttgccttttcttttttttttttccaatgagataaacttaacaatgcagagcaggatttctttagtcttggtggcttaccctaaatcatattgcaaatgaggtgcatttagtttgtcttcagcatagcatgtttaccacctgagaatgataatgaagcagcaaatagttactatctactgagggtgcaatacactgactatgccatgtgttgagttcattcattcctcctgacccatggaggggtagaacatttcagtaacttagactgtaggattcgaggtctttaacattaaagtcattgctccaaactcctatattaataattgcaaattgcttattcacacaatgatttacaattattaatattctttgttcctttgcttttcccgcaaatacttatcaagcatcttttctatggcaggcactgttttttagggcacaaacattgcccaaagtctttccccttgttttgtgtatgttctaagggggaaacagacaatacaatatgtataatgaagaagcaaacaataataagacacaaggtcaaatactgttggtagtagcgcagctgtgaggcagatatacagtatagcggatatataatatagcagtttgctatattaaataggattatttaggaaggtgacatttgagcaaaggcttgaaagccacagacactcttcatgatgctagaacaagattgaaaacaaccccttccttcctgtcaacttacctatccccaggctgctatgggtattggaggacatgctaccattgccatactcctgggacgcagtgacaggataatagatgttgaagtggtggctctttacccaaacagagcatttacatttagagatctggggctagatatgtcaggcaatattccctatggtctgtctgactgtgcggtcctgctgttattggggtaggctagttccttggtgttcatgttgcatttgcctctcttccgaatgcagtatcagtgccttattcctctttatatacccatgtcaccacttccacaagcccagtatttatgccaatgcattgcagaaaagtactaagtaaatttttagatattgcaaaaatgttttttattttcaagatacatctttttacaaacataatacttttagtgaaaattactcacgaatggcaacaagaagaatcaaattgtactggcaaacataaaatgctttagtttaatcagacatttgctagtgttgtcttgttttctggtgccaagaagaaacccttaacatgcaagagaaagtgaaaaagtctaggggctgagaccatgtgaacaaacgtctttctgtcctctttatggtgaattaaactttgctcctctgacaggccaaatacaactaattccatattgggctgctttttcctatggtaaagcatgaaaaatctatccatgaatctatgtatagttataagttaattcaggcacattgttgccttagaatgatgaaatacatgcttacggaaagcaatctattggttgagactaggaaaatgctggctggagcccatgctgtctgttggaaacggagctgtggaaattgccagctctaaatgagataggaaatttgttgattggtttgttggatttctttttctccattattttccaaaagaagaagcaggcatgaattctggcaattttctatttttcccttgcttcccagatttagctcactgattgcataattttcttactgctcatttttcaggaaagtccataggcattagccactgccttttgatgccagtatgcatcagaaggcagtggctaacagggagtgtgtgtcatttccccgggggccaatcagctcaactcagtcacatggtaagtcagttgaaaggaggcagtgggaatcatagatatgggtgatatttttttttccttcccatggtgctcagagggcacaaaggaattctaaacaaccatcttattagttataaaaaatttttcacctctgcagaccttcacactacacttcaatgacactattaatttctcttaattgaacaggtgcaaacctttatcctgttttatattaataaacaggtttgaaacctctttgtttcaaatataccatttaaaaattagtgctaatgtttagttatgatggtctctgctgtaacacattcatgcatcaagcaattagtcatttcctagtgtgcacactgtattgttttaacctccaaagaagaatccagatttgctcccaaatctagaaacatggtcagatgcaccacttgatgatgaatacaaaatcttgacaattcaattttggtaaacagtaaagaatgtgtatatgccacacctatggaacatatcaagtaagctgacatcaaggagcacacagctaatatccgagcacttaacaataaacactttctagtgacatttctaggaaatcatacaaagtaggagcatgggtcaaaatgattagaaggcagccaggaaagtcttcacactggcatcataaattttattctttatatacatttctttttctagttgctaaaattaggaaagctggtagaagaagaatgggaaaattgaaggtaaataagtgatagagtgtttatttacaactgtgcctaagttcaaaaaaaaaaaaaagagagagagaattggttacctgtgaaactgttacctactcatctgggacagctgccctctggtttccttcagaactctacagaaaagactgacttagacaaatgcttgtttggaaaagatttttctttcacctggcagcttctttgcattgctactgcattaatctttttccatgcctgttttgttctcattttttgtttgtttgtttttgagacagaatcttgctctgtcacccagattgcagtgcagtggcgcggtctcagctcactgcaacctctgcctcccggattcaagtgattctcctgcctcagcctcccgagtagctgggattacaggtgcccgccaccatgaccagctaatttttgtgtttttagtagagacggggtttcaccctgttggccaagctggtcttgaactcctgacctcaggttatccacccaccccagcctcccaaaatgctgggattgcaggcatgagctactcagcccggcctcatgtggattctttggactccagattctcctccttcaatccagttttatatatgcaaccaccacacatagctttctcaggcagagttataatcacattcctattttgcttggaaaactttgcacaaatttgaaactagtacatgcacaaggtttataaagatgtaaaaacaaatatatagttagagtataattaaaggaagaatttatcaaatagcaactaagattaggtgatgtgaccatatgagtacttttaaaatgtcgtttgagttttcatatttatcaaattctctaacaaattggtattaatttagtaatttagtaatcagatacaaaatgttataaatatatttataacataatacttttttttctggctctttctcttattttgtacactaagtgcagtaagatgtacccgagggtttctttcaagtcttgggtctttaaaagatcaagcgacgcttgggagaggacagggaaaataaaatatggactgagtagtgtagatgctcagcctagcattcatgaggtttttaaagtttctgcatgattcattccagctcatgagctaaactgctacatgacacattagaactgaaggactcactggtgctgacgagtctgcctggagtgtccttagacatcgaagcggtgtcatggtgataggagaggctggtcagggaacccagactcttggccatttcttcttaagaaccattgctaacaagaagctttgatcagctgcagggaagcaactcattcctggggaaagggcatgaaaagaaccaggaaccatttgagagcacaacttaacagactgacacttaagaaaagggttggaatctttttttttttttttctttgagacagagtctcactctgtcaccgagcctggagtgcagtggggcgatctcggctcactgcaagctccgcctccaggtttcaagccattctcctgcctcagcctcccgagtagctgggactacaggctcctgctaccacgcccggctaattttttgtatttttagtagagatggggtttccccatgttggttaggctggtctccagctcctgactttgggtgatctgcctgccttggcctcccaaagtgctgggattacaggtgtgagccaccgtgcccggcccggctgctgccactttgcacccttatctctttcacacttccattgagaagcgtggctatgagcctgtgattggaccttctctgagaatccagcgagtgggcactggagaggaggaggtgggggactggacaccccactgcaacacttccccagctcctgaagtgggttgctgtgtccatttggagagttagagagagatctttcccaatagcccttctctaccatctaatgcctttctgtgaagagatgggaatctattttaaaaacttggtccgtttcttcctcttcagatcttctgagttgacgttcccactttgtgagtttactgaaagcaaaaaacaaaaaacaaaacccaaacaaaaacctatcacaatcagcttttactcaaaggtagtttggggagtagttagtcaaaggatggagagttggacaaaaatcgtcctatgtcccaggcacttagggggagactgcaggtctttctctaggcagtcacacatcacagctttctgggcaatctgggtctggcttcttacttctgcagtgcagatatagcagagggtcctgtgctatgtgttgtgatcactacatactgtgatcccagtatccccaaatgggattactcgactgctaggcaaatagcactgggtcctttaatgatggggtgttgacacacgtagtgtgatgaatccctcattgctaaccttccaagaggaggtattgcagtcccctgctggctggatttcaagtgttggaaaagcctaggattgactgcggcaattgcagcgctgggtagagttcagtgggtggaagccgggaagataccacatcgttaaaggcatattcatcatcttaagagcaggcagccccggggaagagtgtatttcagtttttgatagtttgtcaaggcacagtacagttcctttgtttgataatcagttcattttcctaattcaaaaggccaataccaggacgaaagacatctgagatggaaagtagaacttggtttcagcgtgtatgtgtgttaagtgcatgagaaaacctgtaagctacatgtcactcggagtcttcttttaaccttaacattcactctgtttcatattgtctgtaaagttcaatgccctcttcaataattctgcaaatctgtggataagagtgtgtgtgtgtgtgtgtgtgtgtgtgtgtgtgtgtgtgtgtgtgtggaggggatccatatgattaatttctgggccctcattctggtctctgttacgttctttgctgttattcctttatctctactctagcatttatgtgtatgtttaactcactccattccttgatttttccaccaaaaacaaaaccaaaccaaataaccagagtcctttgtttaatataactatgccttttttttgatctcgtgagatagaggaggatttttatcactgggatgtgaacgactgttctaaggagggaagctgtccagtccttcagagtgccctgttgtcctctgccgctcccatttttctcctgtgtgtgccctgttccctctgcttcctcagattctcctcctcagttactatcaatttgtagaacagcaggctcaattattttattcgcttcctgctaccgtatttgcagagtatcacctttcaccccaaacagcttattaagataatttccacaaaggatagcaggattcccagtgccagcttttaagataattactcaacaatcctgacacctgatttttttacaggcttgacgacattgtaatgaagtccattctacttagaatttcagtaacaaaatcttctggaactgccttccccgattacagttcctgtttatcccccaaacacccaatttgcccccatccctcctccttcttccctgcttagtggtagagcatgcccacacctcccttcctctttggaacggatgagacacggccagccctggttttccttcaatcagcagtgtggaagcagatcatcctagctcttaaaggctctctccctggccagcagacatatctcaaactgactgaacgctcttcttccagaatgtgctaaggactgtctgacattcttccttaaggctgaaccattattcatttttgagagtcctggaatttggaagataaactccctcctactctagcttttgggactcctttctatttggccactcagtagtataactgtacaaaagaaataaacagctaaagttgagtggctttttctgagtcacttcacaggttcaataaagatgcatcattccatgtcttcctccatttgggctgctgtaacaaaatatcatagatggatggcttataaacaacagacatttatttatcacaattccaaaggctagaagtcccacatcaaggcactggcagacttcatgtctggtgagggcccatttcctggttcatagacagtgtcttcttgctgtgtcctcacatggcagaagaattgaggggatctctggggtctcctttagaagggcactaatcccattgaggggccccacccttgtgacctcatgtaacccaaattacctcccaaaggcctcacctctatcaaaatgggggttagattttttttttttttttgagacgaagtctcactgtctcctagtctggagtgcagtaatgcaatctcagctcactataacctccacctcctgggttcaagcaattctcgtgtctcagccccctgagtagctgggattacaggcacgtgccaccacacttggctgatttttgtatgtgtgtgtatttttagtagagatggggattcaccatgttgcccaggctggtctcaaactcctgacctcatgatctgcccacctcagcctcccaaagtgctgggattacaggcatgagccaccgcgcccaggcgggggttagattttaacacagtcagtctacagcatgcggttttcttttcttttttgtggggggacagagtctcgctctgttgcccaggctggagtgcagtggcacgatctcggctcattgcaacctccgcctcccgggttcacaccattctcctgcctcatcctcccaagtatctggctctacaggcgcccgccaccacgcccggctaatttttttgcatttttagtagagatggggtttcaccgtgttagccaggatgatctcaatctcctgacctcatgatccgcctgcctcagcctcccaaagtgctgggattataggcgtgagccaccgtgcccagcccatgcctttttcttattcattgtgaagactgaaaacagacgaataacttgctttatgtcagtatctttatttccctgtcagtgtattcaatgacacagaaaatacttgattccataaatgctcccacagaaaaacacttcatgcaaaccttcctctccatgtcttctgtccattggagaacccaaactaaagaatgtctcacacgtagttctgcacattccttcccattagcctagttgtttcagatgaaaatttagaagacagtgtaggaggcgggagaagccaagaaggaaggaatctgcatttgaagaagggtcatatgcataatcacgaatagctatttggatttgataaagaactgctattgtgtttggatatacagaaaataaatgtttggaaatatagaatatacacacccaaacatatatacacacacatgttggacacatattggactttgttacaacagctacctatacctttactgatacagatctcactacttgccaggcacctggttctaggcccattaagaactgtctcagtgacctcagtggggcccctcatcaatggctgccatctaggttgagcactctcggctgagttcccagtttctgtcattcacggtccttcctcttcagggatgcagccaccttgcagaatgctataggggcgtcaggcactggccttgacatcgaagcctctgtcttcttgctctccatctctttgagttggaccactctcttctgcttaggaagtaccaggctctctgctccctctttttcccaaaccaaaccaaaccaatgtgtttttactgccgatggataggcctgccacttagaacagaaacataccttagcttcagatcctgttgtcatatgagtttgtaggttctaattgaatataaaaattcaaatttcttttacataaagtatctctctctctcttttttttttttttgatggagtctagccctgtcgccaaggctggagtgcagtggtgtgatctcggctcactgcaatctctgcctcgtgggttcaagcgattctcctgcctcagcctcctgagtagctgggactacaggtgcgaccctttacacctggctaatttttgtatttttagtagagacggggtttcaccatgttgcccaggctggtctcaaactcctgacctcaggtgatccaaccaccttggccttccaaagtgctgggattacaggtgtgagccaccgcactgggcctatctcatgtttttttgttttcagctaattattattactttagaatcactgtgtgagctagatgagagacatcttcatattttaagcaattgcagtttctggcttagcgcctccattcattcagcaaacagctttttagccctggtttgtgccaggtgctgctccaagtgctaaggatatggcatggcacaaggtgcatgtgacccccagtcttgcagcgttgatgtttagcattataatacaataattggctgaacttgaggttttaagagatgagggtgatgttaagagatttatcttttcactgtttccagttcctattgtagcagtaggaacaagaaaagtatgaatatctcaacagttaatcctgttatatgtagctataaggacattgctacaattaatagatagcttagaaatagcaggagaaaggacgggcatggtggctcccgcctgtaatcccccagcactttgggaggctgaggccggaggatcacgaggtcaggagatcaagaccatcctggataacacattgaaaccctgtctctaataaaaatacaaaaaatagccgggcatggtggcgggcacctgtaggcccagctactcgggaggctgaggcaggagaatggcgtgaacctgggaggtgaagcttgcagtgagccgagatcgtgccactgcactccaacctgggagatggagcgagactccatctcaaaaagaaaaaaaaaaccaccaccacaacaaaaaacaacaaaaaacaaaacaaacaaaatacaaaaattagccgggtgtggtggcggacacctgtagtcccagatacttgggaggctgaggcaggagaatagcttgaacctgggaggcagaggttgcagtgagctgagatcgcaccactgcactccagcctggtgacagagcaacactctatctcaaaaaaaaaaagaaaagaaagaaaagaaatagctggagaaagcagaactgatgtgagaaacaatagattctagaaactaaatctaaatttgcaataattgctgcaatttattgagcaagtacatattagatggctaagtttatatacactctcatcataacagcagctctaaaaaactggaattattatgctcattttacacatgataaaactaaggtgtagaaaggttaagtggcttgcccaagggtacatagctaatagaaggacatttaaaatcaaggttttttttttctttttctttttaaattttattttagattcaggagtgcatgagcagatttgttacaagggtatattgtgtgatgttgaggtttgggctgctattgatcaagtcacccaaatagtaaacatagttcctgatagaaagtgctgtagcctttgttctcttcccttcctctctctcctcttttggtgttgccagtgtctaccgtttccatctttttcatctttttttttttttttgagacagagtcttactctgtcactcaggctagagtgcagtggcgcgatctcggctcactgcaacctctgcctcccgggttcaggcaattccctgcctcagcctcctgagtagctgggactacaggcacctgtcaccacgcctggctaatttttgtatttttagtaaagacggggtttcactatgttagccaggctggtcttgaactcctgacctcgtgatccacccgtgttggcctcccaaaatgctgggattacaggcatgagccaccgtgcctggcctactgtttccatctttatggatgtgtatacccaaggtttagccccacctataagtaagaacgtaagatatttggtaaaattcaagttctacatgcatgttcttttctaaacattgctaccctgaagaataaactgagaacttttatcagaattgagtctaagctgacacacaacatatcactagagaggtcctctcacgtttccatgataccattttcctaccatcatggtgggcctgatggacattgacttataagccagagagtccttccagtttggattgcacattatttttctagctcagagaccggcaaattacggctgcaggccaaatccaaccctctgcttatttgtatattgcctctgaactaagaacatttttaaatggttgaaaaaaatttcaaaagagtaagtttttttttttttgagatggagtctcgatctgttgcccaggctggagtgcagtggcgcgatctcggctcaccgcaatctccgcctctcaggttcaagagatttccggctaatttttgtatttttagtagagacaaggtttcaccatgttggccaggctggtctttaactcctgacttcaagtgatccacccgcgttggtctcacaatgtactattattacaggcatgagccactgcgcccggcccaagttaggtaatttttgattcggctttataggcaggaaaatgagactcagagaattataatgccctgctcaaagacacacaaagtagtaagtggtagaaaaggaggtttaagactagatctgtttttatagaaataaatacaaagcaaaaccaaatcactttgtaccgtaatatgtcatagttcatgaacaaaaggcactgtgtgcagaagccttatgtgcagaactccattccaaatagataatcttttttccttcctctattgttagaatcaggaagattttttgtaatttaagatactgtgtttctccctataacccactccattggcagcactgtggctaaccctgtttctcatggctccttctacctttaacaaaatttaaaacaggtaattgtgctgttaattggggcttgggggatgttacccttccttcctctggaagggttcaatgttcaaaggcatctagtcattatttagtggtgaggtaatgtctctagaatttggaagtgaagctcaaacagaaagaaacagcaggactggacgggcttccaaagagtgacttattttaaagagaccgattcatcttttactaattggagatacctagttccaattaatttaaggtagtgcctcatcaaaatatgaccaaagtaaaaagaatattttgcaactccatcaagttcattgtaaactttcttaagaaaaaaaagttttggccgggcacggtggctcaagcctgtaatcccagcactttgggaggccgaggagggtggatcacgaggtcaggagatcgagaccatcttggctaacacggtgaaaccccgtctctaccaaaaatacaaaaatttagccgggtgtggtggcgggcgcctgtagtcccagctactcgggaggctgaggcaggagaatggcgtgaacccgggaggcggagcttgcagtgagccgagatcgcgcccctgcactccggcctgggcaacagagagactccgtctcaaaaaaaaaaaaaaaagaaaagaaaaaaagaaaagaaaagaaaagaaaagaaaggaaaaaaaaagttttaatctaatgccatgtacacggagaacggaagcttaaagcaaagatttagaaggggctaatttgtatctattcagggtaggcacagaagttttttggtaaggtgcattacttttggcagagctgtatattttcttttgtgggagaagggagaagttttttttttcttttctaattcaaatttcaccatggcatgagctcaatattcttcaagacaaaagaatcttgaggtcttgcttctcactgcatagaaagccaatcacagagatgatgtgtactgccagggaagaaggcattttgggtgttgcagctgaaaagatggtagatcagttttaaatccacctccctagctgactaaaatgaggggtttatatagcagggaagaaatggaaaacaggaattcgggtggggtaaggaagaggagttggttgacaggcagcaggtgatcagttagacaatcgtgatgggtgaggggtctggcatctcatcgtccagaggctgtgatgtggtgagtttcagcttctttgaccaggaggcctgatggttggtttcctgttaaaggaactcaggtaagacaaatgtacctttttcaagtttcaagactgggagggaaaatttctacattgtattagtcagggttccctagagtgacagacagacacggttctctaagttcatatatatatgaacttatatatataggagtttattaagtattaactcatatggtcacagtgtcccacaataggccctctgcaggctgaggaacaaggagagccagtccaggttccaaaactgaagaactcagagtccgatgtttgagggcaggaagcgtccagtatgggagaaagatgtaggctgggaggctaggcccgtctctcttttcacattttctgcctgcttatattctagcaaccctggtagctgattagatgatgcccaggcagtttaagggtgggtccaccttccccagcccactgacttcagatgtcaatctcctttggcaacaccctcacagacacaaccaggatcaatactttgtatccttcgatccaatcaagttgacactcagtattaaccatcacatatgtttacacaaaagtaaccataaacttcaattatatgggacaactgggtcagtttcatttctaccttcgttttctcagagcccatgttgattaatgaatattttgaagatgaattccatttctacagtacactgagtacaatggagagtagaagaaatcagtattcaagtagctgcaaattgatgactttgcattccggtttaactctagcagttgactagagtagcctgtcttaatgagtttattcaatgctatgttccctgagaacatgtttgctgtttgggtagtccctgatctgcagggaatcagctcacaaaggagtggccaacaagtgaggtgggagggtgcggtcagggttgactgtgaggttccctccgtggcaactttgcagcctcgacaatactttttttttctttttttaataacgttttgcttttttggttcacatacttctttcgtgttgccatgtttaaacattgacaacactgctgaccaatttatttaacaggtccatattctaaattcattgaggaacatgacaaaaatgtggatcctactaattagtattttgttccaccactgataaaatatttagcagatacactaatctaatctccgttcttaatgttggctttagaggaaacaaaatcatgtcttaataataaagagaaagctggatggaaagtaagaataatcagcttgcattctgcatttccctttgaagtgaaaccagagaggtagaagagtttcagttgcgttgcttacatcaatagatcaaccatttaaacagaagcgtaactaaccgcaaatgcttaaagatttggcgtcattccaaagttgagtttttgttgttgttgttgttttttgtttgtttgtttttttcttgagacagaatctcgctctattgcccaggctggagtgcaatggtgggatctatgctcactgcaacctccgcctcccaggttcaagtgattctcctgcctcagcctcctgagtagctgagattacaggtacctgccaccacgccaggctaattttttttttttgtatttttagtagagacaggttttcgccttgttggccaggcttgtctcaaactcctgacctcaagtgatccacccgccttggcctcccacagtgctgggattacagtcgtgagccaccgcgcccggccagttgagttctttagatcattgtattttgaaccattcatataaacttgtttttaatgagagatgacctccttgatcttcctacagcctcacaggatgggactacagtctacattgagaggctcacctcaggaagatctagctactggtagaggtcatcagtcttgttaataagctgactattggcctctctttggtgtgacatcctggcacccttgatatctacagaaagaaatcagtgctggcattcaatgtaaatctccaaaggggcttaattggactttttcaggttaagataaaatgttcaatttttagcttaaagatgattctgggaccataaacatgccagatttgagttcagttaaggtaattatgtgggcaaaaataaaagtgcaattaggttgttctagccttaactaagtgcaattatcaagaacactaacctggagaaaataggttcattctttacattttactaagcttcccaggtttgctgtttctattttcacctgtcagtgggggtagaactatccaagacacttccaaacactaattccagatagtctttcttttacaaaaaacagtgttaaaaagtttttaaaaagaaagtaaaggaagatagctttcttaggtattctgtctcttttttgtaaacaatgaaaaaaatgagagaatttttgggtgtattttgagtactattcgttgaattgataatgtagtcagaatgtagaaaagaaaacatgaattataatttaaaagtttgactgttttggtcaggctgattgtttctagttaattactgataaatcagttgctttctcacacaacaaattctatctaatcattaaaacatccctagtgtctggaacacaagatgattcgtctgatcactttggttcttataatgaacacatgaagttgagtttatggcaagctctggactgtggcagcgactggcaagattaaaacaggagcctggcaattttcgtttacaaaatacaaaataatatccatttcagaattgtcagtttagcaaggtttctagtttaataaaatgaaaatatttattggcaaaaatatttggatttgttaaaaatctgagaattgtctaatctttcatggcaggtgatcaatgcatggaagaggatagagctcttcatcctagttcttctccaggttccaacctgagtctttgttcatgtgtaaacatgctatacaccaactcagcccactataaatatgctatatcatgaactgtttcatcaaggagttcctttaatccaacaatttcaaggactctttaaaaaaatttttttttttttgaaatggagtctcactctcttgcccaggctggagtgcaggggcgcgatctctgttcactgcaagctccgcctcccgggttcacttcattctcctgcctcagcctcccaagtagctgagactacaggcacctgcaaccacgcccagctaattttttgtatttttagtagagatggggtttcactgtgttagccaggatggtttcaatctcctgaccttgtgatcctcccgcctcggactcccaaagtgctgggattacaggtgtgagccaccgagcctggccttaaaaaaaactttttttttaagagatggggtcttgctatattgcccaggctggtctccaactcctgttcgaagccatcctccttctttggcctctcaaaatgttgggattatacacatgagtcaacatgcctggccccagggagcctttttaaaagaataaatatgtatgtgtatattttcttcaaatattaaatttggaaacaaatgtatcatacttttttccagtggagtttatttgcctaaatataggaagtaagactaagaagctaaactgttacttctagactgcattcaggaaatttgtttttccccaaaatttttattcattttactattttttggatgttatgaaattttttttctactgaatcggcggaatcaactggatttactaagttaaaaaaacagtaattttcaattagccatacactgtatatctaatttcatgttattgttgtatttaattcatgcaaccttcttagaaggtaaatgtcactgcagttttcattttgcagagaaaaaaatgaaagttagtgaacttgcctaatgctgggcaactatgaagtggctgaagccgtgtgtctttatttctaagttaatagcagaatatgtatagttaatggtttgagcactggtgttagacacatttggaattgaattctgtttccatcatttacttctctagatacttaattttacttttctgaattagaaagatacttaaatttacttttctaactcttggtgtgttcatctctaaaagatatagtaataatattgcctcctaggatacattcacgaggtttcaatgggataatgcaaacaatgcttttagtgctgtgcctggaaatttttagattttaaattttcaaaaagtatttatattattacaggcataaagtaagccaaaatttagcccaggggaggtacttgacgttttaaattagtttttgtattcttagcctggatacatgtatgtaaacccaagtttgattgtttgtttaataaaaaataaataaagaaagaaattcttaagactcctggaatcttgagcttcaaggctggaagtgttttccaagagcaaaaggttgatcagttacttcacgtcctggcttcttaaatattactaacatttcaacaccagaatgagaaggagaaagtgagggaaggaaggagtgaggcagagtgtagagtatgctggtgatagtatgcccagagagataacatttgcaatgggactttacaaacctcagctttacacagttagcctttgtgtaggatacattctaaggagaaatcctatgagatgtttcagattaaactgtagattccaaaataaaaacaattgggccgggcgcagtggctcacgcctgtaatcccagcactttgggaggccgggacaggcggatcacctgaggccagtagtttgagaccagtctggccaacatggtgaaaaaaaaaagattgtgtctgttgaaggaactcaataaatgcttcctaaacggtgtcacatgaacagttttaatttctcactcattaagagcaggactgtcctggggtctgaggtgaggctgagcttattaaaggggacaaagtcattacctattatggaggagataactctaaggacagggtacgaaaagccatagagtcccagttttcatgaatgcactcaaaaacctgaaaaattatgaaagacagggagaaagtcattcaaatacctctgagcaaggaagagtcaactccacactgaaacccgcgatggctgtcacatttcatggtgaagtacgaagcgggtaactgcctagacagagtgaggccagttggtcctccaggtgaggggcctgagtgccaaggaaacccttgcttctgacaatatccaagtgtttcctggttcctccatggttggcattttcaggcagaagtgcctgtggaaagttaatgtgtctacttagttactcagttttcttctcttttttcttttctttctttctttcttttttttttttttttttttttttttttttgagacagagtcttgctctgtcccccaggctggagtgcagttgtgtgatctcagctcactgcactctcaacctgccaggctcaagcaattctcccacctcagcctcctgagtagctgggactgcaggtgcactccaccatgccaggctaacttttctattttttgtggagacggagttttgccatgttgcccagactaatctagacctcctggacgtggtggcacatgcctgtagtcccagctacttgggagactgaggcaggagaatcacttgtacctgggaggcagaggttgcagtgagctgagatcgcgccactgcactccggcctggtgacagagcaagactccgtctcagaaaaaaaaaaaaaaaaaagattgtgtctgttgaaggaacttaagtgatcctattgccttggcctcccaaagtgtgggattacaggcgtgagccacagtgcccggcctagttactcggttttctaggagaagtgtcttagggactgatgtggcttcgacctgttgcttagaaaaggacaagcctgtcagaaatacatatccctgtggaagaaattagaacatattagaaacaaaacctctgccaaatatgcaaactttgcttcaatacttcatttgatttgaacaatggaagtgaaacttaccttggacaaaatcaagggaactttacacccttgtcttccctcttttcacgtactttcccctctgcatttggtggggaaagtcattcgcctggacgaactcttcagaccttcagatttacgtctttaacacctgcctatcaactgcatgattttctgtctttttctgacctggaaaagaaaaaaaagattttcttctccagaccacatggcaaagtctttctgattatccgttggtccttaatataacatgaaggcaactgtcaatttttttttttatactttaagttctgggatacatgtgcataacatgcatgcttgttacataggtatacatgtgccatggtgtttgctacacccatcagcccgtcatctacattaggtatttctcctaatgttctccctcccttttccctccaccgcctgacaggccctggtgtgtgatgttcccctctctgggcccatatgtctctctgttcaactcccacttgtgagtgagaatgtgtggtgtttggttttcggttcctgtgttagtgtgctgagaatgatggtttccagcttcatccatgtccctgcaaagaacatgaactcattcttttttatggctgcgtagtattccatggtgtatatgtgccacattttcttaatccagtctgtcattgatgggcatttgggttggttccaagtctttgctattgtgaacagtgctgcagtaaacatacgtgtgcatgtgtctttatagtagaatgatttataatcctttgggtatatacccagtgatgggattgctgggtcaaacggtatttcttgttctagatccttgaggaatcaccacactgttttccacaatgaccgaactaatttacactcccaccaacagtgtgaaagcattcctatttctccacaacctcttcagcatctgttatttcctgactttttgttgttgttgttgtttttgagacggagtcttcctctgtcgcccaggcttgagtacaatggttcgatcttggctcactgcaacctctgcctcccagttcaagcgattctcctgcctcagcctcccgagtagcgggaattacaggcacttaccatcacggctggctaatttttgtatttttagtagagatggggtttcaccatgttggccaggctgatctcgaactcctgacctcttgatccgcccacctgagcctcccaaagtgttgggattacaggtgtgagccaccgctccctgcctgtttcctgactttttaatgatcaccattctaactggcgtgagatggtatctcattgtggttttgatttgcatttctctaatgaccagagatgatgagctttttttcatatgtttgttggctgcataaatgtcttcctttgaaaagtgtctattcatatcctttgcccactttttgatgtttttttgttgttgttttctaaatttgtttcagttccctgtagattctgggtattagcccattgtcagatggatagattgcaaaaattttctcccattctgtacgttgcctgttcactctgatgatagtttcttttgctgtgcagaagctctttagtttaattagatcccatttgtctattttggcttttgttgcaattgcttttggtgttttagtcatgaagtctttgcccatgcctatgtcctgaatggtattgcctaggttttattctaggatttttatgatttttagatcctatatttaagtctttaatctgcagcaattgtcagttttatttattcactgcttatctgtattttctaaagttgcaaggaaaaaaatagtatttatttttaaacttttgttaaaattatttatttatttatgtgggccaatagagtttattaacctattgatctctgaggaaaaaatggatatagtgatttgattatatggttatttgaaatctttactgaagaaaagtcacaaattcttctatttgaagttaaatatgaagcttctacaagtgactggacaaccttgtttatttgtacctgtttagtactttccacaagtaacattttatctgtaatgctaccaagattttttaaaataaataacaactctattttgaaggaatctaaaatttacatggagaagcaagaacttttctataatattttgtgatatcgaatttaatttcaggaaggtaatccatttgcaattcatactcaagaacaggacagaccagaagcatatagtacagctcaattgtaattttccaaatgttaatttcatgttgtttcttcctttgatttttattctctttaaaatatttttcattataattctcaattcaatagatgcctacttatgcagcgctaacatattttcaactttcatttacacattctacagatatgcattaaacacctactgtatgcgaatcactgggtgaagaactgccaagcagtgaaccagcctggcaggtttgtctgctctcgggcagccttcgttctaccaattgagcattggataagaaactgtgatgctctgaggtacaaagaggactcaggtgtccctaatccagtcttcaggacaggcaccctaaaggaaatggccttcacactgggaaaatggagcatgagcaagagatagcaaagccagcaggggtggggttggagaagacatctcagacagaacagcacaggcagagaacagtctacagccttacaggacacattagtttcaagcctttaacttggggaaaaacagatgctattgaaagttttcatcatgggagtgacacgcagggctgctgcatgttaccacacacattacaacatgcatgttacaacaccttattgtacacaggatggtacctgggatgcatgaagaagagtacctcatttaagtgagtgctactcacattgtggacatctgatatttatatatttattagagtggttttctggtagatggagataaaatggcttgttctaacaaaataagtatcttctgacaattttttgacagatggaagtaaattgtcttgaggaaagggccttttaaaaatttatacaaaggcagtggatccggctagcagcagactctggctgtaaccgtttgcattttaaaatacccctctcatgaacatttggagagtaaatcaggagaaggaggtggctgtgggatgccatttaggaggctcttgtgttgtctgtgtgaggcatgatggtggtttggactaggatggtgacataaggtgaaagacaagtagacgtgagagatatttagtgaggaaaatcaacaggccttgacagttgaacagatgtaggttagagattcctagatttctggctcttaatttatcaatttcacttgtgattttaatagaaattaatcatctagctctcagatgtctagctactctcctgacaagccaagggactcccttaacaagacctgatttctttattcaaggttgaaatgcatctcttggtattctgcttcagtcagctttggccttttttggctgccgaaacaatcgaaaactgttatgcagttggtgtctgttataatcctcagtttgcattggactgtcctattttttcatttctccagctgctgaatagctgaattccttatgattacatcctccccctctctagtgctctctagaagcttaagctcaggattttccatggaaattcatttagttatttcctcttcattatcatacactcttcaattcaactcttttgaatttttcttctgttctctgatgagtttatgctttctaacttggtcatggctgaaaatatcattaacctgctgctgttttctgtatttgtcattaataacaacgttggaaatttggtttgactcccaccctgaggagctaggcagtgggcatgcacacgcgcacacacacacacacacacacactcacacacacacacacacactcactccagctcaaatgctttgcaattggaaacaccattcctcttcaggcctttgtaagaattattatgagtgttgatagcaattcaattctgattaagtttattaaaaagtaaccaacatctcatgtacattcaaaagtgttccctcttccattaattatataattgagcaaaaagttattttatctaaaatgtttaaagcctggccactttactatgcttctttttcgataacttaaacataccaatttctctatataataatttttaatcatttgactttgaggattctactttaatggaaaataggaaaaatggatgtcataatacattctcagtagggacttatcagcaaacagaaacaatctacaaatttcatggaggagtttgatggtggttacatttgccacaagacatggtggtttccgatgcccagatgatgacctgccctcgaccactgcagatttagtgtgttctttgctccattagcagcagggactatgggaaagacatttcaataagattagaaaacaaaaaaacagggtggggcctttggttaacacatggttaacagactattcaaggagaagataacagcataactgaagtatttcaggtaatcgggattttaactgcactcaactcaccatggtgaactcgcccttagaaaacacttttcagctatgggtgatgacgacttttcaattttcttcctcttattttccttgatgtctaccttctgtgcatatggtcattaaggaatgccaaaaggtgatgtaagaaaagtagaagaaaatgacattattgtatggcattctctacaaagaaatatgggcagtggaggaataattgtctcatataactttgggattatatgtaaatttctattactaattgctgtctaactttcatttatataaatttctgcatctactgtattttaactacacaaattaatatactttcaaaagattactgagttctgtttctcctttcaacattcaagatgttgggtttttgtacagtggggtcctctgcaatattggcttgcaagaaaaagtgaccacgttagagcattcctaacagtgcatggagaaatgacacaaggcaatatgctagcgcacaaacattgtcagtgtttccaactctagtcaggtactataaggtagacagctcaattgaagactatgatgggggtttgtgctatcagatgtcagaaagatattcttgtaggaagaaaagaacaaacttttttaaagtagcatctctcaatattattctgagtaaatggttccaagaaagcagaaacaagtttattacataggagcttcaggactaaatggaaatccaggctcagggcttgcaggaagagggttagaagccagaggctcagaacccagttgagaaggtggagcaggaggagcaaaaggaagtcatcaagtgaaaagacacagtgggagtcagaaaataccaaaaccaatagccaggtctttgggagcttcaagagcagtgatatacacataatcaaagactaggtcttaagagtcacaaccactgaaggatatttaagaaagagattttaaaaggttcctcaggaaacgttgttgagtgcctgtggtggggttccactaatgagcttcaagtgtgcatcacacacacacacacattatttttcctaaaaaaggtatcgtagctttcattagattttcaaaggggttaccaacatctcaaagaactaaacccacagtgttgtaaaggccttcttagaagctaaggatacgtatgaatggtatgttgtaaaggtcctcctggaagctaaggatatgtatgaatggtcattaaattatgatatctgggagcaaatacgtgtaccaaaggaagactgacaatcccacattgatgaagaccatcaccagcctccatgtgttggaaatttaactgccaaacaaatgtgtaacactgatgtttctgtatgtgatgaaaatgtctattctgctcacagttaatctctacttctggacactcctgctttctatagaaggtgattagattagaaaaaaagtatctgaatgttgaaagagaaactgggtatcataaaattaattattgaatgttgccaatatcacaaaaatacaaaagataattcaaggctactatgaacacctttatgtgcataaactaggaaacctaaaggagatggataaattcctggaaatacacaaccctcctagattaaccaggaagaaacagaaactctgaacagaccaacaacaagcagcgagattgaaatagtaataaaaaaatttgccaggaggcggaggttgcagtgagccgagatcacaccactgcgctccagcgtgggcggcagagtgagacaccatctcaaaaaaaaaaaaaaaattgccccagggcctgtcgggggcatgggggacaaggggaggggagcattaggacaaatacctaatgcatgcggggcttaaaacctagatgacgggttgataggttgataggtgcagcaaaccaccacggcacttgtatacctatgtaacaaacctgtatgttctgcacaggcatcccagaacttaaagcaaaaaaaaaaaaaaagtatttgacattaaaaaaaaaattgccaacaaaaagaaagtccaggaccagatggattcacagctgaattctatcagacatccaagtaagaactggtaccaacgctattgacactattccacaagacagagaaagagggaatcccctctaaattattctatgaagccaacatcaccctaatatcaaaaccaggaaaggacataacaacaaaaaaagctacagaccaatatccctgatgagcatagatgcaaacattcttgacaaaatactatctaacagaatccaatagcatatcaaaaagataattcatgattatgaaaccatgatcaagtgggtttcataccagggatgcaggggtggtttaacatacacaagtcaataaatgtcggccgggcgcaatggctcatgcctgtaatcccagcactttcggaggccaaggcgggcagatcacgaggtcaggagatcgagaccatcctggctaacacagtgaaaccccgtctctactaaaaatacaaaaaattagctgggcgtgatggcgggcgcctgtagtcccagctactcaggaggctgaggcaggagaacggcgtgaacctgggaggcgcaacttgcagtgagctgagattgcgccactgcactccagcctgggcaacagagcaaggctctgtctcagaaaaagaaaaaaaaagtcatacatcacataaacagaattaaaaacaaaaatcatacgatcatctcaatagatgcagagaaagcatttgacaaaacccagcaaccctttatgattaaaacactcagcaaaattggcatagaagggacatactttaatgtaataaaagtaatctatgacaaacccactgccaacattattctgaatggggaaaagctgaaagcattccccctgagaactagaataagacaaggatgcccactcttacctcttctattcaacatggtactgaaagtcctagccagacaaatcagacaagagaaagaaataaagggcatccaaatcagtaaagaggaagtcaaactttcactgtttgctgatagtacgattgtatacctagaatactataaagacgcctcaaaaaatctcccagaactgatagaaaaaaattcagcaaagtttcaggatacaaaattaatacgcacaaattagtagctctgctacacaccaacagtgaccaagctgagaatcaaatcaataactcaatcctttttacaatagctgtaaaaaaaaaaatacttaggaatatacctaaccagggagatgaaagatctctacaaagaaaactacaaaacattgctgaatgaactcatagagaacacaaacaaatggagacacatcccatgctcatggttgggtagaatcaatattgtaaaaatgaccatctgccaaaagcaatatacaaattcaatgcaactcccatcaaaataccaccatcattcttcacagaactagaaaaaaaatcataaatttcatatggaaccaaaaaagggcctgcatatccaaagcaagattaagcaaagagaacaaatctggtgacactacagtacctgacttcaaactatactataagtccacagacaccaaaagagcatagtactggtgtgaaaataggcacatagaccaatggaacacaatagagaactcagaaataaagccaaatacttatagctaaccaattttcaagaaagcaaacaaaaacataaagtgagaaaaggacaccctattcaacaaatggtgctggaataattggcaagccacaggtaaaagaatgaaattggatcctcatctctcaccttatacaaaaattactcaagatggatcaaagacttaaatctaagacttgaaaccataacaattctagaagataacattagaaaaacccttttagacactgacttaggcaaagactttatgaccaagaacccaaaagcaaatgaaacaaaaacaaagataaacagatggtacttaattaaactaaaagtcttctgcacaacaaaagaagcaatcagcagagtaaacagacaacccacaaagtgggagaaaatctttgcaatctatatatttgacaaaatactaatatccagaatttaggaggaactcaaacaaatcaacaagaaaaaaacaaacaatctcatcaaaaagtgggctaaggacatgaatagacaattctcaaaagaagacatacaaattgccaacaaacatgaaaaaatgctcagtatcactaatgatcaggaaaatacaaattaaacctacaatgtggtactaccttactcccacaagaatggccacaaaaaataaaaaaataataaatgttggtgtgaaagtgatgaaaagggaacactttcacactgctggtgggaatgtaaacaagtacaaccagtatgggaaagtatggtgattccttaaagaattaaaagtagaactaccgtttgacccagcaatcccactactgtgtatctatccagaggaaaagaagtcattataggaaaaaagatacttgtacacacatgtttatagcagcgcaattcacaattgcaaagatatggaaccagtccaaatgcccatcagccaacgagaagataaagaaattgtggtatatgtatacaccatgaaatactactcagccataaaaaggaacaaaataatggcattcatagtgacctgtatggaaatggagaccattattctaagtgaagtagctcaggaatggcaaaccaaacattgtatgttctcactagtaagtgggagctaagctatgaggatataaaggtataagaatgatacagtggggctgggcctggtggttcatgcctgtaatcccagcagtttgggaggccaaggcaggcagatcacctgagatcaggagttcgagaccagcctgaccaacatagtgaaaccctgtctcttctaaaaatacaaatattagctgggagtggtcatgggtgcctgtagtcccagctacttgggaggctgaggcagaagaattgcttgaagccaggaggcagaggttgcagtgagccaaggttgtgccattgcactccagcctgggtgacagagggagactatctcaaaaaaaaaaaaaaaaaaaaagaatgatacagtggactttggggactcggttggagctcggggaagggtgagagtgaggtaagggataaaagactacacacccggtacagtgtacactgcttgcgtgatgggtgcaccaaaatctcggaaatcaccactaaagaactttttttttcttttttgagacggagtttcgctcttgtcgtccaggctagagtgcaatggtgcgatctcggctcaccgcaacctctgcctccagggttcaagcgattctcctgcctcagcctcccgagtagctgggattacaggcatgtgccaccacgccaggctaattttgtatttttagtagagacggggtttctccatgatggccaggcttgtctcgaattgctgacctcaggtgatccacccgcctcggcctcccaaagtgccagattacaggcgtgagccactgcgcctggtccaccaccaaagaacttaaccaagtaccaccagttccccaaaaacctattgaaataaaaaataaataaaattattgtgtgttaaataaatacttctataaacaaatagaaggcatttttgtcagctcagtaagaaataaacacacagacaaaaaaccaatgctgctggctgccatcaagtgactacctgaaatgtcttatagtggcgaagtaaattcacaaatttccattatagggagacatttaatatctgtattttacagacttaactcacataatagcactactaaatgtccctttctattaacatttcagttaaattttcctccaaagtgatatgttcaagtggaggtttcagtaaaattgacacatttggcatataaattaatcatcaggcctaattatgccagtaggtttgttttttaaatcgggaaattggcacaatatatgtataagttgttgccaagacacgtattatatatttgtaatcattgaatattgctctaaattattagtagtgactaatatcagaaataaatttaatagattaccttaattaaatagtatgtatttacaaaacaataagagaaaaaattgtagagatatttagttgcacctgttcaatgattagtttaccaaaaaaactgagatttgaatatgccgagctgtgcatgtaaatgtattatgatgctatgctaatggcttaagagagggaatattcttttaaaaagattattttacatatataacgtaagtatactgaattggaattatatagggaagatggcaaaatataaaacaatttagactaaattatcatcattctgaagtttcacgaggttatagatagaaaatagccatgatttaggtttgtttattccctattttttcattgtttctcactaagatttatttggaaataaatgaaaataatactgaatagatttttatttaaaaccagcaaaattcttttattattatttttttcttaagtcttatcacaccaaagtttaaatgaagggaaaattgaagaagaaagagagataattgatataaatagcacagaagagtagaaagcaagaagactgctttaggctactaattaaaagagacaagataatttgcagtggtgtggattcaagaataaagagaaaaagaatacaacaaattattcttgatgggaattaagactgcttttagtagtaattcttatattagaatgtaagtatgactctaattaaaataatacccacagttgtcaagtagaaatatgcctgtaaaattagcatattgacaagactcgtattttttccaaaatgtacttgtaccattattctccaacagtctaacacatttaatggtatttggaaacctattagaaaaggtgtaagtattgcattccaaaggctatttaaaacctttcccaagagcacacaatttccataagactagataaaaaacttcttatttttacgagtgcattttacctcaatgtaaagcaaatgcaatacactgtctcatgcaacattgttaatttttccaacttaaatcaaagaggctataaggtagataactcaactgaagactgtgatggtggtttgtgctatcagatgtcagaaagatattcctgcagggagaaaagaactaacattctagagtagcagctttcagtgttatctgtgttatctcctcaaaaacctcacaaaatccctgtgaggcagttactgttaccattttacataccaggaaactgagtttcagaaaaaggttatgtaacatttccaaaagttgatctaattagtacatacctggcaaactacagaaacaaccagctattcaaataattgatctttagcaaaatattaaattgtcaaatatctaaacaataacttaaagctacttcagtaattaatttgaaaataattcaacatatttaaaaattttatcttccccattatatatgtaataaagatgattagaataaatttgaaaacaatgaaagaaagaaagaaaaccacagtattgatatgatttaaagaaagcctctcagtatttttgtgagatcctcttcggtgttctttttcttttcattctctgttgttctttctgttctttttgttttctttgtgttaatatttgtggttataatatattatatttatatttaatataaatttaattctgcttccaagctactttaaacctaagtatatgattaactgattctaataatttatcaagtaaatgtaccataaattatttaactcttgaagcatatttaacatttaatggtctcccatgttttgctattataaacaataccaagctgaacaacttgcacataaagtcttttaaacactgtactttagatagatttttcagaagttaaatcactaaatatatttagagcttttgataaatttagtcaaattcctttttaaaaagttaagccaatttatgcaaaagagataaacattcaaatgtttacattacgttagcctgggagcagctccttggctgcagcacctgatgaaagccttcttctttggcaatactcatcgtatcagtactcatcgtatcagtactcatcacatcagtactcatcgcatcaatactcatcacatcagtactcatcgtatcagtactcatcgtatcagtactcatcatatcagtactcatcgcatcagtactcatcatatcagtactcatcgtatcagtactcatcgtatcagtactcatcacatcagtactcatcgcatcaatactcatcgcatcagtactcatcgtatcagtactcatcgtatcagtactcatcacatcagtactcatcgcatcagtactcatcgcatcaatactcatcacatcagtactcatcacatcagtactcatcacatcagtgatgagctttctgtgcagtgagcagcaggacctagatggaacccctggtgtttcagtaacaccaatattccatctctgtcagcaggaagaatttagagaaatgcagaagaattatgcttttgtacttgttcaaacttacccatgaaaacaaaaatagccagggttggttatcttataattaatcttttcttttttctaagtctgaacttcagccaactgcagacagggaaaatgagtctgtgattgctgtatcatccctgaagcaaggcacctaaggatccttactccaacagacaagctttagagcgggcatccatcagcacagatgcaaataaagatcagtgatcaacagagactattaggatgatggaggaaaatgagatctggacaaatatatattgtaaacagcttatttttgctaaggatcagatgacagttaacaccagaacagaacaatgcttaacataattctcaactagcatatatttttgagaaaaaaaaacacattcagcatattcatgtaaggttgcagaaagattcctgaatagggcagacactaatgacatttgctgttaaaactgttccccacaatatgcacacgagaatcccagaatggtacatgaatgaagcccattctttctttttttcttctcctttaaaaaattatgatgaagtatacataacataaaatttactgctttaaccatttatagatgtactatttactggcatgacccattgtttcttgagtatgctaggatgacaccatgtttttaaaaggcacacataagttcctataagaaaagagatgaaagccattatttctgctcagggagatcaaggaaagctcctgagatgctatgacatccaaattgggtcttacagaagaagtaggcgtttctagacaggtaagagaaaatgacacttcacatagaagcccctgagcagtgccagaatcattaaagtgtaggacctgcattttgaggggcagtgagtaattggtctgagtagagcttagactgatattgcattattaataatagggaaatgaatttcacttaaaatttttattttttgaggctctcgcctgtgagacaagagatgcagaatctatttcttacttcatcctgttgccctctcctgaacccatagccacatgtaccttatgagaggaggtggccttaatcagtggcaagcattttctgtaaagagacaggtagtacctgtcttcccgcttcgcacaccatacggtcttggtctttgttgcagctgctcaactctgctgctgtagtgtgaaagctgtcacagacaacctgtagaaaaatgggcaaggggagatgtcacctgcagagtgcactttaccagccctaggactagatcatctctaagataatctcctgcattcatattttagaactctagcattcgtttttttttttttttttttgagacggagtctcgctctgtcgcccaggctggagtgcagtggcgccatctcggctcactgcaagctccgcctcctgggttcacacaattctcctgcctcagcctcctgagtagctgggactacaggctcctgccaccacgcctgtctaattttttgtagttttagtagggacggggtttcaccgtgttagccagatggtctcgatctcctgacctcatgacccacctgcctcagcctcccaaagtgtggggattacaggcgtgagccaccacgcccaccctagatctctgattctatttctattttccaaattgtgttgtttcacatcagcttgattacaaagaagaatatttttggatgaggggatttaaaaaatttacattctattgctcttttccttgcaaagcagtaactgagtgtcttcccttagtctctgcaaacaatcgacgtggacactcagtttctaagttgaaggatatgaattctagattattctctaagaagtcagaacaggaatcacaaagcagctaaagctaatgctctgtagaggaatatggctaaccttactctgggctaatctaggtaatgtgaaatataaattaataataatttacccttgactgtaactacagggattgttttaatggtagatgtgttctcaattattttggttttgtgtggctcaatagcaagggaatgtaactctctggtgtgcgattccatttagtgtccatattaagtcaaacttaagcatgtgtttgaataatgcataacaaatgagaattatcaagaaaaataagattattaatatttctagtccagtaggaactaaagccagcctggaagtggaatgaagacaatgagcccagctcttatcctgcagaatcctgtggaggcataaactaattaaacagttttgctttaataatctttgtatctttctacagggtgaactctcagattgaatagttgcatagaagcagttgggaaatggaagaagcttctcagttgatgaaaaactgtgagatatcagttagcattgtcaatcaaggaaaatttctaaggaaagtctcaattattttaggagatttacctgccaaagttaaggacatgtacctgggagacaggtctatgccgttcttcaaagaggattttgagggcttcaatatttaaagggggaaggatgggatattgagaaatacacaattctcatgtgagggggcagcaggggaaaatagccattcgtgcctttgcctggttcagtgaatctgcttttttttttttttttttttctaattgagatggagtcttcctctgtctctgtcgccaggctggagtgcagtggtgcgatcttggctcactgcaaactccatctcctgggttcaagcgattctcctgcctcagtctcctgagtagctggaatcacaggcatacaccaccacacccggctaatttttgtgtttttagtagagatggggtttcaccatgttggccaggatgatctccatctcttggccttgtgatcctccctcctcggcctcccaaagtgctgggattacaggcacaccgtgctcagccgaatctgtatttttccataagataaggtagacaatagggcagaggaaacaaacagatatgcatttgtctctgctgggcagagggacaactgagttacgtaatgtgtccccacatctgtgaaaacgagctgtcgatttacattgccctggtgaattttaacagaaatgtttagatctcgggaccacaaggaatttccttaagggcaaaatgtgagggaagtatgtagcttttgatctttgtagccatcttttaggaactaaaatgggaggcaggtttgcaggacccagttttcaccttgacttttccctttggcttagtgagtttggggtgctgagtattgacaaagagtcaaactctgtaaaatatttgaagagatttattctgagccaaattcaagtgcccatggcccatgacacagccctcaggaggttctgagaacatgtgcccaaggtggtcggggccagcttggctttctacacttcagggaggcacgaggcttccatcagatacatttaggaaatgcattggtttggtccagaaaggtgcgacaacttgaagcagggacttccagcttataggtagagtaaaacattttctggttgactgtcgagtttatctaaagacctgggatcaatagaaaggaatgtctgggttaagataaaggcttgtggagaccaaagttcttatttgcgggggaagccttcaggcagcaggcttcagagagaataggttgcaaaatgtttcttatcagacatcagacttgaagtctgtgttgctgttagtgctggagaggtagaatgaggcatgtgtgaccagactccccaccatggcctgaaccagtctcaggttaaatttcaagagtgccctggctgacaaggaagtccattcagatggttgggacgaccttagattttatttttggtttactcgagattaatttttctttcacaattataaaacaaagaacactttttaaaaaaatgtaatttttagagctagtttcttaagtctgtgaaggtgtattaaaagatacattaatctcagtttacctagtaagagtgttttcaggaaaaatgcagtttttttgttagtttgttttttgttttttattttttggggggacagagttttgctctgtcgcccaggctggagtgcaatggtgcaatctcagctcactgcaacctccgcctcccaggttcaagtgattctcctgcctcagcttcccgagtagctggaattacaggtgcccgccactaccccctggctaatttttttatttttagtagagatggggtttcaccatgttggccaggctggtctcaaactcctgacctcaagtgatctgcccgtctcagcttcccaaagtcctgggattacaggtgtgagctgccacacctggcaagtaatgtttgtaaatcaacaataaaacacatttttcgattttagtttatgtctctcttcattccgtcctttgtgaggaaaaacgttggtgtatggagacaagttcagggtcggaaccgagagtcagggtgccctgagagccagcccagagagtggcagcacagcttctccttctgtcagaaatggagctggccctgggtacttgacctccgcactagagaccgcattcgcctctgtccctcacaatgagatgacaccatgcaataaggttctctgctgtgaacttcacctcacagtctcaccttactaagtaatgcacgccaggcccacacttctgatacttagaaacactgacggctgagcaaccttagaatcctgggtttaagttgaggaagcgttggtgagcagctagggcctctggctgacttcctggggcagagctgccccatcggcctgagctggttacaacaaaagtcagcaaacttttcttattaagggtcagagggtacatatcagcctttgtgggccattcagtgttgctcacaactcctcttatctgcccttgtgaggcaaaagcaaccatagacaatgtgtaaatgcatgagtgtggttgtgttccaataaaactttattggtgaacacagaaatttgaatttcatatcatttccatgtgttacaaagcagccttgtttttttttcccccaaatttaaaaaatagaaaagtctttttttgtttgtttgtttgagacggagtctctcactcttgtagcccaggctggagcgcagtggcgcgatcttggctcactgcaacctctgtctcccaggttcaagcaattctcctgcctcagcctcccaagtagctgggattacaggcgtgcgccaccgcacccagccacaaaagtcattttcagctcacaggttatgcaggtcatacttggcttatggtctgtagttcaccaaatttcaggttacacaattttgtgggagagaaataaacttctgttttttaaaaataattctgaagtgtcttggtaattagatgaacttagccttaactctaaattttagacgatctctgccatttgtgttagaatccattcattcagatacttctcctttattgccgccagggcatggagggaggatgagctgcacacgtttttctcctttgcttccctcttgcactcctttccttaactactttgattccttgcatggaggtggacctgccaagacatttttaagagcatgctagggacacctcaaggtgtttttataaccatttcaatgagttagaactttttctttttagaagaaatatataaggattatttcttcctcataagttaccaatgaataatttacttactacacatcattatggatggaattgttcccctaaaatttgtattattgaagtcttaacctccaatgagacatatttggagataaagcatttaaagaggtaatttagattaaatgagctcatagtgtggggacctaatttgatagaactgatatcctcataggaagagaaagagaagctgggcatggtggttcaagcctgtaatcccaacactttgggaggccaaggcagaaggattgcttgagcccaggaatttgagaccaaccttggcagcaaggcaaaacttggtctctacaaaaaatgcaaaaaattagccaggcgtggtggcacacgcctgtagtccaaactactaaggaagctgaggtggtaggctcgcttgagcccaggaggtcaaggctgcagtgagccaagatggcaccactgcactgcagcctgggggatagaatgagaccctgcctgaaaaaaaaaagaggaggcaccagagacctctctctctttgcactcacaggggaaaggtcatgtgggaacacagctaggagggagcaatctccaagtgagaaagagggccctcaccaagaaccaagtatgctggcaccggatggtgggtcttccccgccttcagaactgtgagaaatgagaaaatagctttctgttgtctaggtcacaagactgtgtcagactttgttttggcagcctgagcagactaatatattccatatatgggggtgataatagtttgctagtcagccttttttagtaccctttaccttatccttaagcccactagtcaaatagtgtcaacagttttctatatattctttctttggataaaaagaaaacttcatgagcatttttgacatatacctcattgatcagctttgactctcaaaataaactttgaaaaggaacaaaaaggaaacagcagttttgaaagttaggcttttaaaaaactgcaagagccaagcacttgagagaaaatagacttttctgaattccaggtttaaaatagcaagagccagaatttatgttttgaataccaagtctgggtgtatgtcagaaactatggaaggatagaggctacgaagtaaggagaggtttccatgacagagcaaagaaaataggaggatttcctggaacaggagaaggagcttggggattggacgtgggtctgggtagtggaggttttccataggccctcagagaatattttagacataagaggcaaagtgcatgacaggaagtgctgccttttggggaagatgtgactaagctctaagtagcaatggtgggacacagcacacgtggaaagatgctgacatcagcagcagattcactggtattaaaggaggagctcctggctgggcgcggtggctcacgcctgtaatcccagcactttgggaggccgaggcgggcggatcaccaggtcaggagatcgagaccatcctggctaacagggtgaaaccccatctctactaaaaatacaaaaaattagccaggcgtggtggggggcgcctgtagtcccagctactcgggaggctgaggcaggagaatggcaggaacccgggaggcggagcttgcagtgagccgagatcgcgcccctgcactccagcctgggcgacagagccagactccgtctcaaaaaaaaaaaaaaaaaaagaaaagaaagaaagcaaaggaggagctcgtaagcccagtaagactagacatctctgggaaagccaagactgaaggctaggggcctctttcccaatatgtgtgtgtgtttataatctttttgccctcagactaagggaggagaggtgtatctttaagagtgagaatcagttcagatataagtttaagtttttcattgagagaaaccaaaatattacatttaagtatctatgtaagcatctaaattttagagcagggtgactgcattaccttgaagtagtaaagcttcaggtcaatccacataagcagaagctaccctgtgtagaatcagaggaaactgagctcaattatggaaaaattaaaatgttatgtctgcataactaaattgtgactataacgttgactcagctgcagggattggctaatatctataataaaatgaaacaaaacgattgctgcaggtatttatctaaactacttcatgaaacagtcccaataaacttgtcaacagcatgtacccattatagtaactcagatgtgctacaagtttctgaaattctttctgaatcataaaaaagccatattatgttcttggtatgtatatgtattatgttcatggtatgtataccatatgctatggtaagtgaatatttctgtactataatcattgtaaattggtaatacacatatcctgttaggcaggacatttggctacatgtaacattctatttcccaagaactccactaacagaattattttgatagaacccccttaacatttgtaataatataatgtttctttttctcataggggtattcagtttaacaggctcattgatcaattttgatcattccacttttctgttctaacactttcaggggctatcactgcctatgaattttatgaattcctagcccatgcatattggactcactaagacatggctccaatgatcattcaaaattccagatgggctacttattgttccctgataaccctatacatcccgatttgttcttttcctcctactttctccttggaatgccttctccaacctttttagccttctcccaaccccccttgccattcatttcatccatctcaaatgtaccttttccctaaaggatgctcggatctagctttttgaatatgctcgtttcagtatcccataacccgcattttggacttctcttgagacttatcctgttctgtttatattatatttattatgacattttcttatctgtaccccatatggtattctctttgtagtaatgactatgtcttattttttaaaaatctctctcctcatattactgtattgagcatcatctattctgtctatattttttttaaaaaataacagaacaatatagtttaagctgctacaatgtcttcaatctggaaatctgtgtttgctccatgaaagagcactttaaagaaaagacgtgcatgaatttgcatgtgattaatcatatgtcactctgctttcaaatctccttctaggcaagaaaaaagaacagtgaagtgtggaagcttgagagctcagtagggctgcccaaggatatagaaaatgagggagagtgattacagagtaactttccagggatagaagggcccaggatgggggagctcctgctgatggctgagactatgaggacagcctggagagcaggagggagggcatgaacaggaacagagtttaagatatagaggacaactcaaagctacagccccagccctggtgaaaatagagggagaaaagaaaaatacacatatcttaaagatacagttgaaaatagtgtgtgaagtcagtaggagaaattgtatgacaagcaaggagtgtgtgattagtttacctgatagagttgcgattggacactgagctaggttggatgtatagtgggaatagttttgatttttaaacgtacactgcaagtcatctgggtgtaaagcaggttgctatgccgagttccatgcacatagccagttgtcaggcttcatatatgcctataatgggttcccacttcctcacctgtgagagagctgatcaatgggtaaattggtccaagaaactaacaccatttggatacagaaatcacacaaggcactgaaccagaaggagctgctccagatgtgaagcgggctgctaggaaatctgacgcctagcggtgccactgtcactggccgtttgttgttccagaaaaaggccaaaatcctgggagactcttttagatacagcaactgcctaggatagaattgaggctccacaaaggtgttcttcatgtgggaactacaagatcatcagcggagagagccttccaggaaacccgcgtacatcaggctcctcccgttggaggtgaatcctcactccccacaccccccaatgctcccctttatcctggacacagaggggtgctctcaggcttctccctagctctccctgctcaccccatgcttaagagtgaattaaatatgtatgcaaatgtattttgcagattgtacattaaattttaaaatgcaagattttttttttaatcaactttctggctactgggacccagcatattttcactaagagtatcaataatagcatcttcatcttttcttgacaaatagtttggacagttgtgataattttctgatcctccaagcttttattgggatcgacttccttgtctcacctccacgttttcttttttccactatggaccttgtttccattccacactttctctcttcttcttcttcttcttctttttttttttttttttttttttttgacacggagtctcactgtcgcccaggctggagtgcaggggcgcgatctcggctcactgcaagctccgccccccggggttcccgccattctcctgcctcaggggttcccgccattctcctgcctcagcctcccgagtagctggaactacaggcgcccgccaccacgcccggataattttttttgtacttttagtagagacggggtttcaccgtgttagccaggatggtctccatctcctgacctggtgatccgcctgcctcggccccccaaagtgctgggattccaggcgtgagcccccgcgcccggccccccaactccacactttccagtcgctaatgagacattttcctctgcgccccagtgttcagcccccacccccacctacttctactgtcctcgtacttcagcttcaccggagctttccttcgtttaacaggtattttaactcaagtcattccccttctcccttaaaaaaacagaacttggccaaacaaaattggatccaggaaaggcgtgaccgcggatggaggactgtgttacttacctcaactaaggcagaaggtgtttctcatttgcttttctaccattccttcaaactcattctattacgttcccttttcctgccatgacaggcgtcctagttgtccccttaggagttctccgatgtcctgtatgggacccccaacgaaggccatttctcttccatacgaacccttggccatcctcattcctgctctgaaggctgcctgtgctgagcgggtccctgcagggcgactggagcttagcggcgcagcacctgcttgaggcgtgggggccccgccccgcccgggagggcggtcctgctgcctcccccggctcttgccgcccacctttcccatctgctgtcaagactcagcactagcggccgcttcacgaggccccgcaactctggagaacgcagccgacgctctcgagtgtatggaggagccctcaagtttctgcagctcagcacccaagcctggagtgcgctttaaacctgctctgatggaaacaaccccagctccaacagaagcatatatgtgacttgaatttgtggggagcaggggcagtcattgaagctgccgcagaataattactcttgggaattccagtccaggaaagctctctttcaatggaccttctctcagaaatacttcctggtcctctctttcatggcctgaaggtagatgatttggattgatagagacttctgggcttcctctcgctgagtcttgctcagaggaaggggttatttatcttctacatagtcatcaactgagaggacctcagtcaaaacattgaagcaaaagaaaaaagtctcattggacattcttttacatgtgcttccatggcattgtgaacatatggacatagcaatgatcaaagcggtagttttgcatttattgtggccatcatttggctagtgtctgtcttctccactgtgctggaactccatgaaggtcggggccgtctttgttttgctcactacttaattcctaaggtcttacacaaggtctaataggaggcattttaaaattaatgatcagataggccgggtgcggtggctcacgcctgtcatcccagcactttgcaggccgaggcgggcggatcgcgagatcaggagatcgagaccatcctggctaacccattgaaaccccgtctctactaaaaatacaaaaaaaatagccgggtgcggtggcgggcgcctgtagtcccagctactcgggaggctgaggcaggagaacggcgggaacccgggaggcggagcttgcagggagccgagaacacgccaccgcactccagcctgggcgacagagcgagactccgcctcaaaaaaaaaaaaaaagaaaagaaaagaaattcttgtatattgcatgtaagtacggattctctttttatgaactaaaatgaaaacattggatagcctattaacttataattttaacctcttcttagtggtcatttttgttttgtttttaatttttttctttttgtcagaaactgatgaatgctaattagtggtcattattgaggaataagtaaaatatgcatttaattactcattcattcactcagcaaaatcaatgatcacttactactcaggtactgggattatggagataataaaacagctgattcctttcaagcatgtaccacggagtgaatgaaatggacacccaaatacaataaaatgtgaagatctattaggacaaagctatgtgtttgcgagaaacattttctggatgcttacgatattccagcccctttgtgcgcacataatttcttatttgatttttcacaactgtcctgtgagtcatgctttattctctttttcttttcccaatgaaaaaaaactgaggctcagtgaattttaacctcttgaaaaaattggtccattgttcaggcgtaactctgtctgctttcaaagcaaacagttttttgtttatggcacattactgagaactgcagttttaactctctgcgggtggacagcagcacaaaactaattaaggtgcataagtgagaacactaacaataatcataataactgcatctattatttatggagcaactgtgccgtgccaagcatcacgttagctcctttacaaaaataaaccaatctcaccctaaaacaactctaaaccattggtcttagcgttctccttttgtgtaatgggacatcgaggctcctcacattccagtaacttgctcaaagtcatccaggcagtaagagacagagctaggatttgaaatcagttgtgatgatggtaaatctatgctcttaacaattttttaaaaatggctcttctgggattatttggcattaacatgggccagatgaatacagtgtgtttgatggcaggtagaaaatagccttcaggaactttaaaccaggctgcatttcaatgctgaagtttaaaaacttgttttgtttctggctccctatgtactcctgagcttttggtgcccctgaagagatgttttctatcttatattttgtcaggataattcagacaatatttaccaccaatcaacaggtgcagaaaaatccaacagctccctatgggaaacaatggaacattggttagtataaatattaccagcaaggatctcaaaggcctctcatgttcttgttccttcaaccaaaattcattcatccatgggccaatctgatcctaaatttgtaaacaactgtccagtaattaactcactaaaatgaatactattctcaagcaattgcatgcagtttcacaaatgctcttatcatcagttgcccatctctgtgatatctatgagctgttaaggcagtgaaagtggagaagaacatttttcataaacgtgcacatggtgacttacaattcaaggttctaatcaccgcttgaactcttaaaacatcgatttgtctttctaatttagattgtgtgtctcctgagccctgagcacatattctttatgcctggtacagtgccagatccatcagtattacacaaataattaatcttcataatgatagcttgcagaggtagacccgcaattactgaagggcaccttgacatcccagggaaatctgctttgaaaatatatgtgtgtgtggcagataccactgtatatgaaggccaatcatttaattttttaggtcctcagttcctggttgagaaaggaaatagatgctcaactgttggactagaaattcagaaacgtaatcatccatggccctttatattttaaacattcttttaagtttagacaataactttatatttctaggtttcattcactttattctaaggtttgtaatacagaatctgactagattccaatgtataatatttggcgtatctttatgtttcatcccattttggtagactggatattgcacagcaaacattctttcttataaaatggtaccactggcgtagtgttcagggtagcaagagtccagcacagttctttgtccttgtctacttacatctacttacagcacacatggcactctttttttttttttttttgagatggtcttgcccagcccaggctggagtgcagtggtgcaatcttggctcactgcaacccccgcctcctgggttcaagcgattctcctgcctcagcctcctgactagctgggattacaggtgcgcacctccacgcctggctgatttttgtatttttagtagagacagggtttcagcatgttggccaggatggtctggaactcctgacctcctgatccaccagcctcagcctcccaaagtgctgggattaaaggcgtgagccaccatggccagcctcctggcactgtttatatatccagaagcctccagtgggaggacgagggacttgggattcaaatctgtccaccactgcacatgaagcacgtagagcgcccctgtttaatagcttgctcgagtgtacagtgatgtactgtgcagtgagcaggggagaagacacttaacatccccgagcccagttctgtcacctacatcataaaagtactattaacaacttccagcatttaatgagaattagtgcatataagttacttgacaatagagtaactgctcaatcaaggttaattttcttctcttccggttccctctgtctttgcactctctcattctagtagcctcttttcatcggtgcataattccatattatttaaaacaaacattcatcagcggctcatttgtcataaatctggaagaggtgaaattaaagtagttatgtgcatggaaagcccacctttgaagtatttctacctgacccgcatatcccacaactaacttaccactctgtctgaagccacctctgggtgaaggtattaaatgtgcctgttgaaatacaaataccaggagtgggggaaccactctaaagaagtagagatggtctttctccttacagttataatcagttggggaagaaatgttttcaagcttcatacttgattctgagttttctggcataatcacagtgagatatactctcagagtgagtcaccattactgaaaatgtgtcttatcaattagtcgtgccagagagtggagaaaaaagaaaagtaacgttatagaaagccaaaattaaaacagcttctctcgctatatttttcaaaatgttcttaaaggatttcagtatgtcccaagacaatgggttcatggaattccattcaatccatacctgcatgtgcctaccgtgagtgaggctctgaaactggtgttccatgcacaaggccaattcagtctgaataacactgaaggggacagaattaagaggagaatttctgggccacagggtagaaagcgtaagaatggccttgcaatgggcaacctattcagccagggccagcgtgaggacacatacgactctagagggcaggtaggagctgaaagtgaggagagccgaggtctcaccctgaagaggaaaggggaatggaaggtcaactccactaattgagaatattattcagtccaacctcaatacagatttatggtcagtgtcaccctttcctaggaacaggcagcacgctgtggtggaagggtcacagactcggaagaaagcatatctttgatccgtcctaactcagtttctcctaagagacgcagtcttgtgcaatacccttaatctgcctgagcgttagttttcttagctgcaaaatggagtttataattcttgatctgtttcacaaatatgtcataagaataaagaaatatgaactaaaatgttttgacaatgatggattatctaaataccaaccatgcttgtagatgttcttaaagttcatatcaaaggggttaggagaaatgataaaggattactctaggtttgctttttattcaggtatttattcatgtggttgaacatcttaaagccgaagaaagagtaaaatgctggtgaaaactcaggtattattttctgtatcactggatgctagaaatgattactggaaaaaactctttaatgaaacatgctacctgaacactccaggagggagatgagcagaggaaaatgtctttggccttttccccagtgaagcctgatcctttatgacttggctttcatcgatattttgcgcactcaacagagaccctcaaatatgtttattgagaattcactgtgaaaaccgcactcccttaggcactgtgtgaaagggaaagaaaagaaggatgtgagaaagagggatgtttatgcgctttctagagcttctactcagcctggtatgattccaagcagacatttactgtgttacacagatgctatatcaggttctggaagaagttttcctccataaagataacttgcatcctaattgtgttaccatgtcacttaaatagcttctatcagggtcatttctgccagtaaccctcataaggaatcaaggactctctgatgtcagtaaaggcaagatgtcaaggaagctgcaccaactttcttataaggacgggaagagaatatatatctctgcttacccaaagacaaatatttgaacttctttttctgttttctcatcagtggtagaatgctgtgatatttcccttctctttctcttttggccacaccagacaggagaagggaatttaaggaaatgtggagcatagtagttacagggaagatggaaaaagacatgtgttgtttgagtttgtttcaacattgatgaggtgtgttgggcagtatgaagagggagaagagagtgagagcaagaaggaactgtagggaacacaaataggacagaggacagggagaaaaagaagacatgcgtgagattaaaagaaactggccgggcaccgtggctcatgcctgtaaccccagcactttgggaggctgaggtgggcggatcatgaggtcaggagattgagaccatcctggctaacatggtgaaaccccgtctctactaaaaatagaaaaaattagcagagcatggtggcgggcgcctgtagtcccagctactcgggaggctgaggcaggagaatggcctgaacccaggaggcggagcttgcagtgagcggagattgtgccactgcactccagcctgggcaacagagcgagactccgtctcaaaaaaaaaaaaaaaaaaaaaaaaaaaatagaaaagtccctataggcaaggttagcataaggcaaaattgtgaagtacttagtgtgtatcgtccggaacaggtcttttttgctctgcaatccttcacatgctacagaaacattgcagtctcttttatcaggatctagtctatgatttgttatgatctgtcactttgagataaacatgattggtaagtgttaaagtgttactctcccctgtttttcatttcttttattttgttttgccatttttttagggggaggcagatgaatacattttgtgttaaaatttcatgcattgatactatcggggaagtatagacttctaagagaatatctgattgagacagaaaattatgtaatagttcagaacatgaattttgaatttgcctttgggtaagctgatttccctgaggctgtttttttaacgtggaaaatcagagtaataataattgctatctcgtaaatatattttttaaatttctttttaatttttgtccttttttaagtagagacgggttttcaccatgttggccaggctggtctcaaactcctgacctcaagtgatctgcccgcctcggcctcccaaagtgctgggattacaggcgtgagccaccatgcccagcctatttttaaaatttcataaaattttttacactagaaattgttcactatgttgtactattgtcgttattatttttcaactcattttggctatgagcactaaactctaacctgaatatcatagtttcctagtttctgaggcaatttggactaaggcagtttcagaactaacacaagagaatctggaattgtctttataagactgatgtccctgtgtctgaagggaggccacggaagcccagccattccctgacatgcgctccagtttcactcttagagagtaagtaggagtgggcgggctttgtccccagtcctgccacccagcctccttttccctggggtttcctatggaaggagctgcgtgtgtaaagagcaacactcagcgacacatcaaacccagtgtctctctggctggacccgtcctcagcagagcccctagagcgcttctggttccagctgcatttgaaaactggcttttggccgggcgcggtggctcacgcctgtcatcccagcactctgggaggccgaggcgggtggatcacgaggtttggagttcgagaccagcctggctaatatggtgaaaccccgtctctactaaagatacaaaaaattagccgggcgtggtgtccggtgcctgtagtcccagctactcgggaggctgaggcaggagaatcacttgaacctgggaggcggaggttgtagtgagccgagatcgagccactgcactccagcctggcaacagagcgagactctgtctcaaaaaaaaaaaataaataaaaataaataaataataaaactggctttttccaggaggcctgcgtgaggactcttgcttcctcttcactctcttacatctaagatgctggactgaggaggaggctgcggcctgatttgccctcccagccttagctgagaagctggaaagagtggagggagatgaggatttccagcacagcctccacttggcagtccacctttagaggccaggccaggctacagcagggagtctgaggaccaacgggactcagggcagggcctgggttccccggtaagaccaggttgggccatgtactggcaaatgtggtccaacgactgacctaatggaaaaataatttctgtaggcaaaaggtctggccagggtataaggagggacaaaaggaagcggtaggaacatggggaggaagttctctccttataaaaattgtataagatttgaactgttctatctcaacatgtttttgaatgtgtatcattgaaaaacaatggagtcgggtgtggatgctaaaattattttagatagttctttcactgtggcccccattgccccgagaaaatgttccctgagtcccatcaattctaaaaagcactaaacattttgtttaaaaaatagatctggccggtgtggtggctcaggcctgtaatcccagcactctgggaggccaagacgggtggatcacctgaggtcaggagtttgtgaccagcctggacaacatggtgaaaccccgtttctaccaaaaaatacaaaaacttagctgggtgtggtggcgggcaactgtaatcccagctactcaggaggctgaggcaggagggctgcttgaacccaggaggagggggatgcagtgagctgagatcgtgccactgcactccagtctgggtgacagagcaagactccatctcaaaaataaataaataaataaataaaaataaatcgatctgaaaaaaaaattaaggaaatgatgactagaaacttcacaagtgagaagttatttgtccaggagaatcggtgacttactgtatttcttttagttagattgtatcaaggtatgattacaaaaatcaataacaattttatagaaaataaacagagaagcaacaagctaaacctattgagagaacataacttgactgtcattttatgtatataatacagtattatttataaaactgtaatagataagagtcaggtatacagtatacatttcaaagtattaccacagtatttacagttatctataattgtagagttgttaacatgtacttttatctggatttcttaccttaacaaaatacggtcactctatcaatctcagagaaatgtctgtgcaattagtattttggtgttaactttgagtctttataaggtcatatactcatttttcaaaacgaaaagtatttccactgtagaaagatgtctgttgagaaaataaatctcccttcagcacaattttaatttcaaaatgctgcaatacccagaccacaatcctagctagcattaagaaaaatcacatcgtacaaggaattatcactaacaaaggaataaggattttgaaggccgttctcaaggaaagagccgcattgttgagtaggagtaatctcaggggatggctgatatcaaaggaacggtggagtctttctgcttccagtacaggatggagcacaaagcaagattgattgtcatgttttacctgcaatcagggtgagggaaaaaacgaaagggcttttcaagagttgaaggaaaaggctttaaggcagaacaagtggagattagagcttttgtttcacagtgatgtttgctttcatttatacacattcctgatttatacttaataacatgaaagtggctaattttcctattcgtaaaaaatattgctaagtgtgcaaatatgaattactcactgcttctctttaaatgtactcagttaacaggtcaggttttcttttttaattttttttttttgagaccagagtctcactctgtaccccaggctgaagtgcagtggcgcgatcttggctcactgcaaactccgcctcccaggttcaagtgattcttctgcctcagcctcctaagtagctgggattacaggcatgtgcccctacgcccagctaatttttgaatttttagtagagacggggtttcaccatgttggctaggctggtcttgatcccttgacctcgtgatccgcctgcctcggcctccaaaagtgctgggattacaggcgtgaaccactgtgcctggccttaattctttttttttttttaattagcaaacgaaacaatcaacaaggtgaagagacagcccacagaacgggagaaaatatttgcagtttatcgaactgacaagtgattagtaaccagaatatacaaggagtccaaacaactcaaaaacaaaaaaacaaataatctgattttaaaataggcaaaagatctgaacagacatttctcaaaagaagagatacaaatggccaacaggtattaaaaaaaagttcaacatcactaatcatcagagaaattcaaatcaaaataatcatgagctatcatctcatcgcacttaaaatggcttttatcaaaaagacaggcaataagggatgctggcaaggatgtggagaaaggggaaccattgtacactgttggtgggaattaaattagtacaaccactatggagaacggtttggaggttcctcaaaaaactaaaaatagacctaccatatgatccagcaatcccaccgggtatatacacaaaagaaaagcaatcagtctattgaagaggtgtctgcatttccatgtttattgcagcactgttcacaatagccaagatgtggaatcaatctaagtgtccatcagcagacgaatgggtaaatgaaatgtggtacatatatagagagaatggaatattcttcagccataaaaagaatgaaatcatgtcatttacaacaacgtgaatggaactggaggatattatgtgaagtgatgaaataagccaggcacagaaggacaaatattgcatgttcccactcacgtttgggaagtaaaacaatgatcttacggaaatagagagtagaattgtggttatcagagtctggaagggtagtggtgggggagatgaagaaagaattgttaacaggtacaaaaatacatttagatagaaggaataagatgtaatgttcagtagctcaatagggtaaacatagttaacagtaatttattgtgtatttcaaaataactagaagatgggaattggaatgtttctgacacaaagaaatgataaatgcttgaggtgatgggcatcccattaccctgatttgatcattacgtgttgtatgtgttgtatgcttatatcaaaatttcacatgtaccccaaaatatggacgactatgatgtattcaaaaactaaaaataaaaaaattatgaatacgagcaactagcatctaggcaactgggtctgctctgtttaatgatttcaataattcaacaaatatttattgactaccactcatgtattagacactaagatatttgataatgatacaatggtgaatcaacagataaatgatttatcctgatgcttatacattagtaaggaagattaaaaaaactcgtaatcaagttaagtgtgacaggcatcatgtgcttattggaacatgtagaaggggtttctgtgtccctgcaatcaggacaggtctttctgagtctgaagtatgaatcagagttaggtaaagcagagagggaaggcagtttagtttccttggtacaagacagtgtattaaacactgcagtagagagaattgtaaatgataattctgcacttacagaatttgcaattgagtaaatatgagaatattatctaaatgtactgaatgctcattgtgtgctaggtgttattaaatactttacttgtattgattcctttaatcctcacaacaactctatgaaggagttactgttattgaccatctaaaggtgaggaaacagaggaacagaaataggaagtagcttgcacagatcttcctgatctccctcatagccaatgacaggcctaacataacaaatacaatgacaggcctaacatacaaatacttggcgtctgggtccgaagcatgaacttttttttttttttttttttttttttttttttgagacgaagtcttgctctctcacccaggatggagtgcagtggcacgatctcagcttactgcaacctccacctcccaggttcaagcaattccctgccgcagcctcccaagtagctgggattacaggtgcccgccaccacacccggctaatttttggatttttagtagagacggggtttcaccacgttggccaggctggtcacgaactcctgacctaatgatccacctgcctcggcctcctaaagtgctgggattacaggcgtgagccaccgcacccggcctcaaaaacctgcactcttaagaagcattttagtctaagaaaagattgacatatataattgcagatttacaaataactgcaatgcagtaaattacagttactataagagcatccttatgtcggagctcagtggaatgcctagggcttggtgtgccttagctttttaaggaaaatttgtattattttaattatttttatgtacagaaaactcaacagtgtacatttaaccaagtttagtgggaatttctttagcctttgcctttttgagctttggtgcaggtcttcctgtagactagacatcccagtcttgccttccccttgataatgcagtaagggacccccattttacgacacagggcaggcagaaaggtaaccagctcgatgggatccacgtcgtgtgcaatcaccaccagctgagctttcatgttctccaccaaggtggtgacggtgttaactccggctggaaggacaggtggtctcttagtggggacgtcccctttgccggcagctttcttctcagctggggccaacagcctctgccccttctcttgctttgtctttagtctgtacttgtgggccagcttaagcagctgagtagctgtttggcagtccagggcctgggcgaactggtcaatcgcaggaggcactttcagccgcttacagaggatggctctctgccgctgcaacctgatatagcagggccgtttcacaaggtgggcgaggtctcttttgggttggatgtcctgtccaatgccaaaattcttaggccttttctcaaacaggggattcaccactttcttggcctcctgcttcttcatgaccgcaggggccggagccaccttcttccccttggccttctttcctttcggcatcttgagcggcggaaagagagagacgccctttttctttctttctagactctcgctcccatggacttttggtaggtgcactagatagcacacacggttttcccttgaagcaaggcatttctgtctggttgaaagcacactcacggcctctaaatgcttgtcatgcagtctgcaaacaagatgtttaaaggaagttgaaaactcatgtttctccttgtggaagttcatccctctttctgcacaaggtggactacaagaggtccttctggctggaccaaacttattttcaggaagcagctctgaatctgtagaaaagcttgaacattactagttctcagagtgatgctgcataatacaagaagaggctaccttcatttgatgttcctatgattactgtatgtccgcctctaccgtgataccgacttgctaaggattgctaacatttaggcatacttgcatcgtaacaacttaacagtttaactttgactacaaaggccagtgaagggatcgtctactataattttcaattacgttgaaatgtttccacaataactatctttaaacactttatgtgtctagaaatgcaggttacttggtgaaatctaatctcgatggaaagctttgatgctctgtatcaaatgaaaaccaatttaagccatctatgctgcacattaatattaagcaattatattaactgaaagcactgtgaatacatgaattgctttcattaaaaaaagatttccttaattaccttctaagcaaatattctccactaaactttttaagtatttgcaatactcaaataaaataggtaatggagatgtcaatttacatgaaatacatatttctaaaaatctaacttgcattgcaagtttaaaatatgtttacaaaatccagaattaaatataattttataaggctatttttatttggatactgttatgttattcggagaaaacagtatttcttgtttttcatcctttactagctcaaggcttgtcaggatgccactcatatcatattgtgatgttatgatgtatgcccataccactttctgtctcaaggaaaaggtctgtctcctcttatccacattggccgctgtgcccatctctctggtttccatcttgctggcactaaggtagcccctcatgttcacagagaagaaaggctgaggaggtacatgggttttttgtgaccgcaagcttttcagtgcttgtgtgactctaacttctgtgaaatttcttgattttcctcaagtaggacttcagggattcatggaatataaaagatggagctaaaacagactatttcccacatgttcttaggcttaaatgttgaagtgtaaatgtttaagttgtatttatttatttaggacaaattataattgcatgtaattgtggggtgcacaatgatgttgtgatatatgcccacagtttagaatgattgaatcaagccaatgacatatccatctttttttttttttgacagagtcttgctctgttgcccaggctggggtgcagtggcaggatctcagctcactgcaacctccacttcctgggttcaagtgattctcctgcctcagcctcccaagtagctgggactacaggtgcacaccaccatgcccagataatttttttttttgtattttttaatagagatggggtttcaccatgtttgccaggatggtcttgatctcttgaccttgtgagctggctgcctcagcctcccaaagtgctgggattacaggcgtgagccactgtgcccggctccccattttaaatatatatcatttattcctcctgtttaaagcttaataccctttgaccgacacctctcattttccctaccctccagcctctggtaaccaccgttctaccctctgcttctgtgcatttgactttttaaaattccacatgagtgagatcacagggtatttgtctctgtgcctcacttatttcacttaacatagtgtcctccaggttcatccatgttgtaaatgaaataatttctttctttttctttttttctttcttttttttttaaggctgaagaacattccattgtgtgtatatatctcattttctttttccatttatccattgattgacacttagattgattccatgacttggctattgtaaacaatgctgcaacaaacatggaagtgctgatatctcttagacatattaatttcaagtcctaagggtatatagttagaatagggttgctggaacatatggtaatcctatttttagttttctaagggaactccacactgttttctgtaatggctgtgctaatttatattcccaccagtgtacagtgttcccttttcttcacatcctcaccatcacggttgttatctttcctctttttgttgctagctcttctgatagatgatatatcatagttttaatttctatttccctaatgattagtgatattgagcattatatatatatatatatatatatatatatatatatatgtatatatgttggccatttgcatgtcttattttgaaaaatatttattcagtttctttgcccatttttaaattggattttttttttttgctattaacttttttgagctccttatacatttggggtattagttccttatataatgtattgcttgtaaatttttttctgatctgcagattgtctcttcacttgtagttgttttctttgttgtgcaaatattttttagttaactgtaatcttacttgtctatttttgtttttgttatttgatcttttggaggtcaaataaaaaaaaaaaaaaaaaaacattgcccagaccagtgttgtgtagttttctcctctgtgttttcctagtactttttataatttcaggttttacatttaaatctttaattcattttgggtttatttttgtatactctgtgagatagggtgggactaatattattcgtctgcatgtgaatatctcattttctcattgtcctttatgggagagattgttctttacgcattgtgtgtgttcttggcatttttatcaaagtcaattgacgaagggcatcggttcatttttgtgctctctattctgttccattggtcagtgtttctgtttatactagtgtcatgctgttttaattactatggctttgtaatatagtttgaagtcaggtagtgtaagacctctagctttgttcattttgttcaagactgccttggctagtcaggcttttttgtgtgtgtttctgtatgaattttacgatttttttttctatttccatttgcatgaaatatctttttctgttacttcacttttagtctatttgaatctttaatagtgaggtaagtctcttgtaggtagcatatagttgggttttgtttttatacatcctatttctttgtcaagcttctcattttgtattatttttcatattttatttaatcttctatccttatattcttatagctgactgaacttctttaagagaactatattaattttttgttagttatttcatagctctccatttctttagggcctattgttgaagctttatttgtttcttctggagatgtcattattctgattcttcataatctttgtgtccttacattggtgcttgtgcatttgaagaaatggtcacctcttccgtcctttacaggtattctttggcaaagttatactctcactgaagtctagcctgtgattctaggtcggctacctggtaatggcgctaagcaggtagagcttggcgttagactctctagcttgctgagcctctgcctttgctttgagatcagatggatctgagctcttctatttggtgagaccactggctgggttctgcaatcaggcagagatggtagctgggtcctctgattggatgaagacacaatgtgtattccctagttaaatggtactgctgtttgacttttggaatttgggtagggctgcagattgggtcctaagcttaggctgagtcactgattgggagagtcaggatcagctgctaagtttggcagaaatgcacaatattgaggtttacttccctgcctggatgtagctttggtgtgggatttgaggttgaggtgagctgctatttgaactcccagactggggtggtctagcccctgtatgtagccaagatatgccatggtgggtgtctcactccatgagcagggtcttcttgggtctggttcttgggatggacttttaggttgagccaaactcctcttaaatgcccaggtggtgcaagtatagtccctgtgctttgccaaaatactctgtggtaggtatctctcttctcagcaggaggaagttgggggaagcctgaagctgagcatggaggctgagcatctagggatttaagctagattgatctttccactgtgcttctggggtaaccagcttagctttgcaggtgggctatggtactcccacctatgtggtgctgtttaagaggctactactggtacctctcatcaggtgcctctgctgacagtaatgcagagctaccaccaagatacaagccctgtctactgtgagtaacatctcctttctttgcttgtatttgaccccaggtgacctagtcatgccatgatcccatgtttcccatgaggtgagaacagattgggcttcctgagaggcatcttggagtgctagttaagctggatggccaccttatgttttatttttccactttagaaactgtggaccaggggaatcctctctatgtggcactgtgcccattggggagggggaaggggtagcacagtcagagtgacactgttgttacctgtctgatgtagtttttatgtggttctgtctcaggtttatttacaattttggaatttttgccaagatggtcttgtatagaaatagttgctagttgaccttttttttggaagggaagagctgagatgtcctattctgccatcttgctgatatcattccctttgtttcaaaatttttaatataaagctattccctaggttaattgcttctaaatgtgaaggttgtattatatcaaaagatataaatttggagtcacatcaaaagaaagaagaagagtgagaaaaactactttaaatcaattatgaggtcaaatatgtgctccaaaatattttttttcttttgcaatgtaaggatcaattcagaaaaaagaaaatgtttgcagaggcctttcttaaatgatattttttcttaatttttatcaacgattgctgcttgtgtttagttttattttaaacagctttattgaactatgatcgacatacactaaacttaaacatttgacaaattttgacatatatatatatatatacatatatataaaacatcactatagtaaaaaaatgagaatatccatttcccaaaagttttctcttgcccctggtagtctcttgcacctgacctttcctgccacctctcccttccaaaaacagtatatactccatttttttctggcttcttttatttatgtcattcagaatgaatattttgagatttatccaagttgtagcatgttattaatagtttattgtttttggtgttgtgtggtatttcattgaatggttagaccattgatggatatttgggttgttttcagtttttggctattacacataaggctgctatgaatgtttatatacaagcttttatgtggacagggattttaatatttattgggtaatacttagaaatggaacagctggtaggtatatggtaggtttacatcgaacttaaaaagctgtcaaaatgttttccaaagtggcagtgccacctcacattcccatcagcagtatatgagaatgtatattacaccacatcctctccagcacttgtatggtcagtttaaaaaacacttgtatagtctaataggtgcatggtggtagttcattgtggttttaatttgcacttcttttgtgaccaaagatgtatagcattgtttgtcattgatagatcttctgtggtaaagtccctattcacagctttggaccatgatttcaattgggttttttgttttttttcatattattgaaatttaggagccattcatatattttgggtccatctcctatatcagatatataattttcaaatttttttcagtctgtggtttatattttaattttatttatttaattaatttttggtggggggagacagggtcttgctttgtcacccaggcaggagtgcagtggtgtgatcacaactcaccgaagcctcaacctcccaggctcaggtgatcctcccacctcagcctcccgagtaactgggacctatgcctgcatggctaatgttattattttttgtagagacagggtctcactatgttgctcaggttggtcttcaacacttgggctcaaatgagtctcctaccacggcctcccaaagtgctgggattacaaatttgagccactgtgcctggccttaattttcttaataatttttatttttatgtttttgtttgagatggggtctcactctgtcgcccaggctggagtgcagtggtgtgatctcagctcactgcaagctccgcctcccgggttcaggccattctcctgcctcagcctagctgggactcaggtgcccgccactatgcttggctaattttgtttttgtatttttagtagagacggggtttcactgtgttagccaggatggtctcgatctcctgacctcgtgatccgcccgtcttggcctcccaaagtgctgagattacaggtgtgaaccaccgtgcccggctgaagagcaggagttttatgttttgttaaagtacaatttattactactttcttttatggctcatcattttgtcatctgtaagatattgttaccttatctaagatcaccgaggttttttttttcttttgtttttctggaatttttaagggatttggcttagtctcctggagatggagtgagaacaaagatcctagagaaatagtgatggagttatatttgggtgaggctgcaaagaagattggtgtggggttctggaaagagcaggggtctttttcaaaatgatcataagcagtactctggggatgtgtgaaaaactcagaaagaattcctttgactacttggtgctgtttaagaggctactactggccgggcccagtggctcatgcctgtaatcctagcactttgcggggctgaggcgtgcagatcacctgaggtcaggagtacaagatcatcctggccaacatggtgaaaccctgtctctactaaaaatacaaaaaaattacctgggcatggtggcgcacacctgtaatttcagctactcggaggctgagacaagataaattacttgaacccgggaggcagaggttgcagtgagctgagatcgtgacactgccctccatcctggagatcgagactctgcctttaaaaaaaaaaaaaaaaaaaaaagtggctactcccaaggcctagccattttcggttcccaaagatctatggaaatggcagaactggcaacctttaaggaatcacaaaggctaagaaaacaaacatctcagtcttagttacttaactagcacgaactcagatctgaggatgaggggcctccctgatgggcaggaacttggtttgatcatagagtgccaagaatgagctagaatatcctgctagctttgcaatacgcaaacttggtgccaggttaatgcagaattaatttaaagaaaataacaaaatgcaatatctttcatacctcgtagttacaatattaaaactaatacaccacatactatatagattaattccaagttgcataatttctttatactgttcttctcagaatggtagtctaatctaggtctataattcgtgctgacccacggcagtgacctgaaagagttggcactttcagattttgaatatgttgtctcagagcattttctctccacctttgctaaggacacgtctcccctcagctttccgtgtccgtccctgtttcaggcaaggtgagttaggctcacagtgagctccgccagctgtggctgtgtgtatttgtgtgtctgtgtgttgtagtggtaacagcatcagcagtgtttgttgcagatcagctaactctggtaagaagtttcaaagctggttgttatttactttttcgcttttttttttgttccacctgataattttccaagttaattatttatgctgcagaaaaattataatgcgttatgaaagcaattctgtgctgtatcagctttccattttctcttttgatcaaatatcactatatttcatacatattttttcacaattcgcagtttaggattgcagccacttctcggtttcatgatggatggaagtttagtttctagtttttgtatgtttaaataggtctccataggttttaagaatatgtctgatactattttaacaaatctttagcctctggagtatgtattctgtgtgtgtgccaatactactaagaactcagtttctctttaaaacatatttttatgccctccatccctgctccaccccatcatttttcctgggagcagccaaagccatagacagagtaggaatttaaatgtaatttacaaatgctgtccttctcattcctcctcctgtggtgatttgtcccaggcctcctctcttcctcttctaagtctgaatcaatatcagttaacactgtctcgccaacactcctatgagctccacctcacagattagcagagccttttctcatttcagaggtaacagttgaatgtgaatgagttgaatcaggctgatataggtttctactggattttcacttttccacctataaaaatgagaaaaatgagagacagctgaaaaaggaccaaagactgcctctgaggctgtatgagcaagctgcttatccctgaggctgacactgtttcactgacttcaataagatcaaagatggagttggatttgaaccttggtctctcttatttcgagtacattacattagattttgtatttactgtttccttctgttactctaatggaatatgatacggtcatagactatattaattaagacatacttctcaggtataagtgggtatagtataataatgctactgcttttcagtaagtggatcaatttgacacgggaattcacaatttggccattttataaacagaaattataagggactatcttgcagaaaattttgtccaaaattttgattaaaacaggataacaaaataaatttatacaaataaaacttaggaataaagaaggtgacacgtgaccaaacactgcatcaaatttctgttagcacctttaacacatatatcccgacttctaattttttccaaaaacccacatatttttatttatttatatattttttgagatggagtctcgctctatcacccaggctggagtgcagtggcatgatctcagctcactgcaagctctgcctcccaggttcacgccattctcctgcctcagtctcccgtgtagctgggactacaggtgcccgccaccacgcccggctgattttttgtattttcagtagagacggggtttcaccatgttagccaggatggtctcgatctcctgacctcgtgatcagcctgcctaggcctcccaaagtgctgggattacaggcatgagccaccgcacctggcgtccaatttttttatgaaaggtgattttcatatacagtcacaatacttgggcatttgtatgattattcaacaacttgcaaatgatgctgtcaataattttcaagaagaaacaatgctcttccctaatggaagagttgatctggtatattctaatgatctcactcggaacagtgaaatacttaggagagatcttcttcttggactaaatgtaaagacttttaaaaactccagattatactggttatgactttttaataaatatgactttattagatacattttgaagggacttgtgtcttatagaagtataataaaagagcagtctatcatgcgttttaaaccagttactttgaatatcagcctatggcctttaaagctctgaacagttagaactgagctgtatttctgtaattgaaggactgtccacatggcctagagcacattcaaatgatgctcctaaataagcttccagttatcaccgaggcacatgcaaatgggcagaaatttcacatccaatcattgtacaacaggagaaaattctgcttgtataatagaaatgataaccttgaaatacttgagcactcatctttgaggaaagcagaaagacccgaaacctatcatgtgacgagcccgtgaagcctagaatcacagggcagcattaatttcatgggatctagcgaaagaggatctagatggtcattccaagtcctatgtagcctgtttatcatccccattttacatttaaatgtatgcaataggtgtctttacatgagtagactttaaatataggtaatttataggcacaattctttacaaatatttaaacacaatttctaaaattattcaaggttttatcccattgcacagttagactctatttcagttgaaaaatacacgtcaaattgaaaggtgtgaaattatttttttaagccggtactataaattatatgccagaaatatatggtcactttctctagtcatagcaaatgttcaggtaccaagttaactttttaaaaacttttctagaagatccatggaaatcagctgtcacactgcaacaggactcaggaggcctaatatgtgcattcctgatatattcagctgttttaatataaggtagagtaatacagtagaaaacagactacatatggagtcagaaccatatgcagctttcttcactcagtgtttttaaaatgtttaaaaatgcttaacttttttttttttttttttttttttgagacggagactcgctgtgttgcccagcctggagtgcagtggcgcaatctgggctcactgcaagctccgcctcccgggttcccgccattctcctgcctcagcctcccgagcagctgggactacaggtgcccgccaccacacccggctaataaaaatgtttttaaaaacaaaagtgaaccacctttgttcactcattgtttttaaaactttaggtactatttagtgttttggaactttacctgcttattatctgcaacatgaatttaataatatcataaaaactgcatttaaaaagaagatgcactgaggtgatgagtcatatacaactgtgggcaggcaagattttcttgttccctgtacctcgttaactcattagtgcaggatacagattggataacgtctgctagtgaggaactctgtgttaaaatgcctttccataggtgtcactttctcctgtccctgcagtgccaccacaaaagcccagccagctgatggctttagccaatgtggcagcagggagtgtgaggcttctggctttgctaggactcaggccagctgtctccgtcactgggctcagggtgctccctttagttacaaaatcagaccccgtgttgtggagcctgtgcatgtttgcattgctcttttgagttaaaaatcatttagacctaatgagtttaggataaaggactataaacagcctgtcttatccaagttttctgcaatggagtctgccagctcatgcccagctaacgatgtgtctttgaagccattaggtattttctattatttttttgcacataaatatgctttgtggaccttgtagaaagaggtgactagagactggagcaagattcaggtcttcctggatgccctgctaaatgtcatatgattacattggttaaagtcctaattcttcattaataccaacatatgtgatggtgggttgctttcatgtatttctgatagtaatcattagtgctgtttattattaatatgatcattttatccttgatttcctagtatgctgaagaaaagtatgttattcaatcagctttgtgctaaactatagtatatttggcccttaaaagtcctttgcttgctccccgaatgttgaagtttcttactgttccttccaggtcttctcttttcactttccagcataatctcatctgcttttatggcattaattatctctgcattgattacttctaaattcatatctccatgcttaatattttatttgagattcagttccatattaatgtgtctactggattccccagaggcatcttaatatggataaaaaattcatttttatggccaggcacagtggctcacgcctgtaattccagaactttaggaggccgaggtgggcggatcatgaggtcaggagttcgagaccagcctggccaacatggcaaaaccccgtctgtactaaaaatacgaaaattagcctggtgtggtggcaggctcctgtagtcccagctacttgggaggctgaggcaggagaatcacttgaacccgggaggcggaggttgcagtgagccaaaacggtgccattgcactccagcctgggcaacagagtgagaatctgtcccccgccccaaaaaaatcatttttataaccacctacatttattttacttcccgttttaatgaacgaagtcaatagcattatcgcttgcattttcattcggatccactctgctccattctgtcccgtgtcctcttgttcacctgcaaatccacgtagttgctgagtttcagcctattccatctcagggcagagccactgcttggacttccacggcttcacctcagaccctcatccgatgctgccttggctattccaggaaactgctctctgcttctagtcttatcacagctgggaggcaggttctcagccatgctcgccccctacctggaaacagactcggggctgttgtggggggcacggtgagagtgagaccggccctctgggttgtgtgggatccgcccgatactgccacagctgatgctgtcttgaaagcaccacctcccagcaggagcccaaccagcacacaaatagtgcactaaacaaccaaagctaaggaccctcacagagtccacttcaccctcctgccgcctccaccagagcaggtgctggtatccatggctgggagacccacagatgtttcacatcacaggactctgcagacaaccctctttaccagcccatagcctggcagacttgctgggtggctagacccagaagagaaaaaacaatcactgcagttcggctctcaagaagccacatccctaggaaaagggggagagtactacatcaagggaacacccatgggacaaaagactctgaacaacagccttcagccccagaccttccctctgacacagcctacacaaatgagaaggaaccagaaaaccaactctggtaatatgacaaaacaagtttctttaacaccccccaaaatcacactagctcaccagcaatggatccaaaccaagaagaaatccctgattaacctgaaaagaattcagaaggttagttattaagctaaccagggagggctccagagaaaggcaaagcccaatttaaggaagtaaaaaaaaatgacacaagaaatgagggcagaaactttcaatgaaatagatagcataaataaaaaagaatcaaaacttcaggaaacaatggacacacagaaatgcaaaatgctctggaaagtctcagcagtagactcgaacaagcagaagaaagaacttcagagctcaaagacaaggttttcgaattaacccaatgcaacaaagacaaagaaaaaagaataagaatatatgaacaaagcctccaagaagtctgggattgtgttaaatgaccaaacctaagaaaaatcggtattccagaggaagaagagaaaaataaaagtttggaaaacatatttgggggaataatcgaggaatacttccctgactttgctagagacctggacatccaaatacaagaagcacaaagaacacctgggaaattcaccacaaaaagatgattgcctaggcacatggtcatcaggttatctaacgttaagacaaaggaaagcatcctaagagctgtgaggcaaaacaaacaaacaaacaaaacaaaacaaaacaaaaaaccggaacctataaaggaaaacttaccagattaacagcagatttctcagcagaaaccctacaggcgagaaaagatttgtggccctatcttcagcctccttaaacaaaacaattattagccaagaattttgtatccagcaaatctaagcttcataaatgaaggaaagatacagtccttttcagacaaacaaatgctgagagaatttgccactaccaagccagcactacaagaactgctaaaaggagctctaaatcttgaaacaaatcctggaaacatatcaaaacagaacctgtttaaagcataaatctcacaggacctataaaacaaaaatacaattaacaaaacaaaacgaaaaaccgaggtatacaggcgacaataacacaacgaatggaatgatacctcaagtctcaatactagcattgaatgtaaatggcctaaatgctccacttcaaagatacagaattgcagaacggataagccttcaccaaccatctgctgccttcaagagactcacctaacacataaggactcataaaatctcttgctaatttctcctctcctttgctccccaatcctataccagaaggcaagaatgttaatctcttccttaaaattgccgcttgcttcccatctattcaataaagtccaaattacctatcttacgcgtggtttttagttgtctgttgcctacctaatcctctgacctcatattcccaatgtttatatcattcaccatgacttggaacatttcattccttatattatcccttccctagaccttccctctgattatctcttccatctggacctttcccttcctcaatgggcaatttccattcattatttaaggctcagcttaatttactccgttgtggagctcttccttatcactccctagtcagtcgctccctccccagcactgtctctaggcttgtatcacagcaccacaccacctgctgacttgtcagcctggctcatgataccttgctgcctttaatcaagtctggttcttcaattatgatcacagtgtttgctacatagtagaagataaagaaatacttgtctgttggatgaatggtcaagtagcaatgaactttgcctattctttttcaacataagtaacttacaatacttcttttactctcattgaaggtatttaaaataccttcaccacaattttactctcattgaatgtattttaaaatactttcagttcctcacccttcaacatccatctcagccctcagttctactgcagatgcaactatttttaaggcaactttttagatatattgtaaatactgaaaataaaaaataataactatttaaaatgaagatcattcaggaaaacttactatttcatctgcgtttagttcaatatgccaatttcatgtgctgtatttataaaattattctttaataagcatcactaatatatctatgagaagccattaattactgcctctacaaaaggctagtgtcaaaggtaatgttatctcaaaatctgagatgtttaagttccaaactttgtcaattttttttctgtaatcaagaatccacatgttggatgttttactataaaatattactgagtaacatttaacatggatttaaagctggagccaataaatttattatggtgtaaattagcttctttatagaattttctccaaagttgttcgataacatgagagttggaatgaatggaatgtactcaataactatttttaatctatttagttatgaaggaccaaataaatgggtggatggatttctaggcactgtcttgggagacaaaagataaagagtaactaagctgaatttccttcctttggcaaaggctgtcccttaaacaactggtgtattgtcagaaagtgatttaaactatgttcatgcagcaacaagcatctgttttgtaaataaccaaaacattttgttcaggtggcaaagtggtatcttcaatttagaactgaccagcctttggtgaaatgcttctaattaatctaattgcttaattaaatccatgctcaagggatattttttcaaccaaagcctcctaattgtttatcaatgagtgtgattcacattctgctttatctgtgagctccttcttgagctccttaaagatagccaaagacaggggaaaagaggttttagaagcactgcctcacattgaatggaccttagtcggtgcgtagaatagaagctggcaggtcacagtgtttctaagtagagcacagccaaccttaggcttcatcttaccatgaaacatagagcctccttcctttgtgattcacaaagccctttccatcactctggccatccctccagctcttttgcccgtatttccccgtttctgctcttgtttccacacattctctctgaaactctcaaaaataccttctcctccctttccatattttcttcatgtatttttcttttttctttctttttactttttttttttgagacagagtcttgctgtgtcacccaggctggagtgtagtggcgtaatcttggcttactgcaacctctgcctccccagttcaagcaattctcctgactcagcctcctgagtagctgggactacaggcgcccaccaccatgcctggctaattgatatatatatatatatatatatatatatatatatatatatatatatatacacacacacacacacacacacattatatatatatatatatacacacatatataatgtgtgtgtgtatatatatatatatttttttatttttagtagaggtggagtttcaacatgctggccaggctggtcttgagctcctgaccttgtgatccacccgccctggcctcccaaagcgcagggattacagacatgagccaccatgcccggccttcttcatgtatttttcaaattagcaatttatattttttgaaattgaaaataacatccaatagatgaacagcatatcatgccagaagccttgctttcaatgcatttgcatttgctttatcatcgtctcttctgatatcaagcctgagatttctcactctgaaaataattttatctctcgtcaatcttgttatctcagctacatctcttaatgttgattacacccaaatccatgcttactgaacacagtcagatgttctaagtgagctaacatgtgtaaggcatttaatagttgccctggtacttactaagtgacatgaaatttttggctattactattacatcatcatcatcattatcattactattattatcattattcttatgtttctattaggttgcctcagagcaaatcaaatgcatataaccaaatgttttaatccttatgtgtatgttttttaatgtaaattcatagtttccactctcaaacttgtccttcttccttttatgctctgcattgaaccactgttaatttcttaccaacctctgttacatctcttgtattcattttctcttctccacgtagatcctgttgactttggcttacactcatttcatttcactgggattcttctctagatgctcaactttttcttcaaactataattcatcttatctgtggtaatcagtttattttttaaagcatagttctgtttacaagacttctcacaagcttccaagtctctattgcctgttgaataaagttcaccgtccttcatgtgacactgaaggtgttcagtcttccgctttcagataatgtttctggtgcagtcacctgccattttctttcacacctcctagagtgcaacggatctgcatagtatttaatgctcctcattcaatgactatgtagtgaagtgttcctggaagcctggttctagtttaagtgtcttcacccagtgataagactgacacgatcaccgctctgtgattaacattactttgctcacgctcccaactctgctcccttctccaagatacttttgtgctcattcatccacatctgatttatctggtgtgaaactgatcataggtctccttatttatgaagtattctggtaattccgactgaaagtcctctttttcttcttcattctcgtgttatttatttatatctttttcatcgcacttagccttttcactcttggtcagctttctgttcagtgttcagggaatacatgaagattctctgaacccgcgacaaggaatgctgtagcttggaatagtctttctaagtccagaggctgctttcttcaactgtgtgtgcctttcacaagtttccaacttctattcggagccagccagtgctgtgtctactggtacaaaacatagtgttgtaaggctacacgtggaaatgcgcttaaactagaagcaataacagacataggttagtgtaagttatattttttctgtgagttttgaattttgttttcacttttatatttctgcaaatggaagatggcaaaagggctgtaaagaagtgaagatcagtaactgcctcaaatttcaaggcaagaaaaggcagattgttagaaatatccatctgattgaggaaaagtgacatgtttgcttgaggtatgtgtgtaatagattccactgaccactgcacggaatatgtgcagacacagctgatgctgcaaccttatcttaaaaactcatcctttaaaaaataatttccgcatcacaaatatgctttttctttatttcttctcataccattttaccgcctagttaccaatttgctgaaaacgtagtttcacaagaatcctgatttgcagagcacaggtttccttagctcgaggctgtatatatgttctgaaatggaaataaagtctctttcaatgattggattcagtggagctgggtttactgtaaagggaactttaatagctatttttcaatgaacacagaccatctccttttgattaagtttaactattaatgtaatttgacaaggaggtgagaagctcatgcctcatcttcatctgctgtctaaagtaacttaagcaaaagcaaagaaaagaagcagtaaggtgttgctgctggaaaattctgtctgaaaatgctgttatttgaaattatttatagagaattcactgaagtgaactatttcaataatatttttatgttaacgaaggttatcaatgataagatgagccaattataatagtctattataatttaaaatgaatcactggttatcttttcaacacattttatgtccaggagagcagcatatctgcagtgcttaagtgtgcagtctctgaaggcaggtgggaggtttgaattcagtctctagggtccgtacttctgtgaccttgggtggcacagaaggcttatcctttgtctaagccctgacttcctcaatagtaaaacagggataataattctacttacctcaaagttaatactctataggctggacacggtggctcacgcctgtaatcacagcactttgggaggccgaggtgagcagataacctgaggtcagaagttcaagcccagcctggctgacatggtgaaaccccatctctactaaaaatacaaaaattatccaggcatggtggcacgtgcttgtaatcccagctactcgggaggctgaggcagtagaattgcttgaacccgggaggcggagcttgaagtgagccgagatggcgccactgcactccagcctgggtgacagagcgatatttagtctcaaaaaacatttttttaaaaagttaatactctataaattttagctcttattatttatttattgttaagaaaatactcaacattttgaaggaaatgattatatctttcaacattcttgtgacttttctggatatctgctgatttgatgcatttttaaaaatcaaaatatgtaacatgtttttaccttattaatctagcataccatttaaatatacaacagtgtttcttctcttgactaataagtgaacgataatgataattcaacaactacatgatttattatctgatctgaggtttaactttaaatgccaacatcatttttaaggtattttaaaatagactttatttttaaagcagttttgtgttcatagcaaaattgagcagaaaatagagttccaatatatccccacctccaaacattcatagcctcccaactgatagcattttccttgaaagtttaatgattgagggttgcctgcttttacataatttactacgtattttttaaaaattataggccaggcgtggtggctcacgcctgcaatcccagcactttgggaggctgaggcgggtggatcacctaaggtcaggagttcaagaccagcctgggcaacacagtgaaaccccgtctctactaaaaacacaaaaattagccaggcatggtggcgctgcctgtaatcccagctactcgggggactgaggcaggggaatcgcttgaaccttggaggcggaggttgcagtgagccgagaatgcgccagcctgggtgacagagcaagactccatctcaaaagtaaataaataaataaataaataaataaataataaaataaataaaattatgttaatagatgttactatacatgttctggttaaaaacctgagaaagtattttattacatttgaggaatggatttgagagtatttgtacttcaggcaataagaaatattgatcaaatctaaaaaaaaggatcataaaaaagcatttgatactttgtttatccatatatttgcgaacataaatggagttttttggatcagatgacatagtatctatttccttaatctatgggttagaatataaaatgtgattgattacaaaataacttgtttttcatgaaaaaaattagcagctcttgtaaaatgcatctgaataaggagaaagtgtgctacaaatgagtaaagaaaaacgctgactggctatacaaatacactactcattagcacacaaaaactgtctcacttaaccagggaactccttccattccatcaggcatgccttccagagcacgttcttgccttttaaatcatcaatcattgctgccactttagtgagaccaaaagggttaaaactgaaacccagccattccctttcacttctgcaaatgcagctcagctttcccttctctggtctataacaaatgccacccactctttcctctggggtcttctctgatttgtatggccagtccccaacccgcctcctgaacttccatgcaacaatttcagaccctcagcagtggaaagtcttagcatagatgttctgtgagcttcagggcttaacccctcatgaaacttgacctgaatccgtcagtggatagaaaacggatttcatatttagaatcagcataactatttgttacaattttccagagtgtttttttttttctttggagactgagcctcgctctgtccagcccaggctggaatgcagtggtgtgatctccgctcactgcaacctctgcctccaggattcaagcaattctctgcctgagcctcctgagtatctgggattacaggtgtccgccaccatgcccggctaatttttttgtatttttagtagagatggagtttcaccatgttggccaggctggtctcgaactcctgacctcaggtgatccacccactttggcctcccaaagtgctggaattacaggcatgagccactgtgcccagcctctcaatattcttgatattatatgtacttgtattttctttgtatttgaaattatcattaggatggtaatcagacaacttagatgttacaatatctatactaatcacatcacattactttattgttactagtttctgtgaatgtgtcttatcttttaaattaaatccaaagctctttgagccagaaactttgtcttgtatgaggtttgctatataagtatttggagggaaaattgagtgactcgttctttcgtaaaactgttatatcggaacaccacagcttcatgaaaacacattaactagaagttattacactggagttcgatctccaaataatgcgggttgattaagttccattagctctgtggctttaagcaagttccctacttctcaagaccttattgaattcactttacaatagggtgactgggtcaggtgatgtctccagtattctcccttttaaagttatatcacttttcaaaaagaaagtctattctaagaaagaaaatatgactcgaagtctgaatttgcccaagtaccaaagaaaggctaaagttaaagcaaatcttattcatagagagcactagtaaatctatttctttttgatgcttgaatgttttctatgctggaatgttcttggtacatattaggttataaaatgactcatctttaggacatttcagtgcctgagggtattttctttgtaatccatgtattgaaatttgactcttgatagcacatgccaagcacatagttccataatatgattttttaaaattacagataatgaatatcagatgaacacaacagaagacacttagaaataaatcacattttgaccacttttaacaaatactcttagatcagtgtcagatatgagtccttaaagtttggccacaaagataataaacactttatcaaatctctatcttcataatgtgtgctcttctgaagaattattgtctctaacaatgctctcaaagagctaccagaaaggttattaaaatgaaacctatggtcactgtagtcagaatacaaaacaaacacgcatagtcacagttcatttgcatccatttgcacagtgcatttgtttgattttacaaataactgatagatgagtggaaataatattcaatgtcttgcaatttgcagaaaagagaagtgcgactttaatctcagaagaaaatatttcccagagaatgtgaatatctagtatattgtgctatcaaaactctatccctttattttatgtccttgcttgacatttagttggggtttattcaaggattacttgattggaaaagtgcctgcatatttggatgtttaaatacatttgatttatgtctcaagtgacatttgtggaaaacattttctgttttagaaacagtcagggtcagggaggtctcgccgaggggaggcagggactcaaatgaaggactggccacatggagtatgtgtatctcggagaagaacattgctgacctctgtaggaagaaagactggccacatggagcatgtgtatcttggagaagaacattgctgacctctgtaggaagaaagatgtgcacaggtgggtctggtctatgccacatggatcccagtaacagcaaggaggccaatgtaacaggggtagagaagcaaaggagacatttggagaggctgccatattttaaaggttttgtggccatgtttagatttggttataagagtcataggacaccattggtcttctgttttaaagacacctctcgctgctatagtgggaggaaggagaaatattagcatcaggtacaggtgaaccatgtttgtgtctgaggtagatgcccagcaagatgagatgtgcaaggtccatctacataactgtgaaggacaaagggaacgggggcagaggcagggaggggaagccttcagacagttgtgccagtgggagaccttgaaaggagaggtgagctcggacagcctgagacccagcatagtgctgaggaggtgctggcaaggccaatgggggccgcctgggaaaagctgctctctagaagaatcctgttccaggcatgaatagccttgacctagtcctctctcctaggactgggaagagcctgggagagggtggcctggtagtcaggaaagagtggcagctggggactgtcacctgcctgctccttgcagcaggttcttgtgaagggagagccaatcaggcacctccatgggcaccagaacgtgagcgctttggactagggtggaggtagtggaggtggtgaggttttgccggggttctaatatatttaaaggggagaaccaatgatatttactaaaaaataaaatgtgaaatgtcagaattctttgagttgagattttgggtgaatggttatgacaattcctaatggaaattggaaaatatttggaaggaatgggtgtcaaggtcagataaaggcagataagaaactgtttcaggcatgttaagtctgatttaactattcaccatccacttcgatatgtgacaatggcagctggatatattttactgggcggatggtggcctgtggtattccttcagctgccattgatggatagatggcttgtagagcgtgaagaccatcgaggagcggagtacagctgaggaagagaacggggtacattcacgacaccccagtgctccgcagcatctagaaattgggataagaaaatggatctagcgagagagtagaagtagccaggtagaagaataagtagtttatataaaaagagagtgtctgactcagaaaataagtaatgcagatgaaaaggaggggatcgatttgagaaacatctacttaggattggattatgaagtaaagaaaggactttaagaaggaggcagttgtcacttgcttcaaatcctgacaagaggtggaaaggatgatacctcaaatggatcactggatttagcagtgtggaggtcggtggtaatgctgacaaaagtggtttcagtggaacactgatgaaagcattattggagggaatgtaagacagaataagagagcaagtaaaggcagtgagcatagaaactactcagaggaaatcggctgtaacaagaaacaagatggagaattgctgtcctctcaagagagaggcttatgttttaagagagtgacaacacagcaagcttaaatgtttgtgggaaggctctcttagagaaggcaaaaacgtatgatccaggaggaaaaggggagaagcacatgggaaaattcttagaggaatcaataagaggggatgggatctactccatgtgaaatcagttttgctttagagacagcataagtaggtcacctgttttaccaggaggagaggcaaagcgcacaggtccagtgcagctgaagtggtttcctcgctagtggaaatttgtagacattctcttctgattgctttcaaacttctcagtgaaataaggatcaagtcacagttaggcaaagaggtgcggggcgggcatggtggagagttgagaaggggtggtgtgaaagtcactttggtggagggagagtaaatgaacttaatgactcttgtgacactgttgggcagtcctgagtgcctgcttgagttcattcctgtatatttaacgtgaggccaaccagcaggtttaatgtttttctgtattcatttccaagtccttgggtgtgagcacaaacaggcacaggccatatgtaatcattgtggtggttttactaggcagatgtggcacaggaaaaagggcaaggtaatcgagagtaaatagaagggggtggtgacaatgactgatgtaagattgacgctgggaaatgaaggaactgagagctggaggggtgcaattaatagagtgcgggctttgtgggttcaaaatatttagaatgggggccaaaacgctgaaggagacagcaagaaaagattatggaggagacagagtgagtctggatatgaaaaaaagtccagcgtgttatcacaagagacaaactggaagaggctagatgagcagaatagaggacaaagaaccaagagtcctgggtattggtaaaacctgctgtggtctggatgcttgtgtccctctagattcctatgttgaaaccctcatctccaaggtgatggcattaggaggcggggccttttgggatgcgacgggatcatgagggcagaacccttgtgagtgaagttcatgccttatacaagaaagcctagggccttctttcctctccaccgtgaggatgcagtgtgcagtgaactaggtagcgggctgtcaccagacaccacacctgccggcacctggatctcaaactctccagcctccagaactgtgaggaagacattactgttgttcataaaccacccaatctacagtattttgctacagcagccaaaatggacgaagacagatcatttacacgggtagaaaaatcaccaggaatagcgatggtgagaaaaacagcaagccagacacaagaatcacccgtgatgaaggggatggtaaatgactagggagagtgacagaaggcccagtcccctgacatgagccttgatggaactggagcttttagcaggaaccagggcaaatgggcttgaggcagcccagtagtgtgcagggtgtgaaagggaaaaacagccctcagttgacagtgtagtactttcctaggacttctgtagcaaaacaccatgcacttaatgccttcaatcaacaaacatttattctctcacaattatggaagccagaagtctgcagtcagtatcaatgggccaaaatcagggtgtcagcactgtcaccctcccttggtggctccataaggaaaccggttccttgtctctcagcttctggtgactgccagcattcattggcttgtggccacatcactccaatatttagggtcaacattttttgatctccctctgctctgtcttcatatctctttctcctctgtgtgccctaaaatctccctcctcatctcgtaacagaatatgtgtgatgtgtgattgcattcagggtccatctgaacaatccaggacgatctccccatcttgagaacataatcatatctgcaaaggctttcttttcttgccatatgttatggtcacctgcaaagacatatgggcccctgaggtttgatttgaatgttgaggctgatgatgccacacacaagctaagggggtatgaaaggttcattactcacatacttcaggcttctggggagagcaggtgggcctcacaagcagatccaatgtgacctaagaaagcaagggaagaagactggcccaagatgttatagtggttaggggtggggctggggtggggtcaaagttcccatgtgtgggaagggctcgtatggtttgactcccccaccagtgccaagggagggggctccccatctttcctgttggcttatccagatgcgggcataaaggaataccaaggggtgaggcctagaagctgtcaggagtcaaacatcaagaaatggggccagtctgggcctggtggctcatgcctataatcctagctgggaagctgaggcccagaactttgggaggcccagcacttgaggccaggagtctgagaccagcctggccaacatggtgaaaccctgtctctaccaaaatataaaagttagccaggggtggcggcacatgcctgtagtctgtaatcccagttacttgggaggctgaggcagaagaatcacttgagctcaggaggcagaggttgcagtgagccgagctcacaccactgcactccagcctgggtgacagagtgagacccttcctcaaaaaaaaaaaaaaaaaaaaaaaaaaaaaaaaaaaaaagggagggaggccagactactcattacatcatataaggcaattttcccaggttctaaggttctagagattaggaactggctatcctggggtgggtggtagagtccagcctaccacagggagttatgaaacataagcatggtcctcaagggggaactgagattagggttcgatcagaaataggaggggcgtatgaaagaagtcagtgctatagatttttatgtagttaccaatgagctgaaacccatttccccattttatctgttttgttcattgctgtgttctcagcttctacaacagtacttggaacatagttggcatttgataaatattttctaaataaataaatgaataaaaatggacgacatttctaatgtaaagaagttattggaaaatcacaatggaaagttggatttgaaatttaggcatcttcacaaagttcatatgcattattactttaaaattctgtagcgtggaagggagatggcaggggagtatgtcactttgtgacacaaatgaatgaaccatgctaatttcatggaaaaccctatctaaaattctgaaacagaacaccctgcctcccacctgacatagctgcttctgttagcgttttccagccctgtgtctccatgcagaacaaccccaaccgcctgctctgttgtgggtcaacacgctgcctttccaagcactctgaatacaccacagacgtgtcctacccacaaacgtcttcctggtggcgccccttcaaatctaggatctacaatatggaaagaaaattttatttaagtagctgttcataagacactaactgaaagatgtgcgcgcgtgcacacacacacacacacacacgatgtacagtgtcacagaggctctagctatggttattggacttccgaaggatgcagaaggagaaagagagtgataattaaccattacgttagagcaaaacccaagatggttcctgcacgttgattttctacagtgattaactttttttttcttttgtttttgagacggagtctcgctttgtgtcccaggctggagtgcagtggtgcgatcttggctcactgcaacctctgcctcccaggttcaagcaattctactgcctcagcctccctagaagctgggatcccaggtgcctgccaccacacctggctaagttttgtatttctagtagagaaggggtttcaccatgttggccaggctggtcttgaactcctgacctcaggtgatcctttggcctcccaaagtgctgggattacaggcgtgagccactatgcccagcccctctactgcataacttaattaccacaaaataatgcactagatcttcatatttcctcccacggggcactcattcaccaagggactcatttccaaggtctttcaccctatttcttttcttttgaaaaatattcagggaatgagagtttaatataaattgtcattagccaatattcttagccagtcccacacctttaagatggcccgtcttgacgtcttgttcaatggttgccaagccggcaagtgagcatgcacatcctcttggatttcgtccccaaatacaagaggaaagaaacaacgtctcccactgtgaaggatggtggcatcgttagtgggagggtgtccactatatctgtcttcttctactgccctgtattttctcatatcacagcttgacctctctaaatctgatggaaggagaaagactgaagtcagagaggcttgtatctgatggaaggagaaagactgaagtcagagaggcatgtacggagctttgagttttattgtttgacacgcaagggtctgatacttttgtttctggtctcctgtcagggtgccactgacagggccttacactctgctgaatgtagcccgtagccctttggtgagcaccttggcctgcacagaaggcccctgtgctcagcagagtcttcagggagaaattcacttctgggttttctcggcgcctgagaatcctcttcaaggtctcagtcttccatctctagtcctgctctgccctctctctgagttcactaagattgtggatcttctaggttttcacaatggacttttccttctcattttgccctgctctgtgctttgtacttgtgcagcatgcagttgtctgagccctgtgcagagtctcaactcccagccctcttgtttacctagcattgtgaatgcacactgtgattctgggtggcatttctctggagctgtgcattccaggattccggtcaagagagaaataatgctcacatgcttcctcggaggactaggactgaccccgctgcatgcatctgaagaggtaatggtccctacagtgtggtcctttttgggcaaggcttgttaatatctgctctttcattactgtgtagtagggcaaagtcactgcaaatggccgtttcccggtttctaatgtcctgcttttcctagccccctaaggtactttgaccactggttatgaacaaggctgttggctattctattttcaaacagcagtcgtctgttaggaataactatcaatttaatggcgccaatggccatcaaaacaaagaaaattacacagtaagtctgtctttctttctcgaagggaatcatttgcatctcactgtggtaccaagtgtcgccgtttccctcaacatgctggtaaccatcagtcccacaacagagtgaaccaagaatgcagagggctttttgtgctcaatatctttgctttggccaaggaaacactttccataatatcacgtttacttttttaacttttatagtacagagtgaaacatgtagaaaatagtagctgtctcgaaagagatgggaagactaagcctagtgatgaatgaggcacacatagaaagggacaggtgcaccaggacatgggtggggatggtccctgctccatagaaagggacaggtgcaccaggacacgggtggggatggtccctgctcctcatgtctgtgcgaggctttcatttgcaggcttcacagtgctttagaataatgtgttcatggaataaagagaaaggtagcatgggaggaaaatgttttcatacaaagcgaggaaattaaatatcacttgattcaactgggtattttaaggggaaaattacatgattaaatcacacccatggaagtttggtttagaattccattatctaagatggatgaacatttccaaggccctaaactgtgtattagaaagaaatcctaattgcatcaaaataaatgaaatgttatatttttgttattagtttttgagtgcctttcaacccagaagaaaactaaacttgatttaaaaaaaaaaaagctttataacaagatgttagaggtgataaatttaaagtttgaataggaagagcatggtctgggactagaaacactgtaggacagagatgttcctttccacctatttagttattcatttaataacaggctacaggtatcacctatttttttttttttttttgaaactgagtctcagtctctcgcccaggctggagttcagtggtgcaatctaggctcactgcaacctccacctcctgggttcaagcaattctctgcctcagctgggattacaggcgcccgtcaccacacccagctaatttttttgtatttttagtggagacgggttttcaccatcttggccaagctggtcctgaactcctgacctcgtgatccacccgccgcgtcttcccaaagtgctgggattacaggcatgagccaccgctcacggccctatcatccattcttgattgcacatcctcttttggcttccgtgaaagcatactgctatgttttatttctgcctctcttgttacccgccgttatcaatcctaggctcctttctcccatgctcctgcctctatatggtgttgctgaggtccacctttcctctctcatccatcactaaggttgctagaagatccttgttctcagggtgtcactcacacacatgactctcaaatcaaagtagccagcagaacctccacgctgtgatccaatctagaatttccaagctgtcttctggatatttctttttgaatatttgaaccaacagtactgtactttaactcttcctctgctttcttcccaaggctcctagcttctgtgttatcatttgtgacttttccattaagaaaaaatctgttacgagttatttcacctaaaacacggcacattattattttttaatttgtaataattgtgtctgtagtcttaaaagtacaatgctatctcagaatcatataggtatcttttttttttctttttttttgagatggagtcatgctctgttgcccaggctggagtgcagtggcacaatctcggctcactgcaaccttctactctctggttcaagcgattctcctgcctcagcctgccaagtagctgggattacaggcacacatgccaccacgcccagctaatttctgtatttttaatagagacggggtttcaccatgttggccaggatggtgtcaatctcctgacctagtgattcacctgctgggcctccccaaagtgctgggattacaggcatgagccactgtgcccagctgggatctcgttaaagacacagaccccaattaagattggggaatcagagcctttggagacttgggaactcgtgctgtactcatgacttcacgtggttctcatacacactaaggtgagagaaccataaccctggacagcagagaggatactttttgttaattaaatgccacactttatttcaagatattagattaggtattattgacagctgtttgcaaaacccaggaaggcattttatcaatagctactattcattttcagtttgcttcattccaacttgctgtgtattttagttgctctttcggtttaaagcaaatgaaccaactctgactagatttaaacaaaaagcgaatctaagcgaacctattgggagaacactaggttatctcatggagatgtggtaaagtagagaatagggagggactagatcaactccaggtaccttggcagtgaaacctcgtggatcttctcgccactgaatttccttcagttggactttggctcctgtcacttgcaacctgtacttccacccctgctcccaaatttaattttattttttaaaattgcttttaaatgacatgtaataattgtacatatttcggaatacaaagagatatttccatacatggatgtaatgtataattaccatattgtggtaattagcatatctatcatgtataacacaaagaatttatcatttctttgtgttgggaatattcaaaatcctcttttctagctatttgaaaatacacaataaattattgttaactatcatcacccttacagggctatagaaactagagctgactcctatccagttgtaattttgtatctctccttatccttctctcctcctatagtctccaactgacagtaaccataactctactctctgcttctagagctcaatgttttagctcccatacatgggtgagaacatgcggtatttatctttttgtgtctgacttatttcatttaacataatgtcctccaggctcatccttgttgctgtgagtgacaagacttcattcttttttatgacagaatagtatatcattgtgtgtagttaccacactttatccactcatctgatgatagactcttaggctgactccatatcttggctattgtggatagtgcttcagtagacatgggagtgcagatatctctttgagatactgattttctttcttttggatgaatagcgagtagagggattgctagatcatatggtagttctattcttagtttttcgaggaaactccatacggtttttcataatggccatactaatttacaatcccaccaacagtatgtaggagctcccttttctctgcatcctcaccagcatctgttatttttgtcttgttgatagtagccattttaactgggacaagagaatatctcattgtggttttgatttgcatttccataatgattagtgacgtcattttttaaaatgttctttttgcccatttgtatgtccttttttgagaaatgtctttcagattctttggccactgtaaaatcagatttttttttgcttttttatttttttgctgttgtttgaattccttgtatattctgagcattaatctcttgttggatgaatagttcgcaaatattttctcccatcctaaagtggtctttctattctgttgattacttcctttgctgtgcataaggtttttagtttgatatagtctcatttgtctatttttacgtttgttgcttgtacttgtaaagtcttacctataaaagcttcacccagtctcaagtcctaaagtgtttcccccatgttgtcttctaggaattgtatagttttgggtcttaaacttaagtctttaatccattttgaatttattttcatgtatggtgtgagagagagagagagaggtctagatttattcttctgcatatgcatatccacttttcaacgtttttggtgactttgtcaaaaagtcaggtgactgtaaataagagaatttatttatgggttttctagtctgttccattggtttatgtgtctgcttttataccagtgtcatgctgttttgattactagagctttgtagtatattttgaggacaggtagtataatacttccagctttgttctttgtgcttagaattgcattagctattcagggtattttgtggttccatacaagatttggaatattttttctatttctgtgaggaatatcattggtattttgatagtgaaaccagtccagtagtcccatagatagcttttttttggataaacatagaatttgatccttctgttcttaaagcttgaagcttgcatttgttttatctgtgttccttcctcaggatgacattcagggctctcaaaaaaagtatcaaagaggccgggcgcagtggctcacgcctgtaatcccagcactttgggaggccgaggcgggcggatcacgaggtcaggagatcgagaccatcctggctaacatggtgaaaccccgtctctactaaaaatacaaaaaattagctgggcgaggtggcgggtgcccatagtcccagctactcaggaggctgaggcaggagaatggcgaaaacccggggggggggagcctgcagtgagcagagatcgcaccactgcactccagcctgggtgacagagtgagactccgtctcaaaaaaagtatcaaagaactgaaactcacctgatcaccacatccagacaatgagatgccaaacccctcattcatcatgattactttcttgctcctccctagttcctcccttttcttagacattgtcacatttcttccctgctatataaaccactagttatagccagtcagggaaatggatttgatactaatctcccatctcctttgctgcagcactccgttaaatccttcttccttggcaatactcattgtttcagtgactggctttctgtgtggcaagcagcaggacctagactgaacccctgtgctttggtagcaacaggaattgcactaaatctgtagcttgctttgattaagatggtcattttaacaatattgactgttccaatctgaacatggaatttttcttttttggtgggtgtgtccttttcaatttttctcatcggtgttttgtagttttcattgtagaggtcttttatctccttggttaaatttatttctaggtactttatttttttgtagctattaaaaatgggattgcttttttgatttcttcagctagtttgttattggtatatagacttgctattaattcttatatgttgattttatattctgcaactttaccaaattcactgatcagttccaagaattctgtggtgaagtctttaggtttttctctatataagattatgtcatctgcaaagagggacaatttgattttctcttttccaattttgctgtattgtattgctttctcttgcttaactgccctggctaggaattccagtacagtgttgaataagagtagtgaaaatgggcgttcttgtctggttccagctcctagaggaaaagtttttccccattcagtatgctgtcagctgtgggtttgttacatacggcctttattattttgaggtacactccttccatgcctaatttattgagaattttttgtcatgaagggatgttgagttttatcaggtgctttttctgtatctattgagatgatcctatggcttttgcccttaattccgttgatgtgatgtatcacatttattgatttgggtataccaaaacatccttgcgtttttaggactaatcccatttgaacatgggtgtataatttttttgatgtgctgttagattcagtttgctggtattttgttcaggatttttgcatttaggtgcatcagggatactgatctgtagttttgtcgctattgcttttgtgtcctggtctggtttgggtagcagagtaatgctggtctgctagaagaagtttggaaatgatcccttctcttccatttttttgaagagcttgtgtcaaattggtattagttctttaaatctttgggagaattcagcagtggagccaccaggtcctgggcttttctttgatgggagactttttatgatggcttcaatcatattgcccattattggtttgttgaggttttctttttcttcatggtttcatgttggtaggttgtatgtgtgcagggatttattcatttcttctagtttttcctatttgctggtggatagttgttcataatagtctctaatgattgtttgtatttctgtggtctcagttgttagtcttcttttttgtttctgattttatttatttgggtcttctctctcttctcttagtttagctaacagtttatcaatttttgtttgtcttttcaaaaaggcaagttttcatttcatcgatcttttgtaatttttttttagtctctactatgtttagttctgctctgatctttatttatttattttctagtttaaaattttgggtttagtttgttcttcctttactagttcattgatgtgcattgttagattgtttatttgaaatctttctacttttttaaagcaggcatttatttctataaatttattcctggggatcaacttacctctttctgtgtggtgaggagtgtctcttgggatgagccgatcccagccaggctcttcactttcctctttatgctgccatctccagtctctgtgcatcagaaggtctttatcactttcttgctgaattccagtgttttctcctatacactctatttgatgtgttgttttctaattgttttggtcctttgtggagtaggagagcactgggcatctcttatcagccttcttgatgacatctggataggacaatattgatcaatgatatatctagaagcaattttgaataaataatatagtgttataggttataattaaatatgtaaaccaaaaataaataaaggaaaggaagaaaaacctccctttttttcagaggcagggagtttttatttttggcttctgtaatggtatttcaccaagttttaaaggtattaactttattaacccgcaacattcatcattttaaaggcgtatatagaaactatcaaaatgggtcagaaacaaggtttgcgatactcataattatcttcaacagtggcaatatttaaccttttgagtcaatctcaacagattggcaatataacataatatatattgataagtgtcattcttgataaaaaatcaaattatttttctatttacaatttttagaaaaggtttaatgtaaaaatatttttcttctttatatatttccctgccatgataatgttaaaacatatcaagatgctcctcaaagtttaggagtgaacagcataacattccattttagttgaagcattctttcacatagccaacatattttttcaagacactctaagaactcgtgaggatactacaggaaaaatgttcctcttgcctactgagcttttagtcatattttccctcaaacttttctaaattaaacattgttataactgggtttgtttttttttttgaaatttaattttccacggtgcagtcctcaagttattcttttattcggagccactccttcagtttcaacttgctgagcaggcaagcaactgcttttggtttctatggaaactggattcctgtggctgcctgtaggtattctcgttccaccaaccttttgttgtgttgtggtatccagtgatttaggtggaaaagtacaagttattcttccatgatggatatgatatggtcataacaggctaggatctaatcggacccagagaactgagagactggaaggtacatcaggaaggctgcaatgtgttttatacaaattgtatgctgtcctagtaacttttccatcagaggtcttatggattgggagtgaagaatcttctgctgcctgagataacaagtaggaaccctcctgccagctacttaatttctttagaatgtgttggagaatgttaaatacattggaaatcttgagtgctgaaagcttttcttttaatgcttctgaggtaatttcttccagtagaaaaagctttgaagtaaatgcatcgatatggccaatgtaaaatatctgttggaatgcaatcaacttccagtccacaagcgacaacgttcactttcagtcagagcttcaactccataaccagcttgattctctacttctggtagtacataaactggaaattgttttccgattttcttctgtttcttagaacgtggtcttgtctccatcctccggacactgcagcacatgagtaacaacaggtcttgcaggctaaataacttatgaataaagtttccttcctgaggagctaggtattccgacgtatcttcaacatagtcctgaagttcatatggcaatcgtccttttggcttctgaaatgcagaaggccatccaatttcggccaactagaggcatctgaagggacagaccgttgctcagaaacagagggctgtttagaattttctaaattcattaagggcaatttgggtacttttctggaaattggctttaagagctcatcctgcattttaaaaatttctccaacaggatcaaattttttatatactcatttgataggtttttttaaaaaaaaatacatgacttgccaggcgtggtggctcacgcttgtaatcccaacacttcgggaggctgaggaaggtggatcacctgacgtcaggagttcgagaccagcctgaccaatgtggagaaagcccatctctactaaaaatacaaaaaaaaaaaaaaaaatggctgggtgtggtggcgcatgcctgtaatcccagctacttgagaggctgaggcaggagaattgcttgaacctgggaggcagaggttgcagtgagctgagatcgtgccactgcactccagcctggggcaacaagaaagaaactccgcctcaaaaaaaattaaataaataaaaagtaaaaaaataaaaacacatgactcttctggactacaagcagtattagtctggttttctgcagaagcctgtcctgaggaagaatttgggctagctggtcaagaatttaagttggaacccatgacagctgtctttccgtcactattatttttacactctgtatcaataattaaacactccttatctgtatcactgctgcagagaactgtatcttcagttttagctgcttctgatgtcacagtcttttcctttgagttgtctaggttttccagaacattgggtctttcagcatcaacatgtaccatatctatagtcatatcatatttattagcagtttcaatttcctgagaattttctaactgtaaggcatcagatgttttcaagtcactatcttgcctcgaagacttgtcagtatttgatacctttttgccacatgattcaaatccctggtcatctttatttttgcactctttagggccaccatccataccagtgaccagttgtttctccttttgcgactgttcaatgagaatctgagataaacttctagaattagcagaaatgtctggtgcacttggtgccacaggtgtagttcctgctttgggggctgtaggagcatctgtcacgttagttactgtggaagtacttgctggacttcttggctttgatgctttggtggtggttactccaaaagtttcaagttttgtaacatcaccatcaaaatccagatacaagttttcaagagtctcagtgttttggcactcactacttcacagggcatgtccatttcagatataaactcttcaaggataaacctcttttctatgcctggtgggagagtcaaagatccctgttcttaaggatgtaaatatatacacagataatatagttattgaataacttgggtttgagggaagtaaaaatagttgttttctagcataaaagtaattcctttttcaaagcttcaaattaattttggatcagtgggaggatcatttttaaacttaataaatgagtgaaagtccagttaaaacagaagaataagaacagttcattttaagtagactctcacaagcttggtcaaatcaaatgctctaggaccttctcgtatattttaggatactttacttgtatttgggagatgattccccaggagtatttcatatattcacatgtggtgtaaacagagactctggcagcttttctttcaaatgatcttttcaaggatattgccattgtgaacagctttggaagttaaggtagcttttccctctgtggtagagggcaggttttcttggtgtttaggaaaattaaaataatgactacttttaggacaaagtttgagcaaacttacttgaggtctgatatggtttggctgtgacctcacccaaatctcatcttgaattgtagctcccacaattcccatgtgttgtgggagatacctggtgggagttaattgaatcatgggggtaggcctttcccatgctattctcgtgatagtgaataggtctcatgagatctagcggtttcacaaaggggagtttccctgcacaagttctcttttcttgtctgccgccatgtgagatgtgccttttacttccagccatgattgtgaggcctccccagccatgtggaactgtaagtccattaaaactctttcttttgtatatgcccagtctcaggtgtgtctttatcagcagcatgaaaacagactaatacaaggtccattataaatgactggagtttcctaagctccagcttccatagctatgaagaaaatccactcagtatacaacttttcccttttttagcctaggagtcttgtgtcttttgccaacatccatgaaacaatgataatgtaactcattagattgcaagtagagtaaacctcagaccctttacaattaagtgtttctccacagtttacatgaaattgaaaaatgaaggcaccaagaatttgtttttttctccttacacacacatctgggcttttacaattgtagggaccagccccacagggtcggagggtttttctccccgtgtgcggagatgagacattgtagaaataaagacacaagacaaagagataaaagaaaagacagctgggcctgggggaccactaccaccaagatgcggagaccggtagtggccctgaatgcctggctgcgctgttatttattggatacaaggcaaaaggggcagggtaaggagtgtgagtcatctctaatgattgacaaggtcacatgagtcatgtgtccactggacagggggcccttccctgtttggcagccgaggtggagagacagagagagagagaggacacagcctacgccattatttcttcatatcagaggtttttagtactttcactaattttgctacggctatctagaaggcagagccaggtgtacaggatggaacataaaagtggactaggagtgtgaccactaaagcacagcatcacagggagatggttaggcctccagataactgtgggcaggcctgactgatgtcaggccctccactagaggtggaggagtagagtcttctctaaactccaccagggaaagggagactccctttcccagtctgctaagtagtgggtgtttttccttggcactgacgctaccgctagaccacagtccacttggcaacgggcgtcttcccagacgctggcgttatcactagaccaaggagccctctggtggccctgtctgggcgtgacagaaggctcgcattcttgtcttctggtcacttctcactatgtcctgtctctgtatggcctagtttttcctaggttatgatcatagagcaaggattattataatattggaataaagagtaattgctacaaactaatgattaatgatattcatatataatcatatctatgatctatatctagtataactattcttattttatatattttattatactggaacagcttgttgccttggtctcttgcctcggcacctgggtggcttgccgcccacatgcaatagctttctagctatttcttctgtagcatataagagttcagcaaacatttactgggtcccaatcttgtaacagatactcttatagatcctagaaatcccaagataaataaaacatgattcttgacccaaaatgcttccaatgaatagaagaaacaatgcataaagacgcatgacacagaaacagtatttttccttccttctttccttccttccttccttcctttctttttctttcttagattgggtctcactccgtcacccaggataaagtgcagtggcacagtcttggctcgctgcaacctccgactcctgagttcaagtgattctcctgccttagcctcctgagtagctgggattacagccgtgcaccaccacgcccggccaatttttttgtatttttagtagagacgggttttgccatgttggccagggtggtctccaactcctgacctcaggttatctgcctgccttggcctcccaaaatgctgggattacaggcgtgagccactgtgcctggcataaacagtatttttcatagcatgggatataagtgacgacagcaacagcaactttttttttttttgagatggagtcttgcttgttacccaggctggagagcagtggtgtgatctcggctcactgcaacctccacctcccaggttctagcgattctggttcctcagcttccccagtaactgggtttacaggcgcccgccaccatgtgccagctaatttttgtattttcagtagagatggggtttcaccatattgcccaggctggtctcaaactcctgacctcatgatccacctgccttggcctcccaaagtgctgggattacaggtgtgagccaccgcacccagccaatgacagcaacattcaaggggtgctctgagagcacactgaggtgcacttagcctgtcgtgaaagttcaagagatggttcttgaagttgatggtcactgaatgcggttttgcaggagattgaatttgaaaagctaccttaccttccgaggctgttcccagtgcaaatatccttgaaaagatcattcaaaaacatgtgaaaagagtgtttctgacggaaggacatatacagaaacataaaatagcatgatgtgaatcaaggaactaaacaccaactgctgttactagtttgtggagttccttgtgtggagcagtaggaagttgaagctggagtttgctatgcatgctgcgttaaggaactcagattttagcctttatgccagttgcctccagacttttttttttttttagatggagcctcgctctgttgcccaggctggagtccagtggtacaatctcggctcactggaacatccgcctcccaggttcaagcaattctctgcctctgcctccagagtagctaggactacaggcgcctgccaccatgcccagctaatttttgtatttttagtggaaacggggtttcaccctcttagccaggctgttcttgaactcctgacctcgtgatccacccacctcggcctcccaaagtgctgggattacaggcatgagtagctggccttaggcttttctgattatacatttatttagtaaaactttctcaagcagtcacctctaatatatctatatgtatttataaatttctctacacgttgtatggtctccccatatattaaatgttagtattttattttattttataaaacgaaataaaaatagataaagttggccaggcgaggtggctcacgactgtaatcccagcacttctggaggccgaggcgggtggatcacgaggtcaggagatggagaccatcctggcgaacacggtgaaaccccgtctccactgaaaatacaaacaaaaaaaaagaaaaaaggaaaaaaaaattagccgggcgtggtggcgggcgcctgtggtcccagctactcgggaggctgaggcaggagaatggcgtgaacccaggaggcagagccgcagtgagccgagattgtgcccctgcactacagcttgggcgaaagagcaagactccgtctcaaaaaaaaaaaaaatagataaagtttctcatattttcttctacacctcaactgattgtctttctcactctccttgagggccacatttagtctgcttgcaggtgctaacacggggaatgatgatttggtcagattcatgttttcaatcactcctcacagtggaagataagagttgagggatgcaggattcaaggagggaagtgtaggaaccaagatattatgatggatcaagcaagagaaagtcaggatctgactgagagagcaggcatggagtgaaaaggagggctaaatttgagaaatacctaggtagtagaattggtacgatccgcccattgagtaggggtggggagtggctctgagaggccggagtgaggcctgagtgaagggatgggagaagcaaatccattgagtagggatggggagtggctctgagaggccggagtgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggagtgaggccggactgaagggatgggagaagcaaatccattgagtaggggtggggagtggctctgagaggccagagtgaggcctgagtgaagggatgggagaagcaaatccattgagtaggggtggggagtggctctgagaggccggagtgaggccggactgaagggatgggagaagcaaatccattgagtaggggtggggagtggctctgagaggccggagtgaggcctgagtgaagggatgggagaagcaagtccattgagtaggggtggggagtggctctgagaggccggagtgaggccggactgaagggatgggagaagcaaatccattgagtaggggtggggagtggctctgagaggccggagtgaggcctgagtgaagggatgggagaagcaaatccattgagtaggggtggggagtggctctgagaggccagagtgaggccggactgaagggatgggagaagcaaatccattgagtaggggtggggagtggctctgagaggccggagtgaggccggactgaagggatgggagaagcaaatccattgagtaggggtggggagtggctctgagaggccggagcgaggcctgagtgaagggatgggagaagcaaatccattgagtaggggtggggagtggctctgagaggccggagcgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggaagggatgggagaagcaaatggcgcacattgtgtttcggtgactgagagaatagtggttatgtttaatgagacagaagattcagtggataagcagattttagtggtgggttcaattaagaaattgacctcatctttatacagattcacttccttttaattttctctcaacacactcatccaaaatttggttgtgttgtttttctgctgaacaacctgtattattctcctttcttttccaaatctccacattttggcccaacccgtgttccatggtgaattcagacagtaaaagaagcaactgtttttcaagtgccttctttgttatttataacacaatgctttttattccaattttgtagttgacttcttttctctaatagattattgtttagtcattgcagatcctgttattcttcccagcaaacaacctcaaagtttcactggcttacaataaataaaatttatttcttgcttgtgtaatttaattttatttcatgtacttttatcccaatgtacatttcaatttgggacccagaccaaaatagccattcaagtgcgaggggtttattttgtagatgatccgaaaagaataggaagtgagatagggaagaaaataatgacaaaaaaggctttattttcaagggcgttatcactgtggacaactggagcttaatcctactgcggaaaccgagaagccagggtaaaatgtgtacctgagtaatcccacccgtgggccaaggtaattgtaatatttacacaccaatttccatcagccattggtcgtggctgtacctatgagtgatcactttccagcatttcaggcctagaaaaagtagccaaggaggtttcagagtcagagaaagccctcgtgcagaaaatgtacatgctagcatttacaaatcagtcaggtatgcatcgatgtggttagagtaaaaggacatagagaggaatccactaaatccatccaggaataaacaaataaaataggaaaaaaaaacccactgttgacataagttaatacttttattttaccactatttctttctttagcccttttattcagttacggctacttgtgtacattaggtaggtagtgtgcaaattttacagtatgcattaactcaaattctatatttgtagtaactaaaacacgccttatttttcatctctatgctattccctcccctttccccagtttctctgtgtatgaagctcgactgacttgtcaaaagctccctaaagtgatgtttttacaataaagtctctcctaaacttcagttaggatcaatcactctctactggctgctcctgtagaattttatctgtagttttgttttgtcatcttatcactttataatattatttacaatctgtctgttaatgtattgtgcacagggctgggcgcagtggctcacacctgtaatcccagcactttgggaggctgaggtgggtggatcacgaggtcaggagttcaagaccatcctggttaacacgatgaaaccccgtctctactaaaaatacaaaaaattacccggcgtggtagcgggtgcctgtagtcccagctactcgagaggttgaggcaggagaaaagctcaccaggaggttgcagtaagccgagatcgcgccactgcactccagcctgggtgacagagcgagattttgtcttaaaaaaaaatatatatatatatatatacacacacacacacacacacacacacatatatatatagaacacctttaagatgatttgtgtcttacttctttttacttatcccatgattgtcacaataaaggtttgctcacatcataagcaaatacctaaatagacatgcctgattttcttacaattatggaagtgaatcttactttgaaaaaaaatcataaatgccccacatttttcaatgtgcttttggacatttcttaataactatgtttttataatattatatatgttaaggcacttacaattttaatgtgtagttatatgtaaaatcacattgtatcgagtaagcattatcaaataattctttatgatgaaattaatttatgagtttctaataaatactacagtattgttggccagaaagcactaatgaaaataaattaaaggtattgtttgttactttaaaggctaggaatttctaatataaagaaatgtaaggaatagttcataatttaagaacacagccacttcaaattgtaaaaaagaattatctattgttaaagcgaactaaatatggcctgggaaggactctatacttctatacttgagtccttgtagaggaaccataacctaacttaataggacaacaagattgaaaacctaatttaggagtatgtacgtggaacaatcgccagtccagcagccatacttcagccactcacacactgctgcgtgttcaaactgtgttcgagtaaggcaaacttgtaaccagtccagttgtttgtgtaactcacttccgatttctgtacatctttttcctttttttgtctacaaattttcttccacgatgtggctgtgctggagtctctctgaatctgctgcgattctgggagctgattcacgcatcattcattgctcaagtaaactcctttaaatttaattcagctggccgggtgcggtggctcacgcctgtaatcccagcactttgggagtctgaggagggcagatcacctgaggtcaggagttcgagaccagcctgaccaacatggtgaaactccatctctactaaaaatacaaaaattagccaggcgtggtggtgcgtgcctgtaatcccagctacttgggaggctgaggcaggagaatcgcttgaatccgggaggtggaggttgcagtgagcagatatcgtgccactacactccagcctgggcaacaaaagcaaaacccgtctcaaaaaacccaaaagtttaattctactgaagtttttctgttaacactgtgttattattttatcttttgatgaaaggcaaatgatataaacaagaacttggaatatttgtgaataatgtataaataaatagtttctgtttattctctgtattctgttaaaagtttttgctctgctcaatatatctggccataaaattcttttaaatcctgtataattttaaaagcaaatttgatgcatgtgcaacttattttattttattttttttgaggctgtttgttacaatggaaattgccttaacaagtctcatgtggcacatgtggtgcccagagcattctgaaagttatggttttgaaagcagtcgttgtggcgacattgtcctaattaaagttctcgggcagttttgccgacattcaaaaccatcttccatttttatccttttgtggtaatatttatcatttataaaaaggaattccaacacctcttttctatgtataatctcccaacgttcctggtcaaagcagtttgctcccaaattaccagaagtggtctcgttgcggcagcagagctcccctggtgcacttctactcacgggtttgttgaacgtgtagctttacccaccttgaggcagaactgcatgtgcccgtgttggcgctgacgcatgatgtgtggtgcacggatggagcaaaggtgaatatctccccacagcagacctccgaggttcataaattatttatcacatacttcagtgtgctgccacagtgatcagggccagtttccaatatggagacaagagctctttaatcacgctcttccctgcaaaagaaaaagattggcatttaacagagagctgtaagacaggatagggatgtgactgcagggaaacctccacttggaataggagtcgctggtcagttctagacccaatggcatggacttatgtagtaatagtagtaagagttcctgaagatagtttcaatctattgccagcattctgtaggtctttataacaagcaggaaatggatacacatgtctctgttccataattagaaaagtatcaccattttcctgggacaaaaatatgtaagtttaaacatttttagtgccaggtcagtagtcacgatttaccaacagcattttttattttaaaaatacagttagtgactacaccattggctaacaaactgagacttaaagcattctctagatgcaaatgctacaaataaatcaaattattaggcatattcactaatacttacaaacttaacttcatatataaagcaaggtagatcaccagtgtggccatgcaaacagggtttgaggacttcaatatttaaagcaagttagtccaacccacagcccaagggccacatgcagcccaggatggctttgaatgaggcccaacacaaattagcaaattactaaacttacttaaaatgatgggattttattttttgccattttttggtttgtgtgtttggtttttagctcatcagctttgttagtgttagtgtattttatgtgtggcccaagacaatacttccaatgtggcccagggaagccaaaagattggacactcctgatttaaagggaaaagggagggcagatgaagaaagaggataaaaaaaagagagagaaggtagacaaaacaggaaagtggttagtctttggaggctttgattagcacttactgaatctacattttacatgtgaaaggagtgggtagcgaaacagtgaattatgcatagtgctcagtgcgtctgcatttttgcataagataaagtaaacatagaggaggtgctcaaatatgcattcctctcaggtgagccaagggatgccctctaggcctgtctttgtcaaggtaccggtgaagataagctgttagtttacattgtcaaggtgaaatagaacagcgttctgttttagggtaaagctcttggggcccacgaggaatttccttgtgagcaatttgtgaaggaggccaccgggggagacatgtggccttctgtctttgcagctatctacttaggaacaaaatggaaggcagtttttgcatgatgcagttactgagcttcacttttccctttggcatagtgagtttggggtcctgagatttttatattcctttcacagcctcactatacttgaattaaaatacaatctacatgttaaaactgaccacatcattctttcctgtgtgtcttcaaaggatttaaggcccatccagataatccaagatgatctcatttcaaagccttaattatatctttgatgactctttttccaaataaggtctcaattagaggttcctggaataagacacggactcatctccctgggggccaccattcagcctgatccggaaggaaggccatgatttcagctctctgggatttgagacaaagaggccccttttctttcattttatcttttcatgtctcttcttgccatgtacccacatgattgagtgtgggctgagggtgaatccaagaagggctttgttttgtggtcagtacaggctttggtccacagagacaacaatactttcaatactcttttgttctgccccagaggagctcaacacagaattgcctagaacaagaaactgggtaagtgtgcttggaacatacgcttgtcttctcttctttggactcttgattgcaacactcatctctgcctggatattcacatggacttatactctctgtcttttcttctgtgtgtcttctcttctgtatgtcactgaatgttgggcccacctggataacccaagatgatctcatcttgaggtacttaattatatctgcaaataacattttcctaaataaggtcacaggcatagttttgggggactgggacatggatatatctttttggagaccatgatttaactcactataggctaaattctcagccctaaaaggggtcctacacaaagtgagggcactcaatggaaagaagggctctgagatgtgagataggaacatgtgaacagaaccttcaacccacagattcccctggactatcaggtccaggagaagagactccttcctctctcaggttgagactcccacggcctggagattaggcaaagcctctgttcgatctttgcatgaaattaagtagtcttagtggtctattgcaggggtctctatctgtgattgacctttacttatttcttgcttaatgtactatcattctctttttttcttgaataaggtagtttacatattaaattcttcgctaaagatacagctcttaaattaaaaaatactactactactaccattttgctttagtcagtaagttctgccttaattttctgtctattttatatattttgtctatattttgttgatatattaaagttttttcttgtttttattaatatgatgatttaaggctctagaatttcttctgagtgcagatctacctgggtcatacagatgttgtcatatgtggtcagttcttttacaaatattcttcaacgtttttctctttggcccttaatgatataagaaaacttccaaaaactgtatgttttttagtgttttggagttttattgtttatttaatttcactgcatcttaatcaaataattaaaaatgctttttagaaattactgaagttttgtggtctgaaatatagtcttttttatgatctgtggaatcaaaaaaaaaagcattctatatttttaaggtgccaagtttgttatctgtcaattagagaaaactatgtgatttacatttttacatcatgacttactattgctctcttcagcagtcacagcctgatagaggtgatgtaattttccctgctgtgctcctgtgtctgtgtctttccttatgcatgctctacttttttttttttttttttttttttttttgagacggaatcttgctgtgtcgcgcaggctggagtgcagtggcgcgatcctggctcactgcgagctctgcctcccaggttcatgccatttcctgcctcagcctccggagtagctgggactacaggcgcccgccaccatgcctggctaattttttttatttttagtagagacgggctttcaccatgttagccagcatggtcttgatctcctgatctcgtgatccgcccacctcggcctcccaaagttctgggattacaggcgtgagccaccgcgcccggcctactttttgttttaagaacattgatgctctgttatttaatctctagaattcataactggcatatcttcattgtgaatcacacgcttattttttcttttctgctactttttcttacttctatgctttttctgccctgtgttttaaagagaagaaaatcagtgatgccacacaaaacactccgtggtagtcagatcacagcgatggttttaacatttgtagtgctgacattctgttcccgttcttgtctctttcactgagttctcctaccatcaggcaggttccatgctcgtcaccaggccctggctgcaacttttcataccctatcaacatttggttcactgatgattgttgtttgctagattttccaagcagttccatataaacaatgttcccatatctttgaacattcaaaaatcagtttgtattgcgtttatacttgattgaaataatagttggtataaaatttccgggttgcactttcttggtgcaaaatttcacaggtctcagctctttcagtattgaatactgctacacactgcccttgtgattacagattcaagctggccatcagacttgcaagacacagacagctttaatctgatgctacatttactgggctttaaaggaggatacaggccgggagacacagctggtgtcctggggcacccacagctccctttgccctttcacctatccagggcctatgtggctgccacaaacaagagtcagggtgcttgcgggccacatggataatcagaagccaccgccttgatttcccaacaattttttatgctatttctagacacaaagctacaagccacatattgattcacagcccccctgttccaagggcaatggaacataggtgatgagggagacattccacatctatttcaaatctgtaatttccaagtgtgtctgttagcttctgttgattaggaaattatccccaaatttagtcacttcaaacagcaacagtttgttaacctaaggatctgctgaagagttcccatggtctgggctggctctggctaatctcgcccaggcttgctcacatgactgcagtgccttagcaggatggcagagggcgactagcccgtcatagcctgcctgtggtctggtggttggccatttgcctctggctcagcgtggcgattgtttcattattttgcattcttttgttgttgttgttttttgttgtttttttttgtttgttttttgtttttcgtgttttttttgagacagggtctctctctgtcacccagactggagtgcagtgacgtgatctcagcttacagcaacctctgcctctgaggctcaagcaactctcccgcctctgcctcccaggtagctgggattacaggcgagcgccaccaccgcccagctaatttttgtatttttagtagagatgggttttcaccatgttggcccgggtggtctcgaactcctgacctcaaatgatccagccgcctcgccctcccaaagtgctgggattacaggcgtgagccactgcgcctgcctgttgttaatagtggtaaaatatttggtgcagcttctcagtggccacattttacagtttcggatgcactttctggatcgggcatgcattttctgcttgtgtaactctgcttattttgcattattttaaggcatttataattaattctgattcctcattttggactatgttttgtttctcctgaaccgtctctttcctgtaggtagagggaagcatttcatggagggccaggtccctggctaggacaaggtagagcctcacagtcatatttggtatccagcggccattgctctgccccagcctgtcatctggctgtggtgggtttggtggcccacgtctaactctacctctgtttctagactgtgacccgggaccgggggaaattagtagcagcccgtgcctccagtgccactgtggcgagccctctaggacgggcctctcacattgggctttatggtgtccgcggcctcagtgtcagtactctgctcctccccacaagcagccctgctcagtttgccctgggctggcaggctttttctctgtgttgaggtttggcatttcacctcactcctgttttcattaaaagtagacttttcctttctatttcaagttctgtggatgattttgggagaatgttttctttatatcatctgcaaatacgcttcctcatttcccacctcgactttccatcttccactttcaatcttttctttttttggaaggagggtggggtattgtcagagttgtattttccaagagccctttcaatttctccatttttgccctttatcactgtgtgtgtgtgtgagagaaagagacatacagcatacatatagaaagatgtgcaaaatgtaaatgtatatttaacaagtggttataaagccatataatatgcaacaaccacacaggtaaagaaataaagtcttaccaaaacctagcagtctcccaggtgtccctctccagtcaccacactcttcctcatgcccctaccccagtacccccaggagtcaaacacttttctgcctttagtgtcatcatgtcttagctgtgtttataattttaccacctatatatgcattacgaaagagctgcttctccttgctatctttttcttgctgtaggtcttgtatcttcaaagatacttagaaatagggttccgaatataactttttctgtttctgcactctctctcttcttttgtgtttcctttaatctgtcagactgattttgttccactcacatgaaaactctgtccccagtgcctcctgatccttgcctctgcattcatgactaagtgtgatgcactgggagatgactgggagtccgtagggagtgggcgtattggccagtggtccttgcctctgcattcatgactaagtgtgatgcactgggagatgactgggagtccgtagggagtgggcgtattggccagtggtccttgtctctgcattcatgactaagtgtgatgcactgggagatgactgggagtccgtagggagtgggtgtattggccagtggtccttggctctgcattcatgactaagtgtgatgcactgggagatgactgggagtccgtagggagtgggtgtattggccagtggtccttggctctgcattcatgactaagtgtgatgcactgggagatgattgggagtccgtatgggatggcgtattggccagtggtccccttaacagagcggacctttgttgttgggcatcacctgaccccagtgtctaaaggagaatttcctccttggagataacgtctgaccgcagccttctgggagccacgggaacggtcttgtgtgcctgcaattagaacacacgtaatcactttatttctgaatttaagcctcacccagtcccccatggttgcttatttgctgactcctagctaggaaactttctgagattctctgagtgaatcacatttgttttcttcgtaggttgtggctttctttattgtactaaatcaatgcctactagtctgttaaatgtcaaagaaatattaaactttttatattctaatactactcccattcttttgtcctagtgggcttaaggatgttttaatttattttgctgtcctcgtagttgattttctttcttctttcttttttttttgagacagagtcttgctctgtcccccaggctggagtgcaatggtgcgatctcagctcactgcaacctccacctcctgggttcaagtgattctcccgcctcagcctcctgagcagctgggactacaggcacccgccaccatgcctggctaatttttgtatttttagtagagacggggtttcaccatcttggccgggctggtctcgaactcctgacctcaggtgatctgtccgcctcggcctcccaaagtgttgggattacaggcgtgagccaccacgcccggccttagttgattttcttaaggcagagcagataacatttgtgcttacactaccacatttaaccaacatttcaatcagggatagtttaaataaaactttatataagagtttcccatttcctccattctctttctagaagttttttttcttttttttttttagtattgttattacttgtaactgtctgtgtgagtgcagagatataatattaaaatttatcaaatttcagggtagtgatattaatcatttattttagtagcaaaattaaatgttaacattcaactgtaagattggaagatttaactgtcttttcccccattgaattaatacagaacaaaaatttatatttctgatacagacaggagacagggaaatactgggtagaagatgatggtgccctgacaaaggctctgccttcaagcctggaagcccatggctctaagtggcaacaggcattcctgttttcctgcccaaaagttgccttttcacctgccatgccccactatcctgtacccatataaaccccaatccccaggctccagaagcaggcaaggaagtaacaaacagaagagtagaagaatagcagaatggtgtggcagagagaagagaaggaacatctgaacatcgagaggagttcagctagggatggttggagaggagattggctgctggatggccaaactccaggggaagatcatcttcccactccatccaccttccagctccccatccatcccactgaaagccacctccaccactcaataaaacccccgcattcatccttcaagtctgtgtgaaatctgattcttcctggattctggacaaggacctgggtactgagagggcactgagctggttaacacttaagccatctgcaaacagcaaagctaaaagagtgcactgtaacacacgtccacttgggctttgggagttgcaggcacccacccttagatgctaccatggggccagagcccaaaacacactcagcctggctcctgcacctgcctgtgtgcccccctcccataaggggtttgagtgtgcagtggcagaacatacgagccacacccctgtcgcatgtcctgtgaggggggtcagggaactctaccgtttcatttccactggttgatatgagattttgcaaatgatacactgtagatcagatactctcaaagaaaaaaaaaggctacaaagttgtagtgttcaattaccttattcatgaatacttttttcctaacctaattaactcaatatcttggcatcactaggactttgagctttacccaatacgggtttctttcttcccgaagcgtttgttttactgccccattttattgctttcaattaatgaaatctgattctaaaaccaagagttcctgaggtgttagccaccaccactatcctccctgctgtcaccttcattctatctgttccacctatcttttgaggacatctagagttgaggttattaaccttatatcatgttcccttctccccccatttgtactcattttgtttagtgtgggtaattcaaatgtaaattgttttggtcacaaaccccaactgcttgctcacagaatagcctgcaatctgccttttgcaatgatcactccttcctggagggtacgttggcatcattgagtctgatggcacctgcttctgccatgttagaacactgcctgcagccctaggatctggacttcagtcagaccagcaacatattcgcttttttctcttctttgtttgcctatttctctgtcttctaattgttttaaaggtgaaggagagtagtagtacagaaataataataacacaaaattaaaattaaattaaaatgtaaaaaataagtacagaattaatttttctctggcttgattttaaaatgttagttccaagtgctttaggttggagatgtttccgacccgagcatgtcttcccccacgtaagcatcccttcacacattctttgaaatcagctgctctgatcctaaatgtaggcctcacgtctcaccagctgtataatcttgggaaagtaggaaactcactttacttctttatttctgggacagggatcctatctccaagagttgttgaaaggattaaatgatacagtgcacttaatgttcctggtagataagaagtgctctataagtagtgaccatttttatcatctgtgtagatgttaaagtttgccaggatattctaggattatatactctgcaattccgtgctgctttcatacgtttgctctgataaaacttccctaggacactgagaaaagatttttcagggctgactaagccctgcttaaatattttccagctgttctggttcttaagaaagaaaaaaaaaatagattcttaaaagagaattaactcatttattcttactctttattctctgtgtctgaggggagaccctaccaacctcccatctatgactcccagtaatcacaggatacatcattgtctgggaagagagggagagggccacaggcttggcaaagtccgaacttccggtcttcctgctttccaatatccccaggcttctggccttgtacacggttaacgtgtttcagctagtgctgagtgttgcattctgccccttcaaccagatcacttccgctgaaagtttgcatctcccagtatcagtgttggggaagccaaatgaaatctatcaatcccagttcagaatgtaaagaaactgaagatcctctttccccatatggattattatatcatcatagcatttggagaagccaagatcaacaaaaaagcagttagcaggtatgcatgtgtgtgtgctatttgaacattacacatagtaatttttcagaaaagattctcatctctgaaaaacttttcctccctcaagacaaaaagaagtatagctcatttcattttaggatataatctgtctttgggcttcagcattttaaaattagacatatctttgatagaatattctttcaattgttaatttctccaagaaagttcagctctctggaatcagattgagattttttgttaaatccttatatttgtcttcagtgcattcatgttttaaaacaatacattgaaaatttggaagtgtttttacttcaaataactacattgtctttttctaaaatgagaagttgcagtgttccatgttctgatttgatatttttcctgatttctgttagtagtcttggatgttttctgtacttgtatttggagtatgcacacttgtctgagacagttctatttctcacagtcttcactgtgccacatatttgcttccctgtcatcttcaaaagagtgggctaaggccaggcgcggtggctcacacctgtaatgctgacactttgggaggccgaggcgggtggatcacgaggtcaggagatggagaccatcctggctaacaaggcgaaatgctgtctttactaaaaatacaaaaaattagccgggcatggtggtgtgcatctgtagtcccagctacccgggaggctgaggcaggagaatcacttgaacccgggaggcgaaaagttgcagtgagccaagatcgcgccactgcactccagcctgggtaacagagcgagagactccatgaaaaaaaaagaatgggctagagcttggctacactgcgagatttattgtctttgaactgccacttattctgagctgctcacttccattaatcagcctgacttaccgactctggaattgtgtgctcatatcagacaggttgtggctaaagtccatccattacatttctaggccctcacttctctgtacaaccccagttcagtcatgctggcaaatatgtggggagcgctcagccctgaggagttccataagggaaagttccacatgggcttggattatatacctaataactcagagcaaatttgtgaaagcttcacatgtcatttacaatttgtaggcactgcagaactgtagattctaaagagagaaggctatgccttctgatgatagtcttaaatcatggaaagctaaaacaataaacacctcaaattcagtgtatctttgccttggaaaaagggttagacttcatggttgcaattcacctcactcgcctgtggttcattgattctgacatctaattaaattgatcatctacagtgatcacaaggcgattgtttgccaaacactactggcaaagaaaacttagctcatacttgtaatttactttaaggtttctatccggaattgggaacaaataagaaattggttttgactaggaaattgtacacaattgtaatcataatttggactggaataataaccactgtgcatttgcttgtttctgactttgttagtcttcataatattcctttcaggaggttggctatatttatagttaactgaattttgccaatgttttctttccacaaagcttgttgtatttaattgtctttaagaaaagaaacgaaaagtatctgtcaactttcaagaaataaaatgtttttgttaaaaatcaatatttattaaagcgaatgtcttttgaaaattcaagcaatatataatttgcaaacatttgattaaaatagtttcagtaatatatttttagcttgaatgggtcaagataataaatcaatattttctctcaaattctgataacgtgtaaaaaagttctttgaaacaataataaaacttaagaaaaagcagtcagtaaagctactgatgattctttatttccttttatgagataatcagtcttttgacttcagcattttaaaattaaaaatacctttgatagaatattcctttcactgttaatttctccaagaaagttctgctctttggaattagattaactaatgatattttttgttaaatccttatatttgtcttcagtacatcctagtagacttgtttagatagcagacccaagagttaaattcaaataattagcaggaatggaaaatagaggattctaatttttcttaagaaaatgctttcttatcattggcaaaagaatgagtttattcacagacatttttattccattattctgtgagtaaagaaaggaagaggaggcatgttgaggttttcttttcctaatgatgttacattaattattgtagccaagatacgcttttgaatacgatacaaaaacatacctacaataatgatcataaaaatattcctttttccatcgctgaaaattgcctttatttgacaggatgatcttctatgcatctcatccgactgtctgtatttcccttctgctttggtggagtggggtgagagagagagagagagagagagagagagagggagggagggagggagggagagggagagagagacaaggcggaagcagagcctttgcgggtagagcagataaagattcccagacaaatttcatgggtgaagtggccaatttacttcttttatagctgaatgtcattttttttgtggatttttccatcaagtagtgaaaactcacatattaataatattcagagtctcctctggccatttaagcaccctctttgtccagagtcaagtcagattcttggcggccctcctggcgccacgtgtgtgaggtggggggaggtttctcacccttggcgatcctctcctccgcacaggggcgtctgtgggggtgtccgccattttgtttggtctcagctgccagttcccagaggaaccctctcttctggccacacgcccgcttgatggtcacaggcctccgtcagcggcttctccatccctctctggcaagctgaagtacgtgacgacttccctggccctctagggttctcaggccgtcaggtacgggtctctgtcaatctggcacctgacagctgagacaaacgaaaaagacgctccgctcgctgattcctgggccgcgcggggtcacggggcgctgcggctttcctggaatctcctcaggattcaggcacaccctgtgctctcaggttcactaaacccgtctggggtttctacacacgacctgaaggcatctccgccctttggcggcagatagaggaatagaaacgactgaggagacatgaagcagggaggaaaagctggatgagaggaagcacagggagtggaaggcaacgtccaggagacacggctcctgatgccctttcgtctcggtgggctctctgtggcgaaccgttgtctgcttgagaggaaaagggaagtcatatttggtgccatcctctggactccagatgtttttgtgcctggccataattatatatatatgcgcatatatatatatatttgcatatatatatatttgcatatatatatatattttgtttgtttgtttgtttttggagacagaatctcactctgtgcccaggctggagtgaagtggcgcgatctgggctcactgcaagccccgccttccggcttcccgccattctcctgcctcagcctcgcgagtagctgggacgacaggcgccgccaccaggcttagctgtcaaattagctatttttaaggtaatcgattctgaaaggcaagtcagaatgtataaagctcaaatgaacttctctatgttacacactgtttctgtaccattcagtcttgactccactcttcctgccgccctcagtctagttgcagtccaggtgccctgttttcagttcctaaaccacaccatgtcatctctagcatcaagcatttttctctacagcatttttccttcctacctacaacccatactttatatagttaacttctattcctcatttttatcttcatttcgagtaacagacttgggaaaatcttccataaattcgtaagtttaagtggagaagcccttatgtgtgtgtccacagtatcccatagcgcttggtactgtgttaccataacacacaccactgccttgtcattgtctatttaccaccagactaagtccaagaggcttcttttttgttttgttttgttttgtgtttgtttgtttgagatggagtcttacactgtcgcctgggctggagtgcaatagcgtgaccttggctcactgcaacctccacctcctgagttcacgcgattctcctacctcagcctcccgagtagctgggattacaggtgcgcattaccacgcccggctaattttttgtatttttagtagagatggggtttcactatgttggccagactggtctcaaactcctgaccttgtgatccgcccacctcagcctcctaaagtgctgggattacaggtgtgagccaccgcgcccagccccaagaggcttcttgtaggtcttgtctgttgttctattctagtgccttgcacagtgcttgaaatatggaagaatctgtaaaaaatcatattgagtacagttggctctctggatccgtgggctccacatccttggattcaaccaactgtagattgaaaatattcaaaaattaaaaaaaaatcgcatctgtactgagcaggtacagacttttttcttgtcattattccttaaacgaaaccgtataacaactattcacatagcatttacattgtattaggtattctaagtaatctagagatgattaaagaaaaagcgaggatgtgtgtagcttatatgaaatagtgtgccttgttatatcagggacttgagcatctgtagattttggtgtctttgggggtcctagagccactcccctgcggatacggagggatgagtgtatggaggtggtaaatgacttgctccaggtcacattagtgagtgaaagagcaagggatgtgctctcggccattcagttctagaatctgtgcatttaaccacgatgcatatagccagacacagagctgttattccaaaacactgagaattagtaacaagggctctttaaactattggatctaaactaatttcaactagattaaatctacttcattactttttacaaatgttgtttcctgggtggggccttttggaatgatgaagttaattatgaaataaaaatggaaaaatgaatttcatccaaaatacattttctgcagatttaaatgtctgtgtatattacatatacacgcatctgtatctatgcatgtctttacatagatatatccataaatgtatatgttatatacagcgtattagggatagttctccagagacagaacacacgcacatatatacacacacacacacccacaccctggcgcacacacacacatccacacacacatatatgtgcacacatacacacacacacacacaccccgccaagcacctcgtaacaatgtttaacagaagaccacatagacaatggtggtaccatgacatgagattctagtggagctggaaaattcctattgcctggtgatgctgtggccagaataaagtcatagtgcagcgcattactcacatgtttgtggtgatgctggtgtaaacaaatcgtgctgccggtcatataaaagtatagcacagcccaggcacggtggttcatgccagtaatcccagccctttgggaggccgaggttagtggatcacctgaggtcaggagtttgagactagcctggccaacataatgaaaccccgtctctactaaaaatacaaaaattcgccgggcatggtggtgcgtgcctatagtcccagctactctggaggctgcagcaggagaattgcttgaacccaggaggcggaggttgcaatgagccaagatcgtgccattgtactccagcttgggcaatagagctagactccatctgaaaaaaaaaaaatatagcacatgtaattatgtacagtacatatttgacaataataataaatgactgttacctgtttatgtgtttactatatcgtatgttttatcattatggtagagtgtatttctacttacaaaaacagtgaactgtaaagcagcctcaggtacctccttaaggagctcttccagaaggcattgctatcacaggagatgacagcttcatgtgtgtttggcccctgaagcccttcccgtgggacaagatggaggtggaagacagtgatattcatgatgctgacccccgtgtaggcctaggctaatgtgtgtttgtgtattagtttaaaaaactaaaaattaataaacatagaggaaaacttatagagatataaagaaaatatttttctgcagctgtacaatatgcctatgtttcaagctaagtgttattacaaaatagtcaaaaggttaaaacagtcaaaaggttaaaattaaaagtttatgaagtgaaaatgttacatcagccaactttaatttattaaggaaggaagagcgtttcttttttaatgatgtagtgtagcctctaagtagttttcatgaagtttgcagttgttacccagaccttcataggcgctcactactcactcagtgacttacccagagtagcttccagtccttcaagctctattcatgtgaagtgaactacacaggtataccagtttttatattttataccataattttaccgtcccttttctatgtttgggtacacaaataccattgtgtttccgttgcctgcagtattcagcacagtaacctcctgtacaagtttgcagcctagaacaataggctctactgtctagtccaggtgtgtaggaggctgtgccaactagatgtgtgtaaatgcactctagaatgttcacacaaaggcaaaattgcctaacaacgcatttctcagaatgtatccccccttgttaagtgacacatgactccatgtatatatacaaagagagacatagagagagagagagcgtgcacacacaagaatgacagggagagagagatttattataggattattatgggaattggctcccataattctaaagactgagaagtcccatgatctgctgaagaactaggaaagccgatggtataattaggtctgagtccaaaggcccacaaattaggaccaccacactagctggctgtggtgtcagtatctgtcatcccaccgatttggggggctgaagtgggaggatcacttgagccaggagtttgagaccagcctgagcaacatagagagaccccagctctaaaacagaaaaaagaaaatcaggagcaccagtgctccagggcaggagaagatggatgtcctaggtcaaacagagagaaaattctccctttctctgtgtttttgctctatttgggccctcagtggattggatgggagtgcccagctgcttagtgaaggtgatttcctttactcggtatactaagtcaaatgctaatcttttctgggaacacattcacagacacacgcaaaaagtatgatttcccagttttctaggcatcctttagcccagttaagtgggcacgtaaagctaaacatcatatacatgtatgtatgaatatatacatgttccttaccctggatttctctttccctgtcactcttataatttgtgtatttatttggggaaagaatagttatcaagaatttctagaggaagccaactgtctacataagcttcagagttacaacgcctaactctatccaatctaagttaaatttaagaatgaatgttgagtacatctggtttgtatatggtgttttggcagagctcaatttaattcatctcaaaaagcatccagtgagcacataccaaataatggcctcatttcaggctttgggctgtataaataacatacatcccaatgtggggaaaccagacaataaacacaataatttacagagaatttaaaggaggatgagtgtcatgagaagaaaatagtaaaaggtaaggaggagaggaactacatcgtttgggattgcaattttaaacagagtcaaaacttgaaataattttagtatgttgcaaatatatctaaaatacgtaggacgtcttgcatggtcacgtaagtctagaattcgaaaaatagctagagaataaactgaaaattcaaaattaatatattagaaaaattttggaacttttatattatagcaaggtaattaaaatattttcataaatgtacctttattttgttatcaggaattaggcaaaggctgttgaaatattcgcaaatacaacccagctctagaaatcaggaagtggtgctctacggatatgcaggagggagtgctgaaagaacagctcatgaggtagtgcaggcagaggcaggttgatggcagcagtgactccaatttgctctcactctgtgtctccattcactttggtagtgcaggcagaggcaggttgatggcagcagtgactccaatttgctctcactctctgccttcattcactttggtagtgtcctcttacacagacgctgggattggaaaccagattgctttgacaaatgggaaattagcaaatatgagatgtgcagcaacttgagaagtgctcatgtgctgaggcatgtttattgatacacttagagacccgagaccactatgcaaatatgcgcccaccagccctctggaggatgagatgattgcctccaacaactgagccaagcatggttttatttttgtttttgtttccgttttggttttcagatggagtctcacttttttgcccaggctggagtgcagtggtgtgatcgcagctcaatgcaacctctgcttcccaggttcaagcaattcttctgtctcagcctcctgagtagctgggactacaggagtgtgccaccatgcccggctaatttttgtatttttagtagagatggggtttcaccatgttagtcaggctggtctcgaactcctgacctcaggtgatccactcacttcgtcctcccaaagtgctgggattacaagcgtgagccactgcgcccaaccctgagccaaccatggtttaaccaccagtgatctgagtggccaggtggtctctgatgatccacaagctgaccaaggttatcacagatgctcacataagtctagcccagaccagaacttccaagcagagtgcagctgaaattgctttcatagaatgagctaataaatggtcgtcatgttaaaccagtaaggttaagtggtttgttacacagcaaaagctaactgacacagtgcatttaactacttcaattctgatagcccatcacagaatattttagctaagaactacatctaatttatagtcctttatatttttttctgttggaagcatttcatagagacaaactagttgctatttaagtaaaataatgcaccattatgcatacgtttttgttacctatgtagacaatgagaaaatagaattgttttaaattcctagggacacttataagttctaggttgacatttatcaaattttcattattatgtctaagcacagtctttccctactacctcccaaataaagagttacctgctaggcgcacatctatcccacgaatttgtcagctcaaaggaacaaggccagcagttatgcttgattatacagaataaatagagtatgaaaattgaaattagacacacttactataaaatgtgatgattatttccattccaggaccaaattgaattaaaaaaaacttattgatctggattgaatttcaatttgctaagatttgagcaagccaacttctgcccagtaatgtttgaatagaaaggcttatgaggccaatagtctgttcatcacaggtgataaagtttttttttaaagtcaataaattactttttactacaggagaaacgtatgctttatatgccaacaaagagttgaaatgccagaagcacttgaggactaaattacggagcacttatttcatcacaacagaacgctaacgcgggtgcttgattacaacaagccatccaattgcatgaatttgggctgcaaggcacccaggcttttatattcattagcaaagttattgattctggaaagttacctctaataaaactacaccattttctcaggcctgttatatgggcgcagacaaattatttgatcaacgatattgagcaaaaggaaaagcattcattgtctctaatctcttttccctcctcccagaattgtacatggcgatcatcagcagtatgaagaggagctgtggggccaggtctgatttggttttatatagctatataaatatttgataattaaatcacattgtttcaataagaatattaaataaaagctaaagttaaaaatgacaaaataggccgggtgtgttggcttacgcctgtaatcccagcactttgggaggccgagatgggtggatcacttgaggtcaggagtttgagaccagcctgaccaatatggtgagaccccatctctactaaaaaatacaaaagttattcgggcatggtggcaggcatctgtaatcctggctacttgggaggctgaggcaggagaatcacttgaacccaggaggttgaggttgtagtgagcctagactgcaccattgcacttcagcctggtcaataaaagcaaaactccatctcaaaaaaaatgacaaaatagtataatattatattcataaaaataattttacatttacacaaaggtgtaattcactgtacattagcttcaacaaaacatccataagttattcaattcccagttatcggctgcttgaacttttatgccctttagctccatctgttaaagaacgcatacctccatagagctcccataaaatagtttttaattaatttaatcaaagaatattgttccaagaatatagttaatacactgaatggaatttttataaataaaattaataaagatggaaatgtgttacttaaaaaataagattctagctattctatcattgtttgtgtttccatttaaatattagaatcaccttgccaaattccacacaaaaatcctgctgatattttgattggaattgcattgaatctattgcattaatttggggaaaattaatatttaaaaatagtgagttttccaatccaatcacaaagtataccttaccatttattagaaatttaattttctcagcaatgttttagttttcagtgtggacattttccacctattttcttaaatttatctctaaatatgacatattctttatgttcttatataaatatttaaagttcacattcataagaaaattcaaaccaccaactgggagacattatttgtaaaatatatgtctgacaaagaacttgtatccaaaaggtataaataatttttgcaattaaataataacaatataaagaaaaattgcaaatatggaaaagattgagatacatttgaaaatagaaaatacatgacccacaagcagattaaaagctgctcaacaccatcagttatcaggaaaatgcaaattaaaatcacagcaatttatccattcacacactaaaatgattacaatttaaaacccaatagtaataagatttggcaaaaatatggggcaacaaaacttctcatatactgctgaacagctttataaaacggtgcgaccacttaggagaattgtttggcagtttcttaggcttagatatttgtgccaaagaattgaaacctggttcacaaaaatacttgcctagaaatggtcacagcagcttgattcatcatagccccagaagagagacaacccaaatgtccatcacatcacagacatgggaaaatgaatcaacaacatagatctcatgttagtctcttctaagtggacaggtttttattttccaatccagtaagacaaattctctagaaaacggcatagtacccacctcacaagttcactgtgagcattaaatgaattggtttatttaacacatgtcaaacattgtctggaaaattcagagcactatatattcagagcactatgtatatgagtcttggttatgagtattactgaaacttctatgtgccttgcttttcctgtatttcttgtcacctcattccccttcctcatggctccttttgaagatagtatttaatttacatctccattactgtttggaagctatgtcctttgttatactattttaatagtcacccttaaaatttgaatgtgtgtataaaacgtaagtcctaaagttaatcagtgtctttactttcttcaccctcagattcaaggacctaagaatgatttatttctcatcattcctttcaaatcacacttgcagttgtatttttaaaatttctgccttgcttttataacccacaaattagacattgtttgatattaacaaaagcaagagtcagatctcctctgtgttccttgtctcccttccttgatacatttcagaccttccttatgggaccttattctttgtttgtttttgaagcccaaccttagaagctgttttatgaggcttatttagaagtaaactctttcaaaatctgctcatttgtctttattttgtcctcattctcgaaagatactttagccgtataaactattctccattgcccattattttctctgaacacattgagggcgtttcactgtgttcttgctttgctcattgtttttgtggctcagctagctgtcagtctgaatgttccttcgtaggatgtgcgcttgtttcttctagatccctttgagcactgtagacgcaggtcctctttatagtacaattttggcttgtgtattgaggttcgcataaacagtatgggcttaggttcccaaccatggcagcccagtgggtaccacattaacaggggtgaagtttttactttttctccatctttatgaaaattgagacaggagttaggtagattgtttttccattctcaggggtctggctttatgcagatggtctcaggtttgaactctaggccacaggacactgggtgtggtcccagggagtctggtggcttcaatgctagctttcctccctgtgctgtgctcctgcctaggtcctgcccacatggacttccttcaccttcatgcaggctcatccatgctttacacgttatgcatgcccatttgtgtgtcccaacttagcattttgatttgttatatgaataaaaatcaagagagatgcaagatccgtagtcagtcatatttgtggaaatcgaaatcccccacacattttttcatccatttgaatttattaagtttgaggaaaatgtcttaacaaataagcaagtttggctagtcctagaaactatatctctaacttctaacttgggagttactgtaccaattatatggtgaaaaaaattatagttcataattatttggtattaaaagagacctaaaaattattttttattcattccttttacatctatgaggcaaaatgacaatgcaaaattatataaatgtgattatctacccgcaaaatttggattaaagactattttcatgtgaaaaatgtgaaaaagataaaacgtcacacagactgtgagaaaaaatgtactgttttcacatgttcttgtaaatatattcttatcctttttatctaacgtgtagctaaatatcaaagggccattgactatatatatatatatagctgatgctgaaaaaggctgttgaattgtttcaattaacaatatagcaaaaatactaaagcctttcacttttttttttttttttttgagacagtctcactctgtcgcccaggctggagtgcagtggcccgatctcagctcagtgcaacctctgcctcccgggttcacgccattctcctgcctcagcctccaaagtagctgggattataggcacacaccaccatgcccagctaatttttgtgttttttgtagagatggggtttcaccatgatggccaggatggtctcaatctcctgacctcatgatccgcctgcctaggcctcccaaagtgctgggattacaggcgtgagccactgtgcccagccctttcacattttatatcttgtaattctctattctgctctacaccatagggatgatccttccaaaagcatcctatctagattctgctgttaaatcacctttgttggcctggccagttatcaaactcaacagccccttcatcatcaaagactcgccctctatccgcatctcattccttgcttccgccaataatctgactagtaaagaagtcactgcatgccacaaattgtcagtgctgacttcctcaacaaggaagttatttatttacttatttaatatatgagtgactcagatgcaaattccatcttgagaataccaactcctgatgccaactgattgtcagtcatggctacaacaggagactggattcactcaaatagttcaaataaacagaacgtaatagagggactacttacagaagtgaagcagggttgaggaaagacacaggggatgttgagctactcagagctgcagtgacagcatgtggaaatagaattactgaagttccataaggctggaattgtgagagtctatccaggagtagctgaatttgcagaggaatgcagctgtccacagaaaaacaatggcaaaggagcaatgcagcagagaagacatagtctaatttctctttactttctactgtatgatatggtagaaggcttgcttttggctgtgctggaaaacatacagaaaggaaaaccaaaagataagctttatgttttaaaatctccactcaagatgcaggtggaaaattagaaagccactgtggtgatgttaaaatatatcttgtatgtctgaagtcagctacacaaaggagaaaacatcaaaactaattgcattgattgtgtagtttcagtacctgttaaatgcataattccatcgattcagtttggcaatggctgagcaactaactgactgtaaaggaaaaggaccctaagatttagtatggcaaaccgagataaagttaagaaattctagcccaccaatctcctgaaagctctttgtagccagaatcacctctgcctaagttgctcttggcttgaagatctgctctgagaagagataccatgtacgtcaatggaactacaaaatcttgaaaacttatgcgagaaggaagctggaaagcataaaaaaaattaattcttataaactttttttttctgccttctcttccctctctagctataattttggatttgtctatttttattttcatttatatcaaatgttgtctcatatattttgaagctgttatgtgatgcttgcatttaggattcttgtgtcctcttgatgcattaacaccattataaaatggctttctgtaccctggcatccctctttttcctgatttaatatgcccacagtagatttcttattattagaacttatgtagtacatttttgttcttcctgttacttttaaagtgaatttcttttagatggaatgttgttgtgtctatgaaaaaacagtctatgttttaaaatttagtatttagactatttacctttaatgtaattatgggcatagtagggtttaaatctaccatcttgctattcattttctatttgttccatatttttcttatttcttttgggtttccacctttttccatgttaattgaatattatttaatgtttgcacactatggccttattagctacagctctttattttattttatagatgttgtttatgggtttacaatctttaactcataacaatatactttcaaataatattttaccactttgcatataagaccgttaaacagtgtactttctgtctcctgtccatttttaatttatcacaatgtaccttcaaatcatattatccattttgaaaataatataagaaacttaaaacagtatgtgtccatttttctcttttttggagaattaccatgcattttatttctgcatatgttataaatttcacattacattttcttcttgttttaaactgttaattttattctaaataatttttttaaatgagaaaaaaaattgaatttacccccaaggtagcattcttgtgttctatcttttttgcatattttaaatccaagtatctatttgatattattttcttttattataaataacttatttctgcatttattgtagtgtaagtctgctgttgacaaattaccccagctttttttttctaaaaagtttatccttatttttgaatgatggttttgctgtttgctgaatttacagttctaggttgacagtttttaaatttttaaagtaaaattctaacaccttgtttttgcttcatttctgataagcttcagtcattctcatttttgttcccctgtgtgtagtatgtattttttctccagttgttttaaagttttttcttcatcactagtttacagtagtttcatttttatatagcttgtggtgcttctctttgtggtttgtcctgattttagtcagctgattggtgagtgtatagctttcattaaaccagtaaaatgtttagctattttaagtattttcctacctccttcctccccatcctgctcttgctttctcttggactctacttgcatgtatgttagattgctggctgtttttctactgttcactgattttgtatcttatttttagtctttttttctcaccttgcttcagtttggatagtttctgttgcaatattttcaagtatgtccatctttcctttcacagttttgagtatgctcttaaatgcagtgaatttttcaatttaaatattgtattctgggccaggtgcggtggctaatgcctgtaatcccagcactttgggaggctgaggagggcggatcacctgaggtcgggagttagagaccagcctgaccaacatggagaaaccctgtctctactaaaaatacaaaatgagtggtggcacatgcctgtaatcccagctactcgggaggctgaggcaggagaatcactagaacccaggaggcagaggttgcagtgagccacaattgagccattgcactccagcctgggcaacaagagcgaaattctgtcccccgccgaagaaaaattgtattctttagtcccaactattgatacatggataaggtgtaccatcgccaccaccattatcaacatcataacaacagtgttttatagcacttttaagactataaatgcttttatatatattaacagattttacactcactgaggcttggttatttccatcttaaagatatgaagtgtgaggctcagaaaataagtcagttttacaaacatactgggaaaaaaattgtatgctagaactgaaatctaaatctatccaagtcaatttttatttgctacttcatgctgcccatatctatagttgatcttttaccataccatgatcttaggagactaggaaacaataaaaccacaagtaagaaaatgattctttctatacgtttcaaaccaaatagctatctaagacaatttatccagataatccaagtcaaataaaagtatgcttcagttctctgaatattataagcaaaagtgtaaaagatagctttgtgcctccagtgaagagcagtcaggcaaccagaaggcatacctagcaatataatatttattatttcttgagcttttattgttcggtgttcaatagtcctgtgagatagttctcattattctttatttatacatgagaaaactgtctcacagaagttgcataacttgctcagagtcccatggataataagtggcccaggcagcacttgagtccaggtcagtcttgctttttccctttcttattcactgtcctaccttgcctctatgtttgtgtcccttcttagtcacttctcttgcactgttgatttgcctttttttaatacatatgtgctttatttactgcaattgacaaataattgtatcatttatggcattcaacacagtgtgtggtttttccttttttttttttttattttgagacagagtcttgctctgtcaatgaggctggagtgcagtggcatgatctccgctcactgcagcctctgcttgctgggcttaagcgattctcctgtctcaaccttccaagtagctggggccatccaggcatgcaccaccgtgcctgaattatttatttatttgtagagccctcttatagaagtctccctatatttcccaggctggtctcaaactcctgggctcagcaatcctcctgccttggcctcccaaaagccctgggattacagatgtgaaccgctgcacctggcctaacatgaggttttgaaatacatatatattgtgaaatggataaatctagctaaacacatacttatttttttatctgtggtgagaccacttaaagcctactctttcagcaattttaaagtatatcaccatggggtacaatagatctcttagacctgtccctactgtctagatggcattttgcatcctttgaccaacatgctgatttatctttaacatattgtattgctaccttgtggtaggcagaactttggtcgtcgtgatctcagccacctagcgttacatcctgttatgttacatggcaaacaggctttgcagatgtaattaatgttactcctcagttgactttaagatagggagattaacctagattatgcaggtgagctggatctaatctcatgagctctttaaacgtcggaagaggagggtagaagagaaaatcagagattataagtgaaaaggttggagatgtcattactggcatttaagataaagggggccaaaagccacagaatatgggtgccttcaaaagctgagccaatagctggcaaaatcatgagaacactcactcctgtagcaacatggagctgaattctgccaacaatctaaatgagcctggaagcaggttctccctcagaggctccaaagaagagcccaggccagctgacagcttgacttgcaccttgtgtgcccctatatagagaacccagtcaagccatgctgtactcagacttccaactcatggaacctatgagataataaataggtgttgtgttaatttattatggcagcaatagcaggctaatacatactttaggaacaattaatttcaaatttttgtgtgtgaactctcctcattcactatcatgacacacaaacacattcacccacacactctcagagatactcaagttgtatacttccagaagaggctttctctgtttttaaagtctgaagttctcagcattctcactgagccatgctatcacttttgtgtcactttggacagccttccctgcttctgtcatcctcaactttttcttgcattgtctgttttcccttttccctgtttgcacctcagttcttttgttttctgttaatattaggacctgattatatacacagctagtccacaaacacatgtatagttttcttcacaaaaaatcaaggaaggacattgcattgtgtgaagtgtttgcatctttatatttttattttatacttactgcaaagtggcatgtggatacttttctactgctggacacaaaggtatctattaagatagaaatattcctcatacacgtgctgtaggattcttggaactgaagaaaatttggcctctaaaaaactgtattatcataatcataagaattatatttgatagagtttctaatattttattaacatcaggagattcgattgaagtcaacatttgcaatttaaatgtggtattaagcactttgtttaaaggcagaataattataatgcatcaatgtgtatgtttctacaaatttgacaactataacacatgccacttaaaaccttatttaccatgcgcagtctcatataaatacaagctgtaagtctaagagccaccctagattccattctcttctttacctccagtgactagtccgtccccaaggtgagcttatttttcttcctgaatgaccctaaggggtaaaagtagatttgatagttggggacgatatgatttgtggttatacagaaaaacttttaactactgacactatacaaagctctaacttgtcctttggaggaaaatatttttcttactaacatttactgattagacatttagtgggaatatcaggcaacgtgctggtttcaaatggttggttgcaggtccctttcaaaaatgggcatttccaattctgcgtcaacatcattgtttacacagctgcagagagcacattcttccaggagcaccttcagggctttccgggaagcttctgggcttcgtttgtttggaatcctaaagcaagcagcctttcctgaaaagaatgtcctcaggaaatactttggaataaattaaatgatatttttaggcatttttatcgatctgttgtttagagacgattttgaatctgttgacttattttgtgataaacagaacttttacagcatctcaatggaatctgatttctagattgacttgccaccttgaaatgataattacattgtttttgagaagtaacatctttgtttccataacataagactttcagtttataacacaatgtacaattggggcttacttttttaaaagcactgatttatttgaaacctgtctaaatttggctaggtttcataattggagcaatcatcaatatagtatgaatgaccttatacaatataattttattaaataaaatatttttattaaaactaaatgaagtcataaaaatttgattttttttctaaagaaaaagtgtattgaaatccatggacctaaaatgtggcttattattaaaaaaatcctatttaaatatacttttgaaatagatacatgtttctagcatattttattcaccctgtacttactctcttatgagaattactccacagaaagtcatcttgttttatgaaaataactaagaaagtcattgtttttcttcctgacaacatttaaatgttggaagccacatctttattaagttacattcagctgattgcatttatgaaattaatctatgaggtcaaaaaagaatgaaattagtattcaaaagatatcactaataaaaatcattgatcaatttaaagaagttattaacatataacaatgttaagtagttcattatactttaaatatttccagtctattattagttaaaaagtaaatctgctagtatttcccccccaaattcattatttcaccgaattcctctcatctgaacatagcttagctgtattaagatgttgcgtaagacggctctcagaagctacttaatttattctaattaacaaatgtctgcattcttaatgtgttaattattagggctccccaatctcttattcgattttttcattcaacaagtatttattgaatgcttattatgtcaaaccctcttctaaatattggaataatagtaataaaacaaatcgaagtttatactctcaataagtttatgttgtaatgaaggatgcaaacagtatatacacactgcaatgtcagctagtgataacttttgagagaatagtgaaataacatacatacagggatagaaagtgatgggaaagccttgtctccaccgtccttctttccctctcagagctccagccaagtactttctccagcagtcgtgttaaacacactcccttctattattaggcatgtcctgacccctctatctgaaacacttgccctttgcctagctaactgctattcttcagtcacagtcaaatactgctccacaggcaagccttccccactcccagccatgctcccagagcatcatgaaacttccatgaaatttgacattgtttgtatgatgatttgttcactctattctcctcactagagcatgggattatatatatgtaatattactatatatatggcatagagtgaatgttcaatagaattagttgaacgcattattttaagtataatatatcaagaagacaggtttcaaagaccacatattttaaccattctgttcatacgggatgtttagaaaaggcaaatctatggaaaaagaaggtagattagtgtttatgttaccgaaacaccaggggttcggtcaaggtcctgctactcgctgcacagaaagccaatgattgagacgacgagtattgccaaggaagaatctttaatcaggtgctgcagctgaggagatggaaactcactctcaaatccacctccctgacctgctaaaaccaggagtttatataacagggaaaaaaaatgcaactgtgtgtaagaaaacaggaactagggagacgcaaggaagccatcacggtgaatgaggggtctggcatctcattgtctggatgtgatgatctggtgagtttcagttgtttgatacttttttttgagagacctgatggtcattttctgagggaggaactcagattaaacaaatataagtttcaagctttaagattagaagggtcaattcctatatttatcagaaaatatctatgagaccactgggtcagtttcatttacccagggctgagagagggaatggggattcactgctgactggcctgagggaacttactggaaagatggaaatgttctaaaactggattatggtgatggttgcagactaagcaagtttactaaaatcactgaatcatactaaaatcattgaattgaaaattagatgaattttatgatatgtaaattatatctcaataaaggtctttttattttttatttttctttttgagacagtgtcttgctctgttgcccaggctggagtgcagtggcatgatctcggcccactgcaacctctgcctccctggttcaagcaattctcctgcctccgcctcccaagtagctggtactacaggtgtgcgttactgcgcttggctaatttttgtatttttagtagagatgggattttaccatgttggccaagctggtcttgatctcctgtcctcaagtgatctgcccgccacagcctcccaaagtgctgagattacaggcgagagccaccacgcccagcctcaataaagttctttttttttaaaaaaaggtagtgactaggggaagtgtaaggatgtgggagtggccagggaaggtctttttaaggagatgctatttgaatagaaaattgacatgaaggcaagagccccaaagatgtctcgggacagagggctcctggcaggggagcagtggggatcttaggtgcattgctatgttggaagaacagtggggagtccaggtggctgtggcgaggtggaatgggggccacaggaggaagcggaggctagggaggagccagttaggtatgtgaggtttggttaattagggtcagggtattgaattttattttaaatgtgatgagatgctattgaaggattttagcaggagagcaacataatttggtttacattttgacagagtcactttggctgctgtacggaaaaacagaagcaggaagcccagataagaaattgagtagccagtcacgaaatggtggtgttatggatcagggtggaacggtggaggcggtgaaaagtatgtatcttatagatagaaatatgtgagaatatcacagcctattctaaaaactgctgaatcattgagtgcatatagttggagaagtgggtggagcagaacagcataagaagagagtaaagaagtgtgcagggtcagattacatgaggccttatagggcgtgggacagagtttcacttcatcttaaatgcagtgagaagtcattggaggatttcaggtgcggaatgatacagtcggactcactcacatgaagattattctgtctgccaggtggagaagagctcataggggaagaagcatagaaacccaagagcaagttaagacactaatggcagaggttaggcaagaggtggtggtggtgtagattgggacggtggcaatgcagatagaaaaataagcgtatacaagggctcctttagaattggaacagatgggataactggatatgaggaagaggaaactaaagagtgaagcatttttggtttgggtaactgagttacgcagtttttttttttgagatggagtctcactctgtcacccaggctggagtgcaacagcacaatctcagctcactgcaacctccacctcccaggttcaagcgattctcctgcctcagcctcccgagtagctgggactacaggcgtgcaccaccacacacagataatttttgtgtttttagtagagaccaggtttcaccatgttggccaggatggtctcgatctcttgacttcgtgatccacccgccctggcctcccaacgtgccaggattatgggcccgagccaccacacccagcccagttacagtagtttactccagaataatactacatgtataaacataggttacacacatacttaaaagaacattagagttcttttttgtttttctttgatgtttggctttgatttaatgggattttactatacacattactcttaagcaagcctttaacactcagcactttaaagtgcttggtacatagtaggcttaagtaatattttatcaaactgagctggagagttcttagatattgttcttatctcaaattcagtcatcccttggtatctgctagggattgcttccaggaaccccatgaatttttttaccaaaatccacagatgctcaagtcccttatacaaaacggtgtcttgtttgcatgtcactgacacacatactccgtgtacttaaaccatctctagactgcctataatacctaacgtgatgtaaatgctatggaaacagttgttttactgtatcgtttggggaataacatcaagtctgtacatttttcagtagagatgcaatgatcataggcctaactgccttttcaatctgcacgtggttgaacccatggatgcagagcccgtgggtgctgattgctaactgtatatcctacttctaatccttcttttgtatggagtgagcttccaaaaaccttctgaaacattaagtcatgctcttctttgaagtctgtgaatcctcagggctgtcggcgtgagaaccaaaggctgcagtggtgcacacaatgtccttcatcccagtaggttgattgttcagcatctgtgtgacccaacctctcctattgtccttgattcaatagctgatctactgaactatgtagctgaattacagctcctcaagcacagtgctgtcttggcttggaatgccctactgcttctgttattattatgatgacacattggtgatttttttcctatgagaatcttctctaatttcccaagtgtaagttagctatcctcctgtgtgtgccctgaaccctgtacatccccatcatcacagtagttcattgccttgtaattgcttgcttgcttttatgtttctcccattggacaatatattccttaaagccagagatttttccctgtgatattatcctcagaacttaatatagtatatgttgtcatactaaaagcttgatcaatacaacatacataagtaaaggaacattattcttctacattagagaatacagttcctagggaaagtatgtatttagaccacacgactgaagcaacaggtctggggaacacccatactcaaggaatggggaggaacaaaaggcattagaaaaaaaagaaatgggatagccgtgaaagcgcaagaacaatgttcagagtgtttatcacggccgtctggaaaaaacagaatttcaagaaatgaatgatcagtcatgtcaaatgcttataaaagtcaggaataatggctgtgaaatgtccaatcaacttggcaattaaaaatacactgatgactttatgaagcagtttcagtatgttggttgagacagaagccagatgatggggtgctgcataataaatggcacatcgcaggctgatgacagcacagccctgctttaatacggcaggaaacacgatgggttctgtggcatcctcctactcactgtcttctgtggattgtgactcctggtgactgacagatgtttaatttcctgagggcaagcaaagtcacggctttaatatgcccgagaataatgatggatgatgcaactttggataagcctgtagaagagacaagagaaaggaagaggtgtagaaaagctctgaaggggtctgggcgcagtggctcatgcatgtaatcctagcactttgggaggtcgaggcgggcagatagtgaggtcaggagttcgagaccagactgaccaacatggtgaaaccccatctctactaaaaatacaaaaattagctgggcgtggtggcgggcacctgcaatcccagctactcgggaggctgaggcaggagaatcacttgaacccgggaggcagaagttgccgtgagctgagatggtgccactgcactccagcctgggtgatagagcgagactctgtcaaaaaaaaaaaaaaaaaaaaaaaaaagaaagaaagaaagaaaaagaaaagaaaagaaaagaaaacagaaaagctctgaagggagaattcttgagtgtgtgatgtttgaaatactagactaaagggcagttcagtgggacagtgggtggaatttgcagtggataccagaacagagtttgggaagagagatttggccaagagactacaccctgcagatctccactgacagaggagttagtgaccaagagcctggccactgagctaaaatccatcgtgcacttgtgctgtaaccacattcccatgggctgctctccagccaatgactgaattggaagcagggatgcctgtcctgggagccatgagctcctctgatgcctgaggttgactcgtggacttccagtagctttgctgaaccttccatagactggaaagcagcctaagatgttttctcgcagacccctctggctccttcaccgttttccttttgcagtagttttcttaataacatccttgcatgtgtaatcctgtgcttatatcagcttctcagagggtccagaccgatataatatctaaagggtagttttatttttgaagggaggtgaattgctgtgttattagtgttgtacccttctatcattcgctatcattcatgtttctttaagatatattcggtaaaatacccatttctcactaatgctggttagagtaggtctttttttttttttttgagacgtaatctccctctgttgtccaggctggagtgcagtggcgccatctcggctcactgcaacttccgcctcctgggttcaagtgattctcctgcctcggcctcctaagtagctgggattacaggtgcccgccgccatgcccggctaatttcttttgtatttttagcagagcggggtttcatcatgttggccaggctggttttgaactcctggcctcaagtaatccgcctgccatggcctcccaaaatgctaggattataggcgtgagccactatgccgggccaggtcttctttcttgaggggagggacaaagtgaaataatgagaactgctctgcaatgtcttcttcagaagagaagctgcccatagaacagagtcccatgtagatgatacagtgatattaaatagaacgttccccacagaagtttaacgcgattagtatcaaggtgacgcttataaatgctaatgcaagaatgccattcaggagtcttgctttatacctaaaaaagcgatgtgttcctgattgtggaatatctttacaggtagaaggcaggtaatagttatatagaaataaaacaaaaataacaatgtataggatacagcctcaaagattcccagaatattagagctacaaggcacgttagagaccatctcctaattttaaatgctcttttgaatattctagtgagagaagctgcagcctgttgagactccacaagactgaagatatgaaaagaggaaatatgcatgaatgcccgcacggagaaccacccccacctgctgctcccgctctaatgatcacgcccattatcaactgggggatggctctgtgccttgtccttgcattacatggaccaagaacacttcacaggactcagagaggtaaatgagagaaacctattcttatagaggatgaaaatgaagcacacagggaggtaaagtgccccaaaatcccatctgaactggctttagaaaccgtatatttactttttcatataatttgtttatctaagggaaaaaaataacagatgtgtttaatggctttagaaacatttaaacaggtggacctcaaaatatgtgaaatgaacatattgccattgtttattataattttccttccttctatttttgcttaaaattcctcaaggcctttggatatgcaaaaaaaaatgagcatttgttttattatgttgcttaatagaaacaattttttaaagtattgatttacgcagtgaccaaaatactgattctaaacaacaaaacatgcagctgttacgaatcctggacgagctctggaaatgtgtggtattgtcttgcaaagaagctgtttttgttctagtcaaatatggaaactagtttagaaacttcattttaatatataattctgatttcagtgttaccagtaaatattaatgtccttttctaacagtcttaatttccttttctcaactcccttgagttatatattttattgaagcattcatttaccatcaagagaaaagaatgacataagcatgtgtgctgaaacgtgcggcttccaggccacagagttaaggaagctacatttgttctcccagccccttacttgtgctatgcatttagaaagaaaactttcgacgtctattgttcttacttttacaatttatgatgtagttaatcctattcaccttgtgtactgaggtaggtcagaatttcttctcacccttttcctcttctaacatgacctgttctttcgcatcatgagtcatagaaatgtaagctaatacataaagtttttgaaaagatgaggaaagagccagagaaataataatgccctgaggttgtgctataaggtatgttccacattggcaagaagtcccttgcttggtagatgtgttcctgtaagccctaaaagaaagggcaggtggctgtcatactccccttatcctccggacacaatcacctgagaccattcactaggccttccaaggggaagcccaggtgaaactgaaggacaacccttctgagatggacagaaaaagaaaaacgtgaaatcttatggtaagggtaaaaggccaaagagacttaggaactgtaaggtagggaggaaagaatgtgggagcccagagagacgggtcctctgtggccgtaacagtagactttcagtggagcgagagagaacatgaggaaactcaggatattctgcaccatggtttggactctaaaaatgtatttgatcatatgatgggtttatagtttttattcttggcctcggtctctgtttttttttcttcttatatgttgtagtgttgggattcactcagatggtggcagaaatattaaagggaaatactagggaaagttatagggaatagtcacaaaccttttggaaggctgaaagtttacatagcttgtaataattgaacaggctgaggcagccggttcttaccttagagcattaggtcttagggtaaatactagggacaacagaggcttccccacttaagtctgtttaccctacctccaataactaacctttgagccagatggcccacttgtggggaggttgactagggatattgtcccctaatggtatttaccttagaccttggtacctgagctttaatcattcctagaactactctcttaaccatgttaattatccacaagtgtgttgactcagagcttctgttgttaattgtataccaaataaatgcctggagtgcgagctgctcagggccagccacagtgacaaaccactcttggtgtgcaggcggtcggacactcagcaggactggcaaagcagaatatctgtgtcagtgtacgttttattcgcctgtcgtttgggtcagggtccatgggcagacccccgcagctaatgccctcaagggtgaggagcaatacctcattatagacttagttgtgaaaagtttttttaaaattaatgagacagtaatcaggtattttaaacaactgaattttacaaaccctcataacattgagtgggaaaaaaatttagatctcagtcaactccttgatcttacacataaagaaactgatgctcaaaatatgaaaagattttcccaagttaatattacacatgatcagtggatatgatactagagccagtctttgatctccaattccagttttcttactataataaggtggatttcttgtgagggaaccaaccggataaagtaaaaaacctacagtttctatgaggatccacatactttcctgacaatggagtaagagaaaatgtggcaagtgaccattgggccctccaggtgtcttagagtggttgacatagttcctgaacaagagtggaaatccagcctggcacggtggctcacgcctgtaatcccagcactttgggaggctgaggcgggcggatcacgaggtcaggagattgagaccatcctggctaacacggtgaaacaccatctctactgaaaatacaaaaaattagccgggcctggtggcgggcacctgtaatcccagttacactcgggaggctgaggcaggagaattgcttgaacccgggaggcagagcttgcaatgagccgagatagtgccactgcactccagcctgggcgacagagtgactctgtctcaaaaaaaaaagagtggaaatctaggtggattcagggatagggaatggtagcaaaaagagagagagaggagagagagggaagagtaaggagcacagaaatagaaagagcatctggtagtgagatgagctggaatctggggagagggacctgtgtccaggcaggcttcttacagagctgtctacttacagagctccacacccacagcgccaggtcagtgatttgtctgtcggtgcgcacccccattctgtgctcttttctgtatcacaggggactggatatctgcaagctacattttccacactgccttctgactggtatttaataagattttgataatgggaggcactggcaagaaatgggaaggtgggagaaagagcaaatccatatttttagtcattgtttttcctggtggtgcccttggcagcagtaaccacagtgacaagtggatgcaagcccgggttccctctaaggtggcacagttccaatggcagcagcagcagcagctgctctgacagctttgtaaccaccagtactcctgggccctggctcttgctgtatcaggagtgtgagctcctggcttcctgtgcagtggcagtggcagtgctcactgcatccggcagtggctaaagaaggactccagcctcctcagcccacagctgcgtggacttggggctacaccattgctctttggggttgtttttggctcatggggtggttgtggcatcctgaagttacgaacagcagttacgaacagcagttcctcaggtaccagtctttggggagcctcatccccttgttgttcctgcctggctttttgtgacgtttaaaaccaatgttcaaatccaatgtgtttggaatgcttagaattggttttgttttcctaactggacacgagagacacaagcactacgcgatccttctacgtcatgctcttaaaaaatatggcaaagttttacattattcatccatttctgctgttcccgtgaaactgacaatatacaaagaccagcgtgtgtggggccctggaatatgtcagtttatatttctattgtgtcagttttcttagggtatatggcgaatataaatatgactattataattaagtggctgtgcattttcatattagaattcattatgttgccttctcagtagaagcactttctatgtagtgcttgagcatataggtaagtcaggtggccacctgcacagtgtgatttgaaggtgtgaaggtatctctctgcctcaaatagcgattaaatttaacaggttcatattctgtagtgaaaaaaatacagttggccctccatatccacgggttctgcatccatggattcaaccaaccaaggataaaaatattttttaaaaattgcatctgcaagttaattataatataatgctcaagaaaattcacaacatgaatgaaatgttacagaagttataaatccattgcatttatcagtagctcatttttgaaaagggtctttggattatagatttccacttcttttacaaagaaacattgaagtgagaattttgtgggtactctttaaacaatagtacatgagtttaatacatattttttaaagccagtaaataacatttttctgtgtccactttaaagtgtgttgggtatataagtgaattggactgtatttctaatatgtgtgtaggtttaattttatatagtttttaaattgttctgtgattaatcggccattgaaaatgacctttttaattgttgagatttactgactagccttatatggaaggatttgtatatcctcaccatatatatatatgtatatatatataaatataaatataaatatatatggtgtatctatatggtgcatatatatagcgtgtgtgtatatatgtatttggtatatctatggtgcatatatttggtatatatatggtgtgtgtatatacacatatacataccatatatacacacacatatatataccatcttttatttgtgtggtgaaaaatactcttttttggtgtaaaaagtttattttctttgctaataatgtcagtttgtaaaaaaaagaattcatccttactgaatatctatagacctttttggtcagtattccctaaacaacgcagtataagaactatttacgtagcattcacattgtattaggtattataagtaatttaaggatgatttaaaatatacaaggggatgtgcataggttatatgcaaatactatgccattttatatcagggtcttgagcatccacggattttgatattagcaggaggtcctggaaccaattccacatggatacagagggacgtctctctctctctttgatattgttatattatatcatattatttatattatatatttatatattggtaatatttatatattagtttaaaggattgttataaaagtggattttaaaccacaacagcaaccaaaatgattatgtgatgttacagaggaatatggttgccatctttttttttttttttttttttgagacagagactcgctctgtcgcccaggctggagtgcggtggcacagtctcggctcactgcaagccccgcctcccaggttcacgccattctcctgcctcagcctcccgagtagctaggactacaggcgcccgccaccacgccggctaattttttatatttttagtagagatggggttttaccgtgttagccaggatggtctcgatctcctgacctcgtgatccgcccaccttggcatcccaaagtgctgggattacaggcgtgagccaccccgcccggcctatggttgctatctttaataaatattatggacataagagagagagagagaatgctgctaggtcacttaaaaatggagatgtgatttatgggaatgttcttgtctacatgtaatgcaacacgtggaatctttataataggtgtcaagaaatttcccattcaggagaattctgtaggtgaaggttcagagggagccatggctagatgctgggcaggggagggttagatgcagcctcactggaggggtcgttttctggaagtgatatctaacatccctccattatctggaagtgatatctaaaatccccaccattatctgaaagtgatatctaacatccacccattatctggaagtgaatatctaactttcccccattatctggaagtgatagctaacatccccccattatctggaagtgaatatctaacttccccccattatctggaagtgatagctaacatccccccattatctggaagtgatatctaacatccccccattatctggaagtgatagctaacatccccccattatccagaagtgaatatctaacatccccccattatctggaagtgttatctaacatcaccccattatctggaagtgatggctaacatctgcccattatctggaagtgatatctaacatccccccattatccggaagtgatatctaacatcccccattatctggaagtgttatctgacatcccccattatccggaagtgaatatctaacatctccccattatctggaagtgttatctaacatcccccccattatctggagtgatatctaacatccccccattatctggaagtgatatctaacatccccccattatctggaagtgatagctaacatccccccattatctggaagtgatagctaacatcccattatctggaagtgaatatctaacatcccccattatctggaagtgttatctaacgtcaccccattatctggaagtgatatctaacatccacccattatctggaagtgatatctaacatcccccccattatctggaagtgatagctaacatccccctattatctggaactgatagctaacatccccccattatctggaagtgatatctaatttccaccattagtgacactcctccatgtttcaaggtatgtatttcaagaaagcccttgttagaataacaggaatttattggggagaatagcacaatgtcttcttttttttgagacagagtttcgctctgtcgcccaggctccggtgcaatggcgtgatcttggctcactgcaacctctgcctcccgggttcaagcgattctcctgcctcagcctcctgagtagctgggactacaggcatgtgtcaccaaccctggctaattttgtatttttagtagagacgggggttctccatgttggtcaggctggtctcgaactcccaatctcaggtgatccgcctgcctcggccacccaaagtgctgggattacaggcgtgagccaccgcgcccggccacaatgtctttatcaatctacacgtaaggaattttctggtaaaatagtgctgggcagattgcaagtgggagcagtgacattgggtttgaacaacaaacttaaaagaaaagaaacaaagaaaagaacacataatctgtaggctgggtttctgtctgtctggttttgggatgcaaagagaagaaaaaatgaggtagtaggcatttagttattttctagcctaagattaaagtgctttttgctcctgcctaactttaggaaagtgaggaaacaacattcacagacaaaggacaattgagcatgagctccaggggaccatcagcaaaacattttcagaagatgtgaagagtaggatgcgtaagtcatggagcagatcagaggcctgtggataaggtaccaaggacaaggaagactctgtcggttgatgatcttgagcagtgctgctaggtcacttcaaaatggagacgtgatttatgggcatgttattgtctacatgtaatcaacacatggaatctttataatacgtatctatatttctatgaattaaagttttcctatggcctatagttaagtgttcttgcgaggtgtgtgagcaggtgcacctatgctgtacatgggggaggatgctagataaagaatattatctactctgtcttacagatcattcccagacggggtggtagaaacataccatacgaatgtaaggaggttcctaaaaatgttcacttgggccataagcaccatacaattgagcaaggttgcacatttatgaagctctacaaagcacaggttggtttagcattatctgctgagccattgggcaataccccgtgaggggcacagagagatgggacaaggcgcacagagggcatctggggagtcaggaaacagcatgaggacagggggcccctgggaatagaaggagacttgttcaagggaagaaactgaaaaacaaaacacaagggagatgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagtatggggagacgatagggaaaatcagggtctctgtgtagttatctgtgtgactcagcatggggagacgatagggaaaatcagggtctctgtgtagttaatctgtgtgactcagcatggggagaccatagggaaaatcagggtctctgtgtagttaatctctgtgactcagcatggggagatgatagggaaaatcagggtctctgtgtagttatctgtgtgactcaccatggggagacgatagggaaaatcagggtctctgtgtagttatctgtgtgactcaacatggggagatgatagggaaaatcggggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgcagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctgtgtgactcagcatggggagatgatagggaaaatcagggtctctgtgtagttaatctgtgtgactcagcatggggagacgatagggaaaatcagggtctctgtgtagttaatctgtgtgactcagcatggggagacgatagggaaaatcagggtctctgtgtagttatctgtgtgactcagcatggggagacgatagggaaaatcagggtctctgtgtagttatctgtgtgactcagcatggggagatgatagggaaaatcagggtctctgtgtagttaatctctgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagatgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggtgagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacaatagggaaaatcagggtctctgtgtagttaatctgtgtgactcagcatggggagacgatagggaaaatcagggtctctgtgtagttaatctgtgtgactcagcatggggagacgatagggaaaatcagtctctgtgtagttatctgtgtgactcagcatggggagacgatagggaaaatcagggtctctgtgcagttatctgtgtgactcagcatacatgggtaccgcatggatagaaaagcatgataaagtttgaaaaagtatttttaagtgttgatgatgatgatgattttgaatgcaaacatactttgattgtgatgatctcttcaattatgatgttgtacaaaaccaaaaaaataaaaaacaaactgatgttcatcttcaatttgaggttaagaaaactcattatattcccagcataccttcttgttgattgaatgattgaagagtaatcagcaaacaacctaatttctaaatccttgacagccataatgataatgtgaatctcacttggagaaattctcatcccaaattgtgttccattgcttcataggaatgtactgaatccgtttcaaagatcaatgaaaataatggcatgctcatatattggatttaaacatcttatatgattgtggttattgtgttttttttttttttaatttctgaaaacaaacaaaaggtcctaggagaaaagtaaacctccgtctcctgtcaagtcccttctcccatacctgcgtctctcattgaaagggtagtacagaattcaggttgggaccaacccgtgtaaccagcagtgataactagtcgctttattcctgaaaactccaggctgtgattacataagcacaggtgaatggggaaaagcaaaagccatggaggaaatccacctgcgctttcttccccctgccagcccagctttcacccaggactgttcttcatgggctgcacgcctcttgccactggtattcttaagcaagtgctgggaagactcgaaagaaaagtgtgagaggagcagcaggcagcgggtttggggaggaatgaaaagcagagatggacaatcctatggttttgccccgaaagaggacagagacttcactttactgagtctgtacaaacatctggaatcaaagccaagagaatgactgcgatctaagcctttctctaggccccaagtttacagcagtttatgctcctagaaagagaataatcactgcatttacccaactaaatatttctgtctatttctcatgaaaagtgaggttaaaggttaatgtaagaccattgcagcccataaatttaggatgactgtataatccttccagctttgaaattgtcataccttttttacttatccaaaatatttctaaaaacaacagaaaggtcttgacaaccttgatgactttatggaatgtgagataaagggcgatatatatacacatcacatatacacacacacatatacgtatatatacacatatatatgtatatatgtgtgcatatatctatacatatatggtgtgtgtacatacatacacaccatatatacacacaggatgtgtatgtgtgtgcgtatatatatattacatctatttacatatatatataacatttcctttgattcaatttgcaggcctcaatcttattctcagaactgatgtcacaacatcgtacaaagccctcataagcatatttgccttccaaggtaactcacagaatacatcttccatttgttattcatatagtcagctctagctgcaattgccatttaccaattcccatctgttagaggtttttcttgtacccgatggcagttgaagcagattgtgaatataaaagaaaatagtttcttggcacagaaaagggatatttgttttaattgacaaggtgtaacatttatgagataaaaatgaattttagacatctcatttatttttatgtcggtctcttcaagacaattattggctcttaggcatacatacagaaacctcaggaaattagggaaaagacagaaaaacaactcttgggaaagtcaattcaagctgatcttaaggctcccagggaaatggcaggtttggagggtggagagaattcaggtgacagtgccaattcttagtgtcttctgtgctaccatgattattttagaaaataaaggagtgctgattttttaaaaagcaatttcctctgctcagcaatgataaataaatcattttgctataaatgagtctagagtcaatgcttcaaatgagaaaaaaagcaatccactatttctccttaagaatgattatatatttgatgagtatctttcttctgataatgatttgtaaaatcttatttcttggtactcccatgagtagtagaatatattgaacagtaaaatgttaaacagtttttgagatgaaggcactgtttctattcaacttatcacaattactgagggtatcaggtatgtactggattgtcatagcttaaagagataccaggacgatgacaaaggaaagttgaagttagctattctgatcagtagaaggacacgcttttccccgcaaaggaaataaaagtgttagtgtcgttctgttgagataattttatcaaatagaaaaaaggaataaaaggaaagtcatctgtgcatttgtaacccagcgattctcattaaatcattataccatgctaacaagagaaaaaagcgtctacaggtggtactccattttcaactgggaaaagagcaggtctaatttgaaataacccaaggctaagggtgctataggatggaaggggaatttttaatcaacactatgggcacacatcaggtgtccccgagggccacgctatgaggaagaacctatgatatgttctatcttcttgtaacagtgctaccctctgggagactacttgcccagggctgggaatttatctttggagttagtttaggactcagggtgaaaaggaggagcagtaggaagtgaggctattggaaagcttctgtaaaaagtggccccttcattattattccatattctgactaagcagagaaatgaacctgtagtttcatccatattttcaaaagcaaaacttcttctactaaaataacttgctacaaaaggtatgtactagtttgggattttgtttttttctgtcagtttgataaatgctgtttggactctcataatccccctaataattgactggggtcagagtatctctagggcgatgctgcacattttaaaaccgcttcacggggtgctggtattcagagaatgctcttgaagatctgtttcccattgacttttcaaatcctgttaattgcttatacagtaagcgttaaaagtcaggcctggcaaaatcaaggaagctgcagggagcagatgaagttttcatgcgcaggagcacagctaggatgaaacgagaagtaactgccgtgtccagtgtggcccaggtggagagctgggggtgtgccatgagactgttaggtccagaggaagtacgctcgattcgcttgatctcgggggtaactgaagagatagcagctctctctagaagtccttttctgaaactattgagacctctgacacttcaaatccttaaacgcaggaaaaactaccaattgattagaatgcccttgagaagattgaagtatgagatggtgttggactagtggtcatttgtttcaatctcaagattctgtatttcctattctgaaatttctatttattataaatcttataatctttaaaattctatttttctaagtctgagatgtggttgaatttcagtttataagaagaaataaggcatatgtgaattcccttaacaaatcacacagttcaattcctgatagttgttacctaacgtttataatgtttctttttatcaaatgatcttcaatattccctgccatgaaatggaagattagtgaattttttactaaattattttggccttaaagtctgttctgccaaattgaaatacttggacagaactaacttttgctgtacaaagtggacagttagccatggagtgagctattgagaagaaagaatattttctgagcagaaaactcattcttctttttctaatagctgtattaggagattgaattggggccactatgctctttctcttgggcaggaaacatgtactttttttgcagtcagtaatgttttcatagctgttatctgacccttacactgagcagaagagtttctgggacagtttctttaagtttacaaataatcagccatgtataggcttaaaaaataaataaagatttctcatccatatgaatgagtggagcaaataaattagatgagggaagctggatcacaatcttgagaggaaacaagaggaaaattcagaaaacatttcacctatacctggttctgttaataccttgccactaccatattatggatgcaggctgaatacatgttttcagaggttagcactgcagccaagcaagcaagcatactgttaatctgatatatataaggacacacataacttacaatatagtaaagcaaataggcttgaatggcattgcagttcacacacactgccatggtgttgctattcaacttctgaaacataattttagttttgtcctcttgcctcccttgccttgctatagtgatttagctttaaaaatgcaagcctgcacctgtcatttccctgctaagcatctctattggcccccatgtcctcaaggatgcagaccaagtccattccagaacagcttccatgctccagtcctacccacctcagtagccctatcactcttcttactttctgctccaaccacaatacaattctagtggttgatcaaaatgtttctttttctttttttttttttgagagggagttttgctcttgttgcccaggctggagtgcaatggcgccatctcggctcactgcaacctctgcctcctaggtacaagggattctcctgtctcagcctcccaagtagctcagattacaggcatgcaccaccacgcccagctaatttttttgtatttagtggagatggggtttcaccatgttagtcaggctggttacgaactcctgaccttaggtgatccacccgcctcagcctcccaaagtgctgggattataggcatgtgccaccttgcccggcctcaaaatgtgtcttgatacaaagatttcccctacactgtaatgttcctctaatcctccctctcataacagctacttatccctcgggtttcatcttaaactttacatttagggagaaccttcccccacagagcagacatatcaggtcccctgtgtattctctaatggcagtcttgtatttctttgtaacaaaaattgaatttatttaacatatgactttcctaccattaagtcttttacttgaacgagggcaggtattcagtaaatgtttcttgaataaataaatgcatggtagttctttatcatttattatcattggtctagtcacagactcagaagcagttggagatactagtatgattgaatttctctatttttagtttctttcaaatacttgcacacacacagacacacacacacacacacacagacacacacacacacacacacacacacagcttccttgcagtttcccagaaatacaattccagagccacaggtccctcatctcacaacttgtccccatgttctcatttgtccctctgatcttacttgtcagcccttcccagcacctggggatcgtgcattgtgaagcagcacactcaggggttccctgctccgtgtttccctccctaatgccaaagggccaggagccattgtgtcgcagagtaggctgcttcacttgtgcctgagggaggacagacaatatgctcatcaggattcagggaggagagtgtggacgctcagacagaggagtgctgtctttgtttctcgctgctatatcagaatgccacagactgggtaatttataataaacagaaatttgcttcctcacagttctgaaggctgagaaggtcaggatttaggggccagcatctggtgaggggcttctcactgcattcttccacggtgccaggtggcagtgcaagaaagcacataagacacacagcaagaggaggctgaactcacttttataacaaacccactcaccccataatgaatttactcctgtgttcaacacataaacttttggagacacattcaaaccataacatgtactattgaaatggagctctgacaggagacaccttgggtgcctcaagctggagattctgctttgcatccccagttaataattagtagataaaagaaagagactctttgggcactgggacctggggtctatgaatgttgaaaaggaagagcaaaccatgacatcaggacttgagtttctcacacccctttctcccacccccacccaggcaaaaatagatacaaaagaagaaggaattacagaagaagtcacataacattattgcctacaactgactgtttaccttgaatacttgaagaccagaatgaagattcttggggtgaagaattacagccttagcatggagcaggcctcggtgcatcggctttcagctaggcatgcctgccaatgttcaacgtcctcctgggatacggaaggcaccgtgatagacatctgggcaagtcaacaggaaggtggatatccaaatctctctcttcgcaatgagtttccagttagatggaggagagagtaataaaacacagtaagtgtggaaaagattaaaatgcatgttgtgatataccacaggaaatcagaggagagaggttcattctaaggggaatggtggaaacgtcagtgagaacataccacctgggtggttcttgtaagatgatgtggaagagaaaaggtaaagattgagcaaaacagtgcatgagcgaaggatgcaatgtgagatggtctgaacagtttaaaagaataacctgggccaggcacggtggctcactcctgtaatcccagcactttgggaagccaaggcgggtggatcccgaggtcaggagttcgagaccatcctggctaacacggtgaaaccccgtctctactaaaaatacaaaaaattagccgggcgtggtggcgtgtgcttgtagtcccagctacttgggaggctgaggcaggagaatcgcttgaacctgggaggtggaggttgcagtgagccgagatcgcgccactgcactccagcctgggcgacagagactgactccctctcaaaagaaaaaaaaaaaaaaagcataagccgagggaatgaaagtactttctgtggctggagcacaggatgtctagacagaagaatttggaaagaaacagaggatactagatttggaacagatcattcaggtcctcaagaccttgaaaataaggctacagtttttaatattattatactgcaggccattgaagataatgcacttgttttgtattgtttttgtttttcagaagacagagtattaacttttttttcaggttgtagaattcatcaattccataaccatttttgaatgagtattacaggtcaaggacttttctaaaaagatggatatggtctcttctgtcatgggtcttacattctgtgggaggagacaagcaataactacatacaatgagcacaataattgaagtgattatgtgggaattaaaggggtgggctattgacaacttcagacaccatggtaattaatggccttcgatttgtaacaggagctgagattcctgacttcacagatccctgaggagatgtttactaaagggaatcttctggtcactgttaccttcctccgtacttacctgcctcatggagtaagcatgacaaaattcttgattacatagggaaaatcacatcttcgattaatactttcctgtttttattcttcattactacttgcatgatattcacataatcttttctcttctcctgcttcctccgtgcaataagctgctcaggcagcctttgctcttaagagcttgtttgtatctgagaacgagttaaggctttacactggtagtaagtttaagtcatgccaaaaaggggtagaatacctgattctcctagtttcaagacaagccaggttttttttgtttgtttgttttttaaaaaagcagaaactttcattgctctctctcatctgaaactagatgaggctatctactctgagtggccaggtcttctgtaatttgtaactgaaatgcaggttacttgctcactgcacgtacagttcagttaacgagggaaatctgatccaaaataagtgaatttattccgaagttagcttgggggaaggggcacaaagcatcccgcctttgaatgtgccgcttctcctctgttgcaaaaagtgggcattttcatagggtaagggaggacatgagcaagggcaggggtcccactgcttctggtcagttacctaccaggcagttgagttggcaccttcctgtgcagagttcagttgtaaaagtagccaagtggtcatgctttcgatgtgctgtcctggtgcgtatgagttcctaggtcacccctggaggatggcagttccgaggcacgcccctggaggtgagagttccatggggacatgctttggtctgtaaatccaccgtcagctctggaggagagacctgtcttggagcacgaagttagaggaacttgctgtgtaggcaatgtcctgtgagggagaggtgagagattatatttgcatttcagcagagctaagcagaaagcagagagccagggaaaggagaaaacagagtgagagggaaaaatataattaaaccacccgtagaaaaatagggagaactgggggccggggcggtggctcacgcctgtaatcccagcacttcgggaggccaaggccgacggatcatgaggtcaggagttcgagagcaggctggccaacatggtgaaaccctgtctctactaaaaatacaaaaattagctgggtgtggcagcaggcgcctgtaatcccaactactcgggaggctgaggcaggagaatcgcttgaacccgggaggtggaggttgcagtgagctgagatcgtgccactgtgctccagcctgggcaacaagagcaaaactccatcttaaaaaacaaaagaaaaaagaaaaagaaaaatggggtacttggttacattttaagaacctaaaaatctagaatttcatgcaaaactcataattttcaagttggtaattaattttcaaatgtaaacatattgtggctcgcaaagaacaataagatcaatcaaccaataaaggcaaaaatagagagtaaggaagaatccacactaagaagcgtgaagacttgattagagacataagccaaagaaaggagatgtgttcagtgtttactgccatgtgccaagcaggggcgggtgaagacaatggcaatgtgaacagctaggaggaaggcaatatctggtaaattagagccgatgacatatgagtccaaaggagaaaagaggacgctgaacccaagcttgatgattgggagaatggtggtcccgtgacttgtcccaccgaagccaaagaaagaacagatctaagggatggtgatctttgagcaagctcgtttccctcacacgttccagcgctgtttcacgccaggctctgggattgaatgatatccctggatcaggttcactggcgtcccctgctggcacagagcagcacaaagacttcgaaactggatacgctgataaatttatgaaatctccacaaactagagaacacgggctaggtgcggtggctcacacctgtaatcccagcactttgggaagccgaggcgggtggatcacgaggtcatgagatcgagaccagcctggccaacatagtgaaaccccatctctactaaaaatacaaaaaattagctgggcatggtggcgggcgcctgtagtcccagctacttgggaggctgaggcaggagaatcgcttgaagcccggaggcggagcttgcagtgaccagagatcactccactgcactccatcctaggcgacacggtgagactctgtctcaaaaaaaaacaaacacaaaaacactagagaacatgttattaaataatagaaagaaagaatgcccatctgataaaggtacaaaactgaccttaaaatgacttagcactggaaagaaaaaaaaaagaggctacaaatttttggttactgaagagccttttaaataagattatattaaaacagtgggtagatctctccaaagcagaataagaaaacccctaatcttcctcctaactaaatgattatatgatttgatgagtgaggattaagttctgcttttaaatataattgctgggtaatatgaatataaaccaaatatgtaaaatttaagatacaaagatcaatattcccaattctataaaatttgtgtcaactaattgtagataataaaatattttatgtattttttagaagaagataataggcataacaactattgtgaaattatccaaatttgtactcttagttgccaattttcagttctttagaaagtgcaattattcttagcagtgagaaacatgagtctcacagaatacatttaagtcttcactttgatttacaacctccagtgttaattaaacaaatgccaactatgctaatagtctggaaatcctttgacaaatactgaaagaaatgacaggtctggcacatacacatatagatggaggcttgcctgatttttaagaggcgttttacagatttggccttataatacttattctataactattcattttatcctggaaaatgttgtctataaagttttggagagaaattgctctgtagaacaaattgacatttcacaggaataagtccactattgctaagaaaaatggtactggggatggagccccaaaatggcagaggcaaacacagccctatcaacctctcccatccccctgtgtacacattagtatagacttagtctgtctttaggaacaacatttttactgacctgctttctaagttgttggtccctcctcttccctgggatctacatatcagggtagtttcataattctctgttgtctcagttacgtgttaaaagtaagcatgttcactgagtgatgattttactttttaaacaacctcatcttttaccgtaccatcagttatattaaatatgacatttaaggttttaaaagtggagttagaaagctacatactgagaggtgaagccaggcgggcttctgactcatgtggggacttggagaacttttctgtctagctggaggattataaacgcaccaatcagcactctgtgtctagctaaaggtttgtaaatgcaccaatcagcactctgtaaaaacggaccaatcagcactctgtaaaatggaccaatcagtgctctgtaaaatggaccaatcaccgctctgtaaaatgggccaatcagcaggacgtgggtggggccaaataagggaataaaagctggccaccagagccaacagtagcaaccggtttgggtacctttccctatgaaagctttctttcacttttcacaataagtcgtgggtgcttctcactctttgggtctgcactacctttatgagctgtaacgttcgtggcgagagtcggtggcttcattcttgaagtcagccagaccaagaacccaccagaaggaataaattccagacacaatacaatatgttgggtgagcagatcatggcacttatgtcaggaaagcttgtgtttaatcctgggtgtgccatttactaagtgtgtgattagttgtattatatatacatacacacacacgtattttttgagacagagtctcgctctggcacccaggctggaatgctgtggtgcaatctcggctcactgcaacctccgcctcccaggttcaagcgattctcctgcctcagcttcccgagtagctggggctgcaggcatgagccaccatatccagcttttttttttttttttttttttttggatttttagtagtgacagggttttgccacattggccaggctggtctcgaactcctgacctcagacgatctgcccacctcagcctcccaaagtgctgggattatagccataggccactgcacccagccgtatcttttaattttaatacccaaatgtattatcaagctaataaatttgaataaaaacaaaatagtaaagctaatataaatattaaactttttacacaaagaattggttctttaaaaaggttagcaaaattgagaaatctttgctagaatgatttaggaagaaagaagactcaactgaaaatcagaagtgaaagaagagacattactaccaattttgcagaaataaaaaggattgtaaaagagtactgtgaacaattgtataccaacaaactgaacatcttaggtgagatggacaaattcctagaaacacacaaatggccaagattgaatcacgaagaatcagaatatctcaagagacttacagtaaggagattaactctgtaataaccccccagcaaagaaaagctaagggctagatgacttcactggataattgtagcaaacatttaaagaacaattaaaacaaatctttctcaaactcttaataaaaagcaaagtggagggagtactgccaaactcaatctacgagaccagatttaccctgataccaaaatcagacaagtatactatgagaaaagaaagtacagaccaatatccctgattaatactgatgcagaaatcctcaagaaaatactagcaatcagaactcacaagacattaaaagaattttacatcatggcaaagtgggctttagtcctagaatgcaagaatggtaaatatatgaaaatcaaagtaatgccctacattcacagaatgaaggacaaaaaccatgtgatgatctcaactgatgcagaaagaaaaaatttgacaagatgctctattacaaaacactcaacaactagtaatagaaggaaacttcgtcaacacagtaaaggccaaatataaacacccagaactaacatcgtactcaatggttaaagactgaatggtctccctctaagatcaagaggagcaagacaaggatgctctctttcaccgtttctgttctacttagtgttagaagtcctacctggagtaattaggtaagaaaaagcaataaaagtcatccacatgagaaaggaagaagtaaatttatatctgttcacagatcacataatcttatgtgtagaaaaccataactattacataaaaatgaattcagcaaagttgcagaattcaaaatcaacacacaaaaatcaattgcatttctgtgtattaatgatgagcaacccaaaggaaattaagaaaacaattcaatttacaatagcattaaaaagaataaaacacttaagaacaaacttaaccactgaggcaaaagacttgtactctgaaaactataaaagaaatatatacataagtggaaagacatcgatattcatgaattagaagacttatattgttaagatagtagtgttccccaaaatgatctacagattcaatgcaatccctatcaaaatctcgaccttttttgcagacatggaaaaattcattgttaaattcaaatggaaattaaaggaatctatgatagccaaaataatcttgaaatagaaaaacaaggttagaggtctcgtacttcatgatttaaaaactcactgcaaagctacagtaatcaaaacagtggttattgtcataaagacaagagtatagaccaacaaaatggaatagagagcctagaaataaaccttcacatacatggtcaaatgatttcaacaagggtgccaagaatattcaatagggaaagggcagtcttttcaaccagtggtcctgagaaaacaagataaccacatgcaaaagagttaagttgaaccattaccatagactatatacaaaaagttaactaaaaatggatcaaagacctaacccataagagttaaaactataaaactcttaaacaaaaatataaggggaaagcttcatgtcactggatttggcattgattatttggatatgacaataaaagcatagataacgaagaaaaataagtaaattggactacaccaaagttaaaaacttctgtgcaaaacaggctataatcaacagagtgaaaaggcaacccataaaatgggaaacatttgcaaataatataactgattagagttattcagaatatataaagaactcttacaactcacacacacacacacacacacacgaaacccaattaaaccattgacaaaagccttgaatagacatctctacaaaaaagatacacacatagctaataagcacatgaagagatgcttgataccactaattgttagagaaatggaagtcaaaaccctgactggcaaaacactgtgacaccacttgatacccattaggattgctactattaaaaaaaaatcagaaaataacaagcattggcaaggatgtggataaactggaaaacttttgcatttttggtgggagataaaatggtgcagccactatggaaaacagtatggtggttactcaaaaaattaaaaatagaattaccatatggtgcagtgatttcacttctgggtatatatcaaaaataattaaaatgaagcacttgtacagatatttttgcacttatgttcataagcagcattactaacaatagtcaaaaggtggaagtaagccaagtgttcattgctggcggaataaacaaactatgacatttacttacaataaaatatttttcagccttaaaatggaaggaaattctgacacatgctacaactgtaggtcattatgttgagtgaaataagccagtcataaaaggataaatactgtatgattctgaaacagaccgaatagtcccattttttaaaaaaaattttgatgaacatagaaattgacccctttggtattaaagtttgaaacttatatttgttttttctgagttccttcttcaggaaatgaccttcaggcctctcaaaaaaaagtattaaagaactgaaactcacccagttaccacatccagacaatgagatgccagacccctcattcatcatgatggcttccttgcccctcactagttcctgtttccttacacattgttacattccttccctgctatataaactcctagttgtagttggtcagagagatggatttgagactgagttcctgtctcctcggctgcagcacccgattaaagccttcttccttggcaatactcattgtctcagttcttggctttctgtgcagccagtagaagaacctagactgaactcctggtgtttcactaatcatcccacttacacagtgtacttagagtagtcacattcatagagacagaaaatagaatgggggttgtcagcagctggtggaaaggcaatggtgagttcttgtttaatggttagagtttcagttttacaagattgaaagggttctggatatggatattgatgacggttgcacaacaatgtaatgatgttcactgaagtgtacttttagaaatgttaggatgataatttatataacttttttttttttttgagatggagtctctgtcacccaggctggagtgaagtggtgccatcttggctcactgcaacccccacctcctgggtcaagagattctcctgcctcagcttcccaagtagctaggattacaggctaccacctgtgtgattacgggccaccatgcctggctaatttttgtatttttagttcgagatggggtttcaccatgttggccaggctgatcttgaactcctgacatcatgatccacccgccttggcctccaaagtgctgggattacaggcatgaggcactgcgcctggcttataacattttttttttttttttgagacagagtctcactctgtcgcctagactggagtgcagtggtgcgatctcagctcactgcaacctctgcatcccgggtgcaagtgattctcctgcctcagcctcccaagtagctgggactacaggcacctgccaccacatctggctaatttttgtatttttagtaaaggcgaggtttcatcattttgcccaggctgttctcaaactcctgacctcagataacttatgtaacttttatataggtatattttatcacacttaaaaatattaacacatcttaagaaattcagccaacccaaattgctgagatggcatggaggtatggaaagagcttttcaagctagaaagacctaagtttgaaatgagacctaagttctactacgttctaatgctatgacctcagagatgtcatagagtcacgttgacactcagcttcctcatattatgcgatgaccacttatagaggcatgatgaagagtaattgagattatgttatttacagtctctggcacagcctgtggctctccacaggtacactgcaatgaatcttcctttgcattttcctcaggtaatagtaaggtgtaattgactacaaataggtctctatgctttaaatgtaaatattaatttcacttagatgatctaattcagtttttacagcatgctatggtttacacaatcctttatatagtattttattttcctaacttttgaggtaagcattacgaattatattttaacaatggatgatctgaatataaaagagattacaggatttgattaagatcatatattgctgtgattcaacaccatattttcttaattcaatttcatcgttatttatatggtacaattaggaaaggaaaaagtaatccaagccctatattaaaccatacctgttgctgagtgtcttcaaaatcattttattttccttcctaagataaaaaaaaaatgatagaatcctacgtgcttgtctgatgattcgtaacttgaagtcagggattagatctcctctgtttcttagttttattctatagcccatgaatatattaagcattcaatagacatttgttgaattaaaatggtataaactattgatctgaaatactgcatttgaagcttggtacttcatgcattttgttcatatcatttatgtactaaattcaactttttttttattttgcatcctgattgtgttttcataaacatttattctaatgctaaaatttaatatcaataaattatatcttggagaaataatttaacaaactcatatttgcttggtgtgattatcaagactgcagaaactttggcaatataacataatggggaaaaaattggacaggaatcagaactaaccttcattatgggttcctggaatagctccaatctattcaagtaccctggagccaaacatttaaatgctccctgcctggatttctgcatttccccaatggagatgataatatttatctggcctacgttgtaagcttcctttttctacaccatgatactcagtatgacatagaggttcaaatcacttactattttcataaccataggcaaacctcttcacacttccatctgtaaagctgcctaataatagtatctgtgttctagtttatcatgaggattaaacgagtgaatatttatgaagcgtgtaaaacagtatttggcacatatgcaaatgttggttaaattttatgtgcataagtgtgtgtgcgcactttgaaaagtataaaaatatatttataatatcaggtcaattaatattttttctctctaaatgctactctagttatgtatatgcacttcaagtacttgacttttagttttctcatctgaaaaattgcattatcttttatttaacttatatttttgatcattaaatgctcttaagtactccatgctcagtaagacagataaatggagaaatctagcatgaagttagaaattaagaaggcatattgtttctataaaaaagaacaattttaacgaggaaagacagaaaacaagaaacataccattgaggccaactggtttataaggtgttgttactcagtcccagattttaaggtgcaattctcacatatgaattttcatagaggcctttgaagaagagaacaaagtctatgaaaatgcagccagtaaaagatcctccccttccttgaactacacccaacctgacttcagatgcaggttgcctttacttggggacgtgtgtggccgagaggcaagaggggtttcccttgagtagaatagaacttaaagagccaacagcagactcctcagatgctagtaacttgccaccagtagcgtacactgtgtccaacacgcagaggcaggtttgagtggaattcccagatagcttgtgatcaaagactggtcgccagtgaagaagacttgggatggatggatggatgggtggatggatgggtggataaatggatgaatttaacattgaggtataatttgcttaacagtaaaatgttcagtttaataagtttaggccaattaatattaattttgattaatctcaaattgtcttgctatcgagtgtttttttaagacagcaccaagtgtaaaggaaaatcttgagatcattatgccaaagacaaattgactccataagattagtccaaattatcaagtatattccatcattttgaatactcataaaacatattttgatttttattattttaagtgaatatttggtgatttcaaataagcaaacccaaattcaagaactttcactgtgcagaaatttccaaagtcaaaaccaaatagcgagtgtgataagttatactcattagacagcaatagagaggccccctgtaatggaatatggggtgactgtgaggatgctgaagaaaaaatggccatgattttttatctaaaggtgtgcttagtaaagtaggaatagaaaataaagacaaatatgcaactccaggagttatgagaatgtattcgggacgtattttgaaaacaaacccaactgctaaaattgagtcgacccagaaaagaattaagctgagatatctcttagtgatactttcacatccagatttacgcttagattcatgatgcattacaactaataaaattgtttaagtatgagaaagagcagaccaaggggccatgaagaaaatataattaaatgcagattaaaggggcagggcttctggtttggcagacacttacacttcaaagactggaacattctctttaataatacctcagttatctaataaaaatgatcatttggaaatcatgctggtcacttctgtctagctcaagtgtcaatgttctggatatactgggtactttattcacactgaattgcttttatacatcgagaaaggtgttaactcttactcttcttaaaatggactgtggtaattaattctgatgcctggaagcaaataagtaaatctttgaaatattcattttatttatacagacttagatatctactttttaggaaaatcacacttaaatacccctttcacttttgtacatatttgacacagtttggtatcaactgttactcggattatatagaaatattttgttgcaatgaatttatccaatttccttaaaggaagaagcaacaatggattatttcaaggagaacattatgtaatagtccatgctaatgaactgttaaaaaaatattattgacacaggcatgttaatagcagtgtgggttttggtaatcagctaacataattagtccagaattatatggactttttaagtaataaaatttactggaaacttaaatgtaattaattaaaagtttggtttagttataaatatgattaaagcatttttctctaattttttttttttttttgagacagagtctcgctctgtcgcccaggctggagtgcagtggccctatctcagctcactgcaagctccgcctcccgggttcacgccatgctcctgcctcagcctcctgagtagctgggactacaggcgcccgccactatgcccggctaatttttggtatttttagtagagacggggtttcaccgtgttagccaagatggtctcgatcttctgacctcgtgatccgcccacctcggcctccaaaagtgctgggattacaggcgcgagctaccgcgcccagcccatttttctctaatttatacttaaatttgcattattatttgcaaaacgtaccaaaatttggacatttaagcatcatttattctgaaaaaagtataagacatagtaaataacataccaatatgggacatgggagataaaaattgatcacccagtagataaagggaaaagctctttcagaaaaaaaaagtaaatttaattggcatataatcagaatatgtatgagcattttggagttcttgttttcttgttaactaaggtagaattttacaggtttgtagaccaaggcttcatctccatgaatgtggccccatgattaagatggcttggggtcagacagactcagtcctgctgtttgttagttgtgtaacatcagacatgctcaaagcctcaacttactcattttggggaaataataataattattaagactggtgagggccagctcggtggctcacgcctgtaatcccagcactttgggaggccgaggcgggtggatcacgaggtcaggagatcgagaccatcctggctaacaccgtgaaaccccgtctctactacaaatacaaaaaattagccgggcgtggtggcgggcgccggtagtcccagctactcgggaggctgaggcgggagaatggcgggaacccgggaggcggagcttgcagtgagccgagatcgcgcccctgcacttcagccccgggggacagagcgagactccatctcagaaaacaaacaaacaaacaaacaaaaaaactggtgagggttataataaatatatgtgaattaaataaaaatgtgttttaaatgtcatcaattgttttatatttcttaataaatttctcttttgtcaatttcattattcagcaaacgcagaaacttaagattttctgctgtttgtagtaatgtagtatatttcatcatatggcaagtgctaccagagagaagtaggattattatttattgtggtttttgcaaaaccagaggcccatgccaggagttttattcagcacggctcctctttgattcctgtcacacctagacacaatgaaggtgatttgcaaaaaagtagaagaaataaaagaaaaacaaaacaaaaactcttcttgccaagatttctaaagtaatgaagaaataacgtcacttgtaaaaggggtttctaaaattacctatctggaacagaagaaagcaagagtccggtacccctatcaaatcaattggtttaacatgttttcccttttaaagtaaaataataatttaaataataaatacacatttttatttatataatgccatttttaatatagtatcatttttctactgggattttatagtttaatagacgttcatcattagtgtgctgtttcaaatcctggccctgctctatattttttggttggtttgtttggatattattaccataaaaacaaaaacaggcttgcaatggctgcagattcacagaagattattagaaataaaagtttattgttaaatattttgtcatagcaaaatatatttttctttaagagaaaaaagtttttatctaaatattatcaaatttattactttcatcacttacgtaagttaaccagttcatatgcatctgtatgtctcagtagagaccaccaacttcaacattaatgtgttttattttctcaaagttggacttcagacaaaaattataaaactggaagatagtaatatttaaggatgccttcctaaaattatcttaagtacatcgaatatttccaaaaaatgtttttcctctgagagtttcctatgctggtaagaaatattttgggaacagaatagacaaggattaagtgaaaaataaatgtccctttttactcttattccagttctcagaggaaacagtttcttgcacggacttccagttattttctatacataggaagtatattatatataacaatataaaatttatcatgaatgaactactctatacacactctgacagttactttttaagttaaacaatatctcgagtgtctcacatatctatactctcacaagtattacatatatattacatacatacttgcctaattagtttttggtgacaatatattgtattattatatgaatgtactataatttttaatagcaagtctctttgcaagtgtagctccagcttctattaggagtgaaatccctggataaaatataacttgtctccaaagctgattctccaaaactgtttcaatttccattcccgcatggtaatatcaatagaataattgcccattgtcccacaacctgtttaacatggtcacacagcgggattctgactttgccaaatggctcacttcaataagcttaatgaatgtttaaatgaatgaatgtcaatttatgaatgaggattaccatcttctcatacacgactactgaatgtatctcactttctgaatgggaatcatcttctcatatactaccacttttttttttttgaaacagggtttcactctgttgcccatgctagagtgcaatggcatgatcatagcccgctgcagccttgaactcctgggctcaagctaccctcccacctcagcctcctgagtagctaggactacaggtgtgaaccaccatgcccagctaatcgtgtgtttgtttgtttgtttgtttgtttgttttagagaacaccaggctggtctcgaactcttgggctcaagtgatcctcctgcctcagcttcccaaagtgctgggaatcaggcatgagccactgtgcccacccttatactaccttttttttttttttttttttttttgagacggagtctcactctgttacccaggctggagtgcagtggtgcaatctcttctgactgcaacctccacctcctgggctcaagcgattctcctgcctagcctcccgagtagcctggattaagggcgtgcaccaccacgcctggctaatttttgtatttttttatagtagagacggggtttcaccatgttggccaggatagttttgaacacctgacctcaaatgatctgcccgcctcggcttcccaaagtgctgggattataggtgtgagccagtgtgcccagcccccttatactacttttatatgtcttgcctggttttttcttctgaccagatttataattaaataactggttttttttcttactgactttcatgaaattttaatttatcaggaaattagttctgttgttaatttatgttgtacatatttactctaatttatctctcttaaaatgttttgttttttggccagacgtggtgggtcatgcctgtaatcccagcaatttgggatcacctgaggtcaggagttcaagaccagcctggccaacatggcaaaaccccatctctgctaaaaacaaaaattagctgggtgtaatggtgcgcacctgtaatcccagctactcgggcggctgaggcagagcaatcgtttgaacccgggaggtggaggttgcagtgagctgagacctcaccactgcactccagcctgggtgacagagcaagaccctgtctcaaaaaaaaaaaaagttttattttttaatatatacatactttagtgggacataagaatgatttagggcacttcaatttgggtctattttttctttcttttattatactttaagttctgggatacatgtgcaagacgtgcaggtttgttacaaaataggtatacatgtgccatggtggtatgctgcactcatcaacccgtcatctacattaggtatttctcctaatgctatccctcccctagtcccccagcttctgacaggccccagtgtgtgatgttcccctccctgtgtccatgtgttctcattgttcagctcccacttatgagtgaatatgtggtgtttggttttctgttcctgtgttagtgtgctgagaatgatggtgtccagcttcatccatgtccctgcagaggacatgaactcatccttttgtatggctgcacagtattccctggtgtatatgtgccacgttttcttgatccagtctgtcagtgatgggcacagccacttgggcctgttttctagggacacgtctctctgcagatggttacagcctccttcggtttgcgcagatcgccctcagacgaaatgtcagcatgtctctcaatgaagctctttaatccacagtcgttttgttttcagctcagttgtttctggtcggtgcaaagctgactgcagtttttcttctcttttcaatgtttgtaacttttcttctctgtgcttgacctctaaattaggatttgtgttgaagtaaagaattgtaataacctgcagagtcacccttaaatctggataccccctctttctctttctctctcagaatggagtactccagagcaatgttctccacttctcccacggcattatcgcacccctaagtctctcttctaactaggatattcttctctgggttctcaggtccctggaggtctcagggacattgatgccatgttcagggtctaaaaggtaaggtttttgtgctttgtacttcttcagtttggcccagatgtccttgtattcgtgagatatttttcacagtgattcctacagtattttaagatcagttctctcacctgtttttactctttttgtctacataggggatatcagagacaggatataaatagtaatattttattctttcaggaagctataaatgtatttagattattacaatttgtacagactctaagcagaaatataatcacatcatttatgatatttatcttcataaatagatatttgaattggcttccaaaatgaccttagagatgtacttacttaatgatggtggccttgatctttttgtgattagataatagcccagcatgtggccacagtagcagaaacacacagtatgtgctggttaattggctctactcgcttcatgcattattacagcttatctgctgcttgtggactggtacatgttgagcttctcaataatcaaagaagaaatcaggtgccaggtcacaatccagacccaagaagtgtctgcttttctgttttccacatgaagtcatcatttagcattcttttcttctttttcaatggtggagaagcctctggtatgtaaaacatgagtaaagttcaaatagggtcaaattccggaaggcagcacagaacttttcctcctagccgtgttactttggccgtacatccttctatcatcccatgcagctgggaatgggggctgccattttcattttgatcaaccattcctcaaaagggcatttagagagtcattagggtctagagtcatgaaatgagtagaataacagaaggtagcatgtcagaagaccatgggcagcccccaggctgtatttgcagtccccgttctgcataatgtgtccagttggtatgtaatgatgcacgcacagaagagaaccaaacactcaaatgttttggctataatcaaaattataccttgagtttcaatgtacttatgtctttgaaaatggtattttaaggaccagaaatgtacacagtgttctgtgttttcaatacacaaaaataaaccttatgcacgtaagtgtaggcctcactgctgggctgtattccttcctaccacggaccctgtaaatactgtagaactatccaaacaacatctaaacttcagatgtaaaattcctaactcctaatattacaaacattcaactattttgatggaaaaaataggaagcatgacaatcatttataagagaaagaaaatatatttctcaatgaacacagattccttgacatggacactttcctgcagcttccgaagacaccagcagtggaaggttatactattcatcgatggccagggctggttgcaggagatattatgatgctttgaaggttgtcctggtcatctttataaaatatatgtcaaccacacctgctgaggctacagagcactgacagagggtaagagactagagaaggaaaagctttgataagatagctgaagataatcagaaaagatggtaactaatcaaataaacatcctcttgcgtgcacaatgtcaggaatgcagctctggaaacaatgcctttgtcagagcactgttagccgtagggtgtgtgccttcctcctcttgtgcttagtgtttggagaatttttgttcgtttgtttgagacagagtctcactctgtcgcccaggctggagtgcaatggcgcaatctcggctcactgcaacctccacctcccgggttcaagcaattctccgcctcagcctcctgaggagctgggactacaggtgcccaccaccatgcctgcctaatttttttgtattgttagtagagttggggtttcgccatcttggccaggctggtcttgaattcctgacctcgtgatccaccctccttgggctcccaaagtggtgggataacaggtgtcagccactgtgcccagcctgagaattttaaaaagaagtagaaaagtgctattcttgattaagcagctgtcatatcagacactggagaatgtggcccaagctcacatggttcatttctgcaacagctcttgcaatctatacattgttgtcaccactctatggggaatcaatgagaatggtggcagaaaagtactctgctgaatggtgaggcagatataaatctggcctaagtgaaacaaaaaactctccatttttaactacactttactggctccaggactggacattttcaggggtagtatagggaaggactaaggatatcgagggttcttggatgaaataatacatagattgttggtcctggctgagtgcagaaacaagggaaaacagcagggcttgaaagcttaggagaaaatggagggaggcaagaggttggaggacttagtggattcatggagaacaaatagaaatacggaagttagaaggagagtgataagaggcaaggcaaagtaggtgatgaaattacccaaagtatgactctgggattgggttgctgaagaagagataataaattctttaaagtaagtaagagtggtgaagtgcttatcccatgtgacttattagagacagaatctgaaatataatttgggtttacattatgaaatttagtgcattatgccataagaatgctgtgtctcctaatccattatgttcgttaaggtggagctttacatgtgtcttgatatctgagtataatcttttgcaataaattacagaagttgtctcatcactaatttggggtgtgctgattttgtttctaagtttataaaatgaaagtcttgatttttgttggttaaatattttgaaaaattgcagttcaagagcaaagttatgttttactcatcagttttttgaatgaaaaattatgtgaacgagataacttttgtatgaatttttaatttttagtaaagttacttaagttatgtttattctccaaaatattatcagtcacatttatttagtgctcaagactaaataagaattttagacagattctcgctctgtcgcccaggctggagtgcagtggcgtgatctcggctcactgcaagctctgcctcctgggttcacgccattctcctgcctcagcctcccaagtagctgcaactacaggcgcccaccaccatgcccggctaattttttcgtattttagtagagacagggtttcaccgtgttagccaggatggtcttgatatcctgacctcgtgatctgcctgcctcggcctcctagagtgctgggattacaggcgtgagccacggtgcctggccaatttttttaaaattatgaaactaggaaacattgttctattaaaaatatttttctctatctattcacagtaacactgaagaatgcagtttacttacatctttttctgtttgacagaagacagttattagtaagtataattattagataaagtatacttattttccatgtttaaaatatgaaaaatatgcaatataggttggtactaagaggggaaatctgcttctgatcaaaattttattttaaatatcatttttatttcttttgtcctaagttatatactttttcttctattacttattgcaaagttactttaaaagaaaacaaaatcaaagaaagcaatcaaccaagattttaaaaataataatagcagaatctctcctcaattctttcctcttctccactccatcttgccttcacagctttttttgtttccaaaggtagtcaaaacattttagatatttatgccaaagggcatggatctgtgataccgtgggtcctgccaagctgaaggttttcctttggccaagataagttactgtggaaggaaagtaactcttccaatccacggttcttagaaaattatacttttatactttttaaattttaaatgaaatgccccacagctttcaatgcatacccagttcagagaatttgaatatcatccaacatgcttccacagtgatcccagtctgagaggactgtgttattatgtaaatgcatagcttgctttctaggtaataaatgataaaactcttcatacaggagaatttggtcttcggtgtatttctatatgtattgaaggtttgctgtgaaatcactctggaatctctcagctggtctgctccacagtatcctactggtcttgggctttgtatattaactttccagaactcatgctcactacagacttgctttagggcctctaaatatttgttgcttttgcatgccaagagttttatccttatttttggagacaggagaggatgtgagtgttgaattgtatttcaggttacccttgggacatcaaaatgaccaaggcagtgtctgctaagtatttgctgagactctgctatgattctttcaagtctaaagacagttatctgaatgatatccccgtgacagtggactcctgcacattcacagtcctggaaggagcctgtccacattggcattctggaagtccataaaagacaaacgcatatgcagtccccgagaaagcattgttgtaaacaaatctgcactagatggaaactctgttatgtggtgccggcatgcatggaagagtaagtccagaactacacctggaagttctttttactaaaagaacacacagttcttttttactttattatattgtattttattttattttgttttattatactttaagttctagggtacatgtgcacacatgcaggtttgttacatatgtatacgtgtgccatgttggtgtgctgcacccatcaactcatcatttacattacgtatatctcctaatgctatccctcccccctccccccatcccacaacaggccccggtgtgtgatgttccccgccctgtgtccaagtgttctcattgttcaattcccaccaatgattgagaacatgcggtgtttggttttctgtccttgtgatagtttgctcagaatgatggcttccagcttcatccatgtccctgcaaaggacatgaactcatcattttttatggctgcatagtattccatggtgtatatgtgccacattttcttaatccagtctatcattgatggacatctgggtttgttccaagtctttgctattgtgaatagtgctagaataaaatacatgtgcatgtgtctttatagtagcgtgatttataatcctttgggtatatacccagtaatgggatggctgggtcaaatggtatttctagttctagatccttgaggaattgccacactgtcttccacaatggttgaactaatttacactcccactaacagtgttaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagcgtctgttcatatcctttgcccactttttaatggggttgtttcatttcttcttgtaaattagtttaagttctttatagattctggatattagccctttgtcagatgggtagattgcaaaaattttctcccattctgtaggttgcctgttcactctgatggtagtttcttttgctgtgcagaagccctttagattaattcgatcccatttgtctattttggcttttgttgccattgcttttggtgttttagtctttgcccatgcctgtgtcctcaatggtattgcctaggttttcttctagggattttttttttttttttttttttgagacggagtctcgctctgtggctcaggctggagtgcagtggcgcgatctcgactcactgcaagctccgcctcctgggttcacgccattctcctgcctcagcctcccgagtagctgggactacaggcgcccgccatcacgcccggctaatttttttgtatttttttagtagagacggggtttctccgtgttagccaggatggtctcgatctcctgacctcgtgatccgcccgcctcggcctcccaaagtgctgggattacaagcgtgagccaccgcgcccggcctcttctagggattttatagttttaggtcttacatttaagtctttaatccatcttgaattaatttttgtataaggtgtaaggaagggatccagtttcagctttctacatatggttacccagttttcccagcaccatttattaaacagggaatcctttccccattccttgtttttgtcaggtttgtcaaagatcagatggttgtagatgtatggtgttatttctgaggcctctgttctgttccattggtctatatatttgttttcgtaccagtaccatgttgttttcgttactgtagccttgtagtatactttgaagttaggtagcatgatagcatcacaattctatacacatttcaggaatgatttttttaaagagacacctcaattcttaatgatttttaaatttttgtaaaataatcaaatgcaaccaatggactgattgaataaatctacttttccctttttgttgatgggccctaaatttccaagtcttctgtgtataaggtgggcttaattttacaaatagtcattttgaagttaaaataacttgttttctgtatacccaattttaaaattcagaatgccatatcagccactttatggataatttctcacatacttctttctctgaatatgagaattttaaaaatttatgcaaaaatgtttcaacttacaatggcatattttaatataacatcttcaatttcaactttttccttttggatatacttttatagaaaggaattcagtatttattaaaccactattttcttcatctattggcagtgtgtttaaggaattcagtttataccttgtgggaatctttttcagataaactgtatatcaagtagttttgtggtgtttgaaggaactttttggcattcagggccatttcttgtgctgtacaaagcagcccttagtgctttctggagagcagactacttaaaattcatatgaacacattcgatgtgatgtgtatgtttagaatcactattgaaatatttctctatttaattggggtggttcatgctaattcacatggcggacattggcagctattttcagtctaccaattttttcttcgggggacatagtaaaatctctgcttccataaatgtttccactttctgaatgcagcagttttcccttcttcttctagctctttcttagtgggcagagagaacaggaaatgctagttgttgcaatgcaagcctggcaggcaagcacacctctcttccccaggaactgagtaagccacgatgctcaactccagtgactgttgaatttcaacagctgcaccctctctttttacccctggtgtcacatagagcatatgctcttggacattcaggaaatcaagtattgcttccattctggccatggtgctagaaatgcagggttttatctctttacctcaaccatttctgtctcctccctcagctcctaggaagctgctgactcacccttttcttgacaagtccttctgggtagtcttcctggatagcatctgagatgaaccccaaactggcacactttctatctctttctgtctgccacatctggaatcacaataaagaggacactactggtaaggacttcaaatgcatgtcaaatggtcagagccatgggctctaggaacaggtgccagcaagtcacaacaaagggttaaatgagaccaatctgcccactccacagtgggcacctctggactctgggtggatctgaggactcttctttggtctgaatatgttggaaacttatttgccagtgaaacagttttgagacatgaaacctttaagaaggcagagccctcataagtggactaacaccattatcgtggaagtgggttcattattaagagagtaggcttgttataaaagcaagttcagcctcctcttgctcttgctcttgacctcttttgccgttccactttctgtcatgacataatgcagcatgaaggcccttgtcagatgtcggcatcatgctcttggacttccagcctccagaaccatgaaccacataaacttctgttcatcataaattacccagtctgtggtactctgttacagcagcataaaacagactaacacagacccatcatctcctgacacagatataaagtgaatccctagcaggcatctttgtccctcagaaaagtcctggaggccaagtagtggaacagcagcataccaatatctttcccacaaaaaacctttctaatttcgtgtccaatatttctaaaagaatggaggcaagtggtcttccgagggtccccaaattattcccagccgcctccttggcaaggtctgctttgatggattcacagattgttctgcaatatgagtagcattgacagttactatctttgggcctcagtcaaaacagagacagagaatacccatttaacaggcactccaacttaggtatccacagaacgtatagttttgttattctctatcatgggcctgctcttgccaatgtttcagcagatagctgcgtagtttagaatttctagttaataatatttcagtttcaactgtctcccttcagtttaatatggggtgtatttaaaataaatacaactccctattagatattaaaggattgttttggaacaactgagtcctttcagataaatcttcaatactctacttttctctcacttctctcactcttttttgtttgtttttttgtttgtttgtttgtttgtttgagacagagtctcactctgtcacccaggctggagtgcaatggtgtgaccttggctcactgcaacctccgcttcttgggtttaagtgattctcatgcctcaatctctggagtagctgggattacaggcatgtgtcaccacacctggctaattttttttggtagtttttgtagagacacagcccaccttggcctcccaaagtgctgaaattacaggtgtaagccactgcgcccagactcactctcctttacttctccaggttggtggctgtgtctatgaggagtaccctttctatgtctgcaggaggagagtgggtccttgcatccacacagcagcctggagtgtcactctggacactctcttgcctcagcctcccgagaagctgggactacaggcatgtgccaccacacccagctaatttttgtatttttagtagagacggggtttcactatgttggccaggatggtcttgatctcttgacctcgtgatctgcctgcctcggcctcccaaagtgctgggattacaggcgtgagccactgtgcctggctgatagtttcttatactgtgaagaagctctttagttcaattagatcccatttgttaatttgtgctttgttgcaattgctttttgtgtttttgttatgaaatctttgccacttcctatgtccagaatggtatttcctaggttattttccagggtttttatagttttgggttttatatttaaggcgttaatccattttgagttgatttttgtgtatgctgtaaagaaggaatccagtttcagtcttctacatgtggctagccagttatcctagcaccatttattgaaataagaagtcttttctccattgcttgtttctgtcatatttgtcaaaggtcagatgatttagatgtctggtcttatttctggattatctatttggttctgttggtctatgtgtctgtttttgtaccagtatcatgctgttttagttactgtagccttgtagtatagtttgaagtccggtaatgtgatgcctccagctttgttatttttgcttaggattgccttggctatttgggctctttttaaattgtgtagttaagtaatgttaagcacattcacctgaataatcttgccaaagtaaaactttataatcattgaacaacaattcccacttttcaactctccccaaccctggtaaccactattctatcttgtgtttcaataaattttgctactttaaataccttgtaaaagtggaatcatacagtatttgcctttttgtaagtgacttatttcatttagcccagagtcttcgaggttcatttatgttatagcatgtgaaataatttcctttgtttttaaggtagaataatatcacactgtgtgcctataccacattttgtttatccactcatctgctgatgaacgtttaggttgcttccaccttttggctgttgtgaatagtacagctatgaacgtaggtgtgaaagacctcaagatgctgtttttaattcttttgggtatatactcagaagtgagattgctagatcatatattcaattttttgaaaaaccactatagcttttgagccaatgtttcaacagatagctgaataagttagaatttacagtgaacaatattacagtttcttccagtttcaactgtctcccttcagtttaaatatggaatctatttaaaatacaccccccattcgattttaaatgattactttggaataactgagtctttttaggtaaatccttaatacttcactttccatagctgttgcaccattttacagtccccacagtgcacaagagtcccgatttctcgacattcttgtcaatagttgtgattttacttatttattttggtagtattcatctgaatgggagtaaggtgatatatcattgcattgcaattggttttgatttgcatttctctgataattagtcactaattattattgagcatcttatacttccgtgatgacgtgggaatttttcttcattgtacaacagatatcattatagtggcgtagttctacactctacacaattttttctaacactacacaaaagcaaacactaaatctaacttccaattgtcaggattactggtctactcctctacccacccataggctgattataaatctttgaaattaattacatctaaaatttttctttcctgtcaagtcactgttgacgaggttcctctgctcacattggcagtctctttctttctcatgattcttcaagtcgtcattttgttagaggccaagctttcactcatggactgaagttatattgtgtgctttttgcctgagtgtttaatcccttaatttacaagcggatgtaggagtgcatacccaggaggtgagggcaaagactcccgttgagtctttggaatctcaaatctgttaccgttttggcttgggacaacaaacatcctgtcagtctcaattgctgtataattgaaaagagaatgataacagttgtcctacatacatcataactctctttgaatcaatgataattaatccatgtgaaaagctttcaaaaacttgtaaaaatccctcataattatatggtgttttacaatttacaaagaactttcacatgcagatttctcacgtgatttttatgttttgagggcagagtgagaaattataaagtatctgtgtatatgccaataatgatgcctaatatcccccactttacatatttaaaagacctttaaaattatggcttttcctagttttcacagcacattaaaaaagccaataccactacacaggtgtgtagtttctggtcttgtgcactgaccatttcctacaccatctttttgtatgctctctagcttccgtagttgttactcgagtagaagagtactgaaaggccacgtagaatatacagcttggtttcatcccactgataaaaatctacttttaacatacatgttaaaataatcaagcctgactaaattatttttgtattttttccattttacctgttatcaactttttaattaagcaatggggccatggtaggcagggtattccctagaacttgtgaatatgttaccctacatgacagaaggactttcagatgtaattaaacttaatgacgttgagttagagagagggtcctgcccagtggaatcacaagggtccttaaaggtataagaaggagtcagaggacagagtcagaaggagacgtgctgatgtgagaatggtcagagagatacaaccttcctgtctttgaagatggaggaaaggggccttgagccaaggattgttgttggcctttagaaactggaaaatgcaagaaaatcaagtctccctaaagcccctagaagggaacacagtccaactaattcatttattttagcccaggagatccctgttgggcttccgacttacagtactggaagataatacattcctggtggtttgtgtcacaaggtctgtagtactttgttccagtatcagtagaaaaccggtagaaggggaattcacgtaaatatcattacacacagaaataattacttattattcttttgttctcaaatcctaccttgtaaacaaaatgaatttttgtttttcggggcttttgtactaattcttatgaatccactgatattttgttttttctgtcgtctccctcaggaacccgaaaggaagaagctatacgactggggacacatgtcttagaagcacactcattagataaagtgtcgcatactctttgataaggtaaggctccctggacgagatgttttacaggtaccatgagctcagtgaattgcttttggaaagacactcagcggagtgggcaccacgaggttaggagaagcagcttctgctcgtcataactttggcaaatgtttacacatcagtaatgaaaaatattctcttggcgatttcaggcttgttactatggatgttgtttgctaacattgactatttttcctaactgcttatagaaactccaggctgtcacccatctgttctctcatcaaagtagttttgggccagcaactatttcagacatttctacagtttcagatgtctcactctgcctatgactgtatgttgtacttgaggactggacgcacagggtaaagtgcaaatagcaagcattcaggtccaactctcctccttctggttaacaatatgaaagaaagaggtagtatcggaattattttagttcaatgtagccattataaaatgtgtatatattttaaaacatcatgtggtacatgataaatatatacaacttttatttttcaataaaaaattataaaaaaagtcatcaaacctgatttctcatactacttttttggtaacactcatcacaccaaagacttattattttaaaatgttatttttcataattaatttcttattaattttataggctagattttaattgttatgtctaaatagtagtgtctggtacgtggtagataatcaatgtgacttgaataaatgaataagtctgttaacgacatacttctcatcactgtaacttatttttggtttaggactgataaaacattttttctctcaccccatattgctaaagatcaaatccttcttctttaagatgctaccataccattgttccattcatcaacgccaaatcattcctcgggcctgagaggagctgccatccttcacttcgtctttgggtcacttccaacctctgttctctgtgtgtctcttctggacttcctgggagaatagcctctctcatgatactcactttcttccacatcttcaatctctgcttcattgatagattatgctactcaatatagaaacaacatcttttttattttttaatgataaacattctccccctcaatcttttaacctactaatgcaggcaatctaatctaaagaatagcctgcaatgcctcctttcatcatttcccatttaatccagctttctggctgagtaattttgcagaaagccctttctcccatgtcacagatggaactttgcagtggcctattctgataaacatgtggcagtttacatgctatttgcatttgaagctgtttatcactccctccttctgagtactttcttcttggtgggcttttatgatagtaattgctatcctactgctgagtttctgaccactgcttgtcagacactttattatgctccctttcctttgcccatacttgcaaagttagatttccacatatgcctttcccgtcttcttattccatgagatttatctaagtgatttcatccattgctatgggttcaactgctgctaatatgttctttactcccaactctctttctacagcttcacatatttaactgccttttagggaatcaccaaaaggcaattccatcttaacatacacaaaactgaacttatgatccttaagtatgaggccagttctttcttatgcattttctaaatcagtgagtgatactatctcttgtcctgttgtcctgggcagaattgcaggaggtgaccgctttctctaccctccctataaaaattaccatctctcgtttaccaacctcccaataccccaatcattagtatctttttaagaaatgattttctgttgtttaacattttttatatgctattacctatatggttttcctcctgaaatgggatattgggtaagagggtaccagatggaggtcacatagacctacagtttattcaaaggggacatctatggagcaaaggcaaaatggagaacccagtgcagccaaacagctactcaaaggtctgagcagagatacagaaatgacacaggagataacagaaagagagagacatatcaagtgggttttgagtgtaggcaaaaccacatttacccgtagctctggagaacccactggcactgttttgagactgttgcagcctgcaagggagggcggacactgagttcagacacacacaccctccgaccagctcccaaatgtctgctgacgtttacaactttgcttcctgctttcctacctggtcttagccttttgatacacaccctcccactgctatcagagtaagatttgagctaagtacataatctggccctgccagattatgacattagttggagaatagataggtcaatgggacctgagatacattttagaaaaatattaatatgtatgccttatgtatagtgtgcagctggcattttaaacacgtggaaaatgatgaaaaatttaataaaccatgagaggaaattggataaatatttccgatacacacacacatcagattcccttttttatgtcacatgcaaaactaaaataatatttgaatggcttaatcagtgaaatatttttctaaattaactaacataccggaaaatatttgacttatctcaaaccaaatatgtatttttattgtatagggttttttcttttttaaaaaatttcagcttgcaatttagatataggaggtacatgggcagatttgttacaatggactattgcatgatgctgtggtttgaagtacgtttcccatcaccctggtagtgagcatagttcctgataggtagtcttttttaacctaacctccctccctccctccctccaccgtctagtagtccacagtgtctattgtgtctcatatttatgtccatacatgctcaatgcttagcttccatttataagtgagaatatgtggtatttggttttctgtttctgcattcatttgcttagatcgccccagctccatctatgttgctgcaaagaatgtgattttattcttttttatggcgtatagtatttcatggtgtttatgtaccacattttctttgtccaatttcctactgatggtcgcctgtgtggattccatgtctttgctattgtgaatagtgatgcagtggacatctgagtgtaaatgtgtttttggcagaatgatttattttcttttgagtgtatacccagtaatgggattgctgagtcaaatggtagctttgttttaagttttgagaaatctccagactgcttcctcagtggattggtctaatttacattcccactaacagcgtataagctttcccttttctctgcaatgttgccagcatctgtttttttgactttttataatagccattctgactggtatgagatggtatctcattgtggttttgatttggatttctctgatgattagcgatgctgagcgttttttcacacatttgatgtatgtcttctttgagaaatgtctgttcatgtctttgcccatcttttaatggggttaattgggttttgtttgttcaactgtttaagttccctatagattctggatattaggcctttgtcaggtgcatactttgcgaatatctcctcccattccctagactgcctgtttactgtgctgatttttactctctgtttattttgctatgtaaaagttctggagtttaattaggtcccacttgtcccgtttttgtttttgttgcaagtgcttttggggacttagctaaaaattatttgccaaggctgatgtccagaagaatgtttcctaggttgccttccagaatttttatagtttgaggtcttacatttaaatctttaatgtattttcagttaatttttgtatgaggtgaaacggaggggtccagtttcattctgctacatatggctagccagttatcccagctgtgtttattgaatagggagttctttcccattgcttgtttttgttggccttgtcaaagatcagatggttgttggtatgtagctttatttgtttgttttctattcttttgcattggtctatgtgtctgtttctgtaacagcaccatgctgttttggttactgtggctttatagtatagtatgaggttggaaagagtgatgcctctggcattgttctttttgcttaggctttctttggctgttcaggctctttttggttcaatacaaattttagagtaattttctaattttagtaaattttctaaagtaaatgttctaatcctgtgaagaatgacgttggtaatttgataggtatagcattgaatctgtaaagtgctttgagcaatacggccatttttacaatagtggttttggtactgaaacaccaggtgctcagtctaggtcctgctgcttgctgcacagaaagccaatgactgagacagcaagtattgccaaggaagaagctttaatccggtgctgcagcagaggaggtgggaactcagtctcaaatccatctctctgacctactaaaaccagggatttatataacaaggaaggaatgtaacattgtgtaagaaaacaggaactagggaggtgtcaggaagcaatcgcgatgaatgaggggtacaacatctcattgtctggatgtgatgatctactgagtttcagttctttgacactttttgtgagaggcctgaaggtcatttcctcaggaaggaactcagataaaacaaatataagtttcaagctttaagaccagaagggtcaatttctatgtttattaaaaagaaaaaaactgttagactgggcgtggtggctcatgcctgtaatcccagcactttgggaggctgaggcgggcagatcacgaggtcaagagattgagaccatcctggccaacatggtgaagcatcatgtctactaaaaatacaaaaattagccaggcatggtggcacatgcctgtaatcccagctacttgggaggctgaggcaggagaattgcttgaacctgggaggcggagggtgcagtgaactgagattgcaccactgcactccagcctggtgacagagcgatactccatctcaaaaacaaaaaccaaaaaccaaaaaaacaaaaaaaaaaccaaacaccagaataaaactgtctatgggacaattgggtcagctttagtttttccaatccttgagcatgggatatttttccatttatttgtgtcgtctcatctcttatttctttcagcagtgttttgtgcttctcgtagagatcgttcatctccttggttagctgtatgcctataggtattttattttctttgtggctgttgtaagtgggactgtgttcttgatttcaccctcagcctggatgctgttggtgaaatatgtatttttaaaaaagaaaagcaaaaaaaaaaaatagatagacttgactaaacaaacattattataaacaagaatgagtgtcaatattcttttccataaggtactcttacaaatcagtgtaaagaattataatttctctatttaaaaaaggagatagcattgccagttcacaaattgtatataagtggcctatgaatgcaaaaacctcaattgcataagtaataaaaaagtctaaataaagtgatattacaaattgtataaaagtggcctataaatgcaaaaaccttaattgcataagtaataaaaaaagtctaaataaagtgatattattttctactgatacaattgatggggagaaaaaccaaaataaagtgaacagaagaaaatggggaaaaagggagccttttagactgctagtgggagggtaactttgtataaactattagaatacaatttgtcaatccgtgttacaatcaaattgttcattcactttgtaacaacagttctatttctaggaaataattatagatggcaactatttctatataaagcttttcattacaatgttaaatatgataaaattggggatactcaagtggtcactaataggagcatgactaaataaactttggtagtgacagtgaatagaataccatgcatctattagaaatgccttttagaaaataaagtcaatggcatggggatacagacataatttgtaaagcagtataactcaaatttgtagaaagaaattacaggacaaagactggtactgattcaaaatggtgcctggctacgacgggcctttgtccccagaattaagcctggagaattgtcctcgaagtaaagcaggtgctctacgtgtagaaagctcctggtgcggatgctggactctgagagaaggctgagcacagccttgggtaatgcagaacttcctcaaaaggcaaggaggcaaaaataaaacaagtgaagagcaactctcttagaagaggaaatgcactcaagcccttgggccacagagaaaagtgctcctgaaactggaaactctatggtctcccagcctccagcctgcctgctcttcagtcagtcaccctacaggtgacaccccctgcattccccactctcattttcagagagctgctgccgggaccctcattctgggaatggactatgaggaaggagacctacatagttgtcaaggaaacctatgccagttacatatgccatacattttaatcgcttagttatcaatgtgacaggtagggagaaaacaccaaatgcttgaggaaaaccaggggtatgaaagagaagcattaagattactttttaatggaaatgtatatattcacctaggctattcttccttacccaagttgaaactgaatagtatgacctaaacgtacatttcgtgtgctgggaagaaaaagcaactgataaccccctttcccgtaggtttcctgtcattaatttgctcaccagtgcaaccccattcaggcccccaagctagtgccatcttgtgtgcacaaggctggggcaattggattcataagaagttttgtccatgaggaattttcagtctaatgccaagtaattgacaatgaaaatgtttcctggtttccatccaaatatttattaatacagcaaaaatgtaggatttgtaggatttatgtatcttccaactatctccactactgcaggacacagacaccatctataaatctcacattgtaaccactaacacttatctttgttattgtcacctggaatcttttatgccaaaataagagtcttaaaagaatgaagccctgcaatttcactgtccaacaacagaggttttacctgataaatcgtcttctcgtctgacagagtgggccacagaaacatctctgacagctgttgcatgatggagtgggagcaaggtcacttcctgcaaatgttagggttcttcagaatccttcaggcgttggaggaataattgaactcaacaggcaatcagtcacgtctgaaacatgtgaaatatacctaaggacccgaggtcagggttgagtgtccaaattcaaccagttattcacacggtctgaaaatgaaaatgtttcatttcagagaagtttatatggagtccttgacagaatgttgaatatgaaatagattttttttctgtcttcctttgaaaatctttgtggataaagcttaacatggtgcattagaatcttaggagtaaaatatccctcacaaaatttgatatcttatctgattagttaatacagacatattacatttttcaactaattttttttcttaagaagaattctttcagaaacggagaagcatgtagtaacatactgattttaaggaacctatgctaacaattttaagtagtaaaacttaaaactaaacttaagaagtaataaaaaggtgataataggataattactatttggcatcctactaagatatttagttggcaatttaattttaaattacctggttttctctgatattcacatattattaaatgcaatttcatttaagctgctctactaagtgttagggaaatatgaaaattgaaagtgtgaccttgttgtccagtaaagtaattttatcgaatttggtagactcttaattgtccctaagtattcattttccctttctttttttttttttattgtagcttttcttttgaaatatgcgttgcctcccagacattgcaaaatggtatagtgagttctggtgtattcttttttttttttttttttttttttttttggagagacggacttgttctgtctctcaggctggagggcagtggtgtgatcatggctcactgttgcctcgacctcccaggaacaagcgatcctcttgcctcaacctcctgagtagctagaactacaatcacccctcaccatgcccagctaatttttaaattttttgtagagatgaggtccgctatgttgcccaggctgatttagaactcctggcctcaagggatcctcctgctttggtttcccaaagcgctgggattcaggcatgagccactgtgcccagacttaattctggcgtattcttaagccagtgtcccctaatgaaaatatcttccaggacctcagtgcatggtccaaatgaggaagctgttaagaggtacaatactattaacacatgtacatacagatttcaacagcatttaagttcagttttttctttctgtcttttgttttgtgtttatagttctttttctgtcttcctttgaaaatctttctggataaagatgtttccacagatttctgtagatgtgttcagccatcaccacccagtcccagttagaatcagggtacagaactgcttcatcagtctcatgagaaggtgtgactgaaaggagcagtgcaaagatgctcctttgtcctttcagtcacgctttctccctgactctgacctttggcaccagctgttaggtcttcacactctaattttacactttaagaaaggtatgtaagggcagggtgcagtggctcacacctgtaatcccagcactttgggaggccaaggtgggcggatcacgaggtcaggagatcgagaccatcctggctaacacggtgaaaccccgtctctactaaaaaaagtacaaaaaattagccaggcatggtggtgggcgcctgtagtcccagctactcgggaggctgaggcaggagaatggcttgaacccaggaggtggagcttgcagtgagctgagatcgcaccactgcactccagcctgggtgacagagtgacactctgtctcaaaaacaaaaaaaaaaaagaatggtacgtaagtagaataatgtaggtagcaccattttgagattgcttttttttcattcatcataaagccctacaaatccacctaagctgttgcctgcattgatagtttgtttctttgttttgtgtcacagtttgtctatttattcacaggttgaaggatgtttgagtggtttcaagtcgtgggctgctacacatgaagcagcaatgaacatctgtgttcacattcctgtgtgactgtgtgtttcacttctgtagcataaatacccaggaggcctggattgcattgcaaatatgtttttaactttgtaggaaacagccataccaccttccacaatggttatgctgttttccatttccatcagcagtgcatgagaaagcctgctgctctgcgtgcttgtcagcacacggtattgtcagtatttttattttagccacttattaggtgtgcattgatgtctcattgtagctttaatttgcatttccctaatggctaatgatggtgaacatctttttatgtgcttatttgctatctctataccttccttgatgaggtgtcaacaaatgttttgcctgttttcttgttgttgaggttgcagcattctttatatggtctggataaaagttctttcttaggtatgtgatttgtaaatatttcttccaggcaatagctaactttttatcctcctaacaagccctacttagaactgaagtttgaaagtttgatgaagtccatattaccaatttttttctttcttagacatgacaactttttgtctaactcttgcacaggaagatttttttcctgtgttttcttctagaaatgttgtagtttcacactttacatttagatctatgatctattttgagttaatttttatagaaagtgtgaagtttaggtctagctttttgtttgtgtgttttcttttttggcctacagtgtttaattttcccaacatcttttgttgcaaattctaatcttcctctatgggattgctttgcattttcattttaaaaaattaagttgactgcacctatgcaggtctatgtccagttcctttatcctgtgccattgatccgttcctctgcccaagccacactgtgaggctgtcttcccaagctcctccctttccaggatctccccggccacagcttctcctttcctcgttttgatcatctagccagaaagctgggcttttagttactcagctctgctgtgcacatcctgcaactgcggctgctccaagcaggagatacagagaaaaagaagccagtcttttcctcaccaccttagaaagagaggtccctgccttgaagctcacgctccccgcacctgctgccttcacagtccttaccctgcagagcgcggcttgagagaggagaggggcgagcttgggatggtggatggccctcccagctctgagctttgggggccagagctaaaagagaggctgctgtctccaagttgccttcaatccaagctggagaattctgcagacaaatagggcgctttcctccactttggtagtacttcaaaatcttgtcttcttcctcaatgcgtcaactaccacccagttttcagagccctccaacctcttttccctgcatttcttcctggcactggatccctaagtactcagtttaatccatacattgcccttatcatttctttttttctttttctttttctttttcttttttttttttttgagacagagtttcactctgtctcttaagctggagtgcaatggtgcaatcttggctcactgcaaactcagcctcccgagttcaagaggttctcctgcctcagcctcccgagtaactgcgattacaggcacctgccaccatgcccagctaacttttttttttttttttgtagttttattagagatggggttttgccacgttggccaggctggtctcgaactcctgaccttaggtgatccatctgcctcggcctcccaaagtgctgggattacaggtgtgagccaccatgcccagcccgcccttgccatttccatcatctgtctttcacactggatcttttttcagttgttccaataaaccaagtggtaaaaatttgaaaagtgaatgtgagtaataggaccaaatttaaaaagttatagaattttagggttggagaggaacgtgaaagagttataatcaccctttcaagccaccaagctgagatgaaatgccttgccctaagtcactcttagccctctgatcttcctacgatgtcatgcgactttcacatagaaactaaaaggacttaccattaatttctcctctttcatttacacatatgaatttttttaaaagtctttctcatatcttgactaagttatactcacaaaacctacccatttttctgctgaatttattcttgaacttgaatacagtctcatgtggaaacagtaataataccaaaattgcaaataatctttatatctgacattgctcttagttaattctgttgctagtttggaaagttttttttttttaaaaaagaatgtttaaacatcattacgtttaaaacattttaaagcctgagtacgagttttaaatcagaatcactgacttccctcccttacacctcattattacaaaccttgatttgaaagccgtatttcctacaaagagtcaaacgagaaaaaacatactcctgtgtgaaaagaaatataccaatgtaccaaatccttatagtttctcttccccaacctgtgaccaatgttcaccctttggtgccagactcatctgttttacacacacacacacacacacgcacacacacacaccccgaaaacttgatgtaaaatgtaaataattcatattagacataataataaggaaaggaaagcaaatagcaaatgtgcctttgttgttaggagtgaagatgcaggttcagaattgtctgtgctgagtaaggataaggtcttaatatctgagaaaaggggtctgaatcctgaggaggatatacagaaagtggccttttgaattagactatttgggcaaatgtgcagaatgatggcgactgactgggcagaactggcgtatggcaccaggttgtagcaatggagatgaaataaaagggcctgatccctaaaagaactttaaaggaagaaacaacaggacccactaacaaatggaaaataagtgatgaaggaagataatcacaataatatgtagtgaatctgagtcttttggccagggaacttgtgacaaatatagaagtaccaaaaaaaaaaaaatagagacattcgaaagatggatatgggatggaaaaaatgaattgttcaggatgtgctgagcttgaaatatcaaggtcatattcaacagaaaaagaaatattgtgaaggggcccagatgtgagggtagggcaaaaaatgatattagtagaaaagtcatttgagtaaagaaagtggatatgttaatagggaaaacagagtgcttggcccagggcagaccctgtaagattcccatgagtaaggatcagcaggtcaaagatttaccagtaagaagacagaggccaatgagacaaagcaagaaagcccagagtccagagagcatgagggagtcctgtttcagaaggggagggtgactagccggaagacttggagaaagtggaagatgaagaaaatcctttgagcgggggagcactgtctggcttggaagatggtcctaggagataggtggggaaatggccagatttggggaggaagaatactggggaatgtgaaaggtctgtgcctagagaacaatgcgtcaggacatggtgatggaatgaagggattggacagcgctgaacattttaggagacagaaggaaaagaagagtgaagtgagacagaaagacatggaggatgtgaaagaaaatgtgaggatttatattcaaaataccaaaaagctttctaattcctagacttgcccccggctagagtgggctatctgggtgaagagtttatacagatatccccatatacactatttattctacttagataacactctagagacactatgtcctgttttcttgaaagactcataccaatggtgacatttcagatcttctaaggaagtttattttagcttcaaaataacacgggtggcacgggggaagtatttttagcctcaaggagcgttttaggccaggcacagtggctcaggcctgtaatcccagcactttgtgaggctgaggtgggaggatcatgaggtcaggagttcgagaccagcctggccaacatagtgaaaccccatctctactaaagatacaaaaattagctgggcttggtcgtgtacacctgtaatcccagctactcaggagactggggcaggagaatcacttgaacccggaaggtggaggttgcagtgatctgagattatgccactgcactccagcctggttgacagagcgagactctgtcaaaaaaaaaaaaaaaaaagagaggactttagtacttctgaaactcctctgtgtagctcttcgttcaagcaatcctaactcagaagtacaagaaggataatattcttgtgtgtgctctgaagctatttagtagcatcagaaaggtggagaataagtagcttataaaacattgacagctcttcaaattggactaacaggaaatctccaggcattttattcataattttggaagaaatgcaataacaaagatttaatgggtcccatattgtgaaacataattgatctagaataagtactattcttattcctatagacaatcatactctgagattttggtcaagtatcagttgattgttaattatctacgtgtttgaaatatatgaaatttaatagagaggccataagtcacatccaagaagtactaagagaaagcaccactgcaaaatcttggtaaattcagaaaataataacaaatctcataatgaaataaatattttattgggattataagacctaccatccaaagaaccattaggaactttacaataactcattaatttatatgggaaatatgacagaaagcaatttctgcttttacttcttttcttctttacttctttcccttagtgtgttttgcatgtgtgtttgtgtttccttgaatcgttgcttaatccaagaagctttcaattgacatcccatgtcagacgggaatgccactgtatcacttattgatttcaacagtggtagtttactcctggaaactaaaaccgttaggtgtttctaaaatgtatgcacacacacacacacacacaaacagagtttaagggttaagtatttatcttcctacctgtatttttcagaagaaagaagaaaaggaggatatgcttctgtactagagactactctttattagaaaagcacaggaacaattctcaacctgaatattttcaataaatgccttggtgaaaattactgaagtggtgctacaaaattgccttgtcttatttttgaggacatgtggaaagcctttctacaacttttagatatatgtaataaagctgaacattcttcacatcatccaaacttattagagagcttaaagtgtaatagtcaaatcgctagcattggttagtttgaatgaatagtccttttaagacttttttttttttttgagatggagtctcgctctgttgcccaggctggagtgcagtggtgcgatcttggctcactgcaagctccacctcccgggttcatgccattctcctgcctcagcctctggagtagctgggaccacaggcacccaccaccatgcctggctaattttttgtatttttagtagagacggggtttcaccgtgttagccaggatggtctcgatctcctgacctcgtgatcctcccgcctccacgtcccaaagtgctgggattacaggcatgagccactgcgcccagccaagactttttaaaatgcttccttcttcatggatctgggctcctgagtgagtgtgctgagtgaatcatgcatggtagcagacacctttcggaatccggcttcagtagacgtgagggtaactccagtgctcagaaaaggtcccttagcagctggacttgctcaaggtgactggatgctcgtcataagatttccaggttgggtctgagttatgtcaagtactagttggaattgatttattgctgtcttgctcacaagccaggagcacacttctgaagttgccaagagtgtgaaaaagcagatatccaaattgtgaagtgagtggtttcctacattaactcgaattgattttgttcttcctaatgctgataaggattattttggagtagaatacagtagccccctcttatccatggggatacattccaagaccctcagtaattgtctgaagtcccggacagtattgaaccctacatatactatgttttttcttatgcatacatgtctttaataaagtttaatttacaaattaggcacagtaggagactcacagtatctaataaattggacgattataaaaaaactgtaataaaattatgtgaatgtggtctccttctctccaagtatactatagtgctgtaatcacctattttcagcccatgctgacttctagtaactgaaacctcaaaaagcaaaactccagataaggggtttcatttactgtaataaaatgaaaattctgtaaacatgtttagttgaaaatatcttacagacatacataattcagtggaagcgatagtgatatgtttcagaaattcagattcaagatttcagaaattcagtttcaaggttcaaggctcctctgacaattgaatgacttagtttttcaaatataatcaagattctgccttgaattatatataatatatattattattatttccatatataatttatggaaaagttataaaattaatataaacatttgaaatactgtcttttggctcactttgaaaagatttccagtttgcttctaaatgaataacaaatttgaaaggccaagtgatttaaggcaggtacatcactacttagcaatacgatttgttcaagcaggtgaaaagtatgcaagaatcaaaatgctctttgcaaaaggagcttcaattttcatcaggaaaacccagtttgtgtcagagggtgaaacttgcttgactagatctgttcactgaagccattgaacaacttccgatgttcttgctctctcccatttacgatgctgaactttacagagacagactgtttgaagccttcctaattattcccattcttagccaagaaggattactaaagctcagcctctattgtaattcttaaacttctcagtgcaaattattaatatatggcaatctaaaatgcctttctctggctttatgacctgattattatttcgagtctctctagcagtgaacttgaggatcatgcaaacatgttctatgggaacatcactgtgtagctgaataatttgttttttagtaagctagctcaaatttatcatcagtcatgaaaatgttttatcaatgctcttccataaagcagacatattattttactagtttcagtttagccctgacagaaacctgatcgggaatactattattaagccacaaatacctgttttaaaatatgttgtcttatgctatttcattgtattgtattaataattcatgtaatatttcctttggttttattgtcttctgtgttataattaaaactgaaataatttgggaaatgtaatgtatatagcacacatctaaagttcagagtgagaataaaactacaactattttatctattgcaatagctcaaatagtagagtttaactataatacttggtatacatatcaaacaaggtatctatacatacattattttaattttactcctccctcattttctctccacgtcccatcacataaatatgcacaaatttaactggccagaggtgacctacattctctacatgcagtgtccatgatgaagatagcaactgtatttgctaaggttttcacagttcataacagtgaaataaaatgtagctatggacattcattgattaatctaatatttattgaaggtgtatttgttagattccgtgatacaatgatgaacaagtcattgtgtaatcatgaagagcttctagccaagtgggtaaaaagataaggaaatcatcccaattagtgagataaactacaagatagggaatcattccgtgtgttaccagcacattctacccacgctgtatttttcagggaaaggtggtgtacattacctgatgtctaaataggaggtaaaagcataaggtgctgggagacaaaggagttgtagattacctgatatccaaataggaggaaatagcataaggtcatggaagagagaggggtgtagattacctgatgtccaaataggaggtaatagcgtaaggtcctgggagacaaaggtgttgtagattacctgatgtccaaataggaggaaatagcataaggtgctggaagagagagggctttagattacccgatgtccagataggaggtagtagcataaggtcctggaagagagagggttgtagattacatgatgtccaaataggaggtaacagcgtaaggtcctggaagacaaaggtgttgtagattacctgatgtccaaataggacgaaatagcataaggtcatggaagagagagcgttgtagattacctgatgtccaaataggagggaataccataaggtcctggaagacaaaggtgttgtagattacctgatgtccagataggaggtaatagcataaggtcctcgaacacaaaggtgttgtagattacctgatgtccaaataggaggtaatagcataaggtcctggaagacaaaggtgttgtaaattacccgatgtccaaataggaggtaatagtataaggtcttggaagacaaaggtgttgtagattgcctgatgtccaaagaggagggaatagcataaagtcctggaagacaaaggtgttattatattacctgatgtccaaataggaggtaatagcataaggtcctagaagacaaaggtattgtagattacctgatgtccaaataggaggtaatagcataaggtcctggaagacaaaggtcttgtagactacctgatgtccaaataggatgtaatcgcataaggttctggaacagagagggttgcatattacctgatgtccaaatagcaggtaagagcataaggtccgggaagagagagggcagtagattacctgatgtccaaataggatttaatagcatacgatcatggaagagagagggctgtagatgacatgatgtccaaataggaggtaatatcataaggtgctggaagagagagggcattacattacctgatgtccaagtaggaggtaatagcataaggtcctggaagagagagggttgtagattacatgatgttcaaataggaggaaatagcataaagtcatggaagagagagggttgtagattacatgatgttctaatagaaggtaacagcataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtattgtagattacctgatgtccaaataggaggcaacagcataaggtcctcaaagacaaacttgttgtagattacctgatgtccaaataggagggaatagcataagctcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatatcataaggtgctggaagagagagggcttaagataacctgatgtccaagtaggaggtaatagcataaggtcctggaagagagagggttgtagattacatgatgttctaatagaaggtaacaggataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtgttgtagattacctgatgtccaaataggaggcaacagcataaggtcctcaaagacaaacttgttgtagattacctgatgtccaaataggagggaatagcataagatcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatagcataaggtccttgtaagagagagggttgtagattacatgatttctaaatagggggtaatagcataatatcctggaagacaaaggtgttgcggattacctgatgtccaaataggaggaaatagcataaggtcctggaagaaagagggtagtacattaccggatgtccaaataggaagtaatagcataaggtcctggaagacaaaggtcttgtagactacctgatgtccaaataggaggtaatcacataaggttctggaacagagagggttgtatactacctgatgtccaaataggaagtaagagcataaggtccgggaagagagagggttgtagattatccggtgtccaagtaggcggtaatcgcataaggtcctggaagacagagggttgcagatgacctgatgtccaaatgggaggtaatagcataaggtcctggaagacaaaggtgttgtagattacctgaagtccaaataggaggtaatagcataaggtcctcgaaaacaaaggtgttggagattacctgatgtccaaatagcaggaaatagcataaggtcctggaagacaaaggtgttgtagattacttgatgtccaaataggaggtaatagcataaggtcctggaagacaaaggtgttgtagattacctgatgtctaaataggaggaaatagcataaggtcctggaggacaaaggtgttgtagattacatgatgtccaaataggacgtaatagcataaggtcctggaagacaaagttgttgtagattacctgatgtccaaataggaggtaatagaataaggtcctggaagagagggctgtaaattacctgatgtccaaataggaggtaatagaatcaggtcctggaggagagggctgtagattacctgatgtccaaataggaggtaatatcataaggtgctggaagagagagggcttaaaataacctgatgtccaagtaggaggtaatagcataaggtcttggaagagagaggtttgtagatatcatgatgttctaatagaaggtaacagcataaggtcctggaaggcaaaggtattgtagattacctgatgtccaaataggaggaaatagcataaagtcatggaagagagagggttgtagattacctgatgtccaaataggaggtaataccgtaaggtcctggaagacacaggtgttgtagattacctgatgtccaaataggaggcaatagcataaggtcctcaaagacaaagttgttgtagattacctgatgtccaaataggagggaatagcataaggtcctggaagatataggttttgttagattacctgatatccaaataggaggtaatagcataaggtcctcgaagacaaaggtgttgtagactacctgatgtccaaataggaggtaatagcataaggtcctggaagacaaaggtgttgtagattacctgatgtccaagtaggaggtaatagcataaggtgctggaagcgagagggctatagattacctgatatccaaataggaggtaataccataaggtcctggaagagagggttgtagattacgtgatgtccaattaggaggtaatagcataaggtccttgaagacaaaggtgttgtagattacgtgatgtccaaataggaggttatagcataaggtccgggaagacaaaggtgttgtagattacctgatgtccaaataggaggtaatagcataaggtgctggaagagagagggctgtagattacctgatatccaaataggaggtaatagcataaggtcctggaagacaaaggtgttgtagattacctgatgtccaaataggaggtaatagcataaggtgctggaagagagagggctgtagattacctgatatccaaataggaggtaatagcataaggtcctggaagagagggttgtagattacttgatgtccaaataggaggtaatagcataaggtcctggaagagagagggttgtagattacccgatgtccaataggaggtaatagcataagatcctgcaagagagagggttgtagatcatctgatgtccaaatattaggtaatagcataaggtcctgggatacaaaggtgttgtagattacctgatatccagataggaggaaatagcataagatcacggaagagagagggcagtagattacctgatgtccaaatagcaggtaatagcataatgtcctggaagagagggctgtagattacctggtgtccaaataggaggtaataggataaggtcattggagagagagggctgtagattacctgatgtccaagtaggaggtaatcacataaggtcctggaagagagagggttttatattacctcatgtccaaataggaggtaagagcataaggcccgggaagagagagggttgtagattatctgatgtgcaagtaggaggtaatcgcataaggtcctggaagagagagggttgtagatgacctgatgtccaaatgggaggtaatagcttaaggtcctggaagacaaaggtgttgtagattacctgaagtccaaacaggtggtaatagcataaggtcctcgaagacaaaggtgttgtagattacctgatttccaaataagaggtcatagcataaggtcctggaagtcaaaggtgttgtagattacctgatgtccaaataggaggtaatagcataaggttctggatgacaaagttgttgtaggttaccggatgtccaaataggaggtaatagaataaggtcctggaagagagggctgtagattacctcatgtccatataggaggtaatatcgtaaggtactggaagagagagggctttagattacccgatgtccaaataggaggtaatagcataaggtcctgaaagagagagggttgtagattacatgatgtccaaagaggaggtaatagcataagatcctggaagacaaaggtgttgtagattacctgatgtccaaataggaggaaatagcataaggccatggaagagagagcgttgtagattacctgatttctaaataggaggtaatactataagctccgggaagatacaggtgttgtagattaccttatgtccaaataggagttaatagcataaggtcctgcaagacaaaggttttgtagattacctgatgtccaaataggaggtaatagtataaggtcctggaagacaaagatgttttagaatacctgatgtccaagtaggaggtaatagcataaggtcctggaagacaaagatgttgtagattacctgatttccaaataggaggtagtagcagaaggtcctggaagacaaaggtgttttagattacctgatgtccaagtaggaggtactagcataaggtcctggaagacaaaggtgttgtagattacctgatttccaaataggaggtaatagcagaaggtcctggaagacaaaggtgttttagattacctgatgtccaagtaggaggtaatagcgtaaggtcctggaagacaaagttgttgtagattacctggtgtccaaataggaggtaatagcataaggtcctggaagacagaagtgttgtagattacctgatgtccaagtaggaggtaatagcataaggtcctggaagacaaaagtgttgtagattacctgatttccaaataggaggtaatagcagaaggtcccggaagacaaaagtgttttagattacctgatgtccaaataggaggtaatagaataaggtcctggaagagagggctgtagtttacctgatgtccaaatgggaggtaatatcataaggtgctggaaaagagagggctgtagattacctgatgtccaataggtggtaatagcataaagtcctggaagagagagggttgtagattacatgatgtccaaataggaggtaatagcataaggtcatggaagacaaaggtgttgtagattacgtgatgtgcaactgggaggtaatagcataaggtcctggaagacagagatgttgtagattacctgatgtccaaataggagctaatagcataaggtcctggaagagagtgtgtgttccagtcagaaggagctattggttcaggatagctgcaacatacatttagtcattatgatggaaaactgataatggagttaggcctgatgttgagatgtataattgaagaagagtgagaggatcacctttcaattcacaaagatcatcatagggccagtataaaagtattttagagacaagtaataatggaattagggaaaccagttcaggtaaaaaatgatgttgttctagattttggaggtgactgaagagaaaaagtacatataattcacttatagctctgcttatcctattacgggtatttctttctaatggagattacagatgttatttttaaaacactttgtgattctgaggaggcatttacttatgggtctagttgtatcattagtaacaatatatattgtgtttatcttaagcacacttctctgcacattatctcaacttcctgggttgcttgatcggataaagcatttatatttgtcttctaaaatatgactaaatactatccccaatcaaagtgacataatattccatagttgtgcaaatgtttagtttttttttttttgtgccgaaagataagtcacaggctggggtatttgatttttcttttaaaaatgataaagcagaaggagagagaaagagaccaagaaaataaaattgtatacagtgaaacacagatgttatctgaaaaatggattttttaagagaaatataggtataaaaggcattcatgagaaatacaagaagagagaaagagaagtgaataaattaaactcttttaattattgcaacagctcaaatagtagattttaactataatatttgatagacatgtgaggtctttatacatatactattttaattctctctctatatatataatgaaatgttattccaaaatgcaatataatcccgtggaaaatttattcagtcggaaaaaggagaaaataaggttctaatactgattttagtgcctcaggcaagacacataactttttgggcatcaatttctatatctgtaaaatgaaaacacacgccctactatgtatatcatatgtaaatgtctaaaatgagataatagtattgaaaatggctttgaaaaaaaatacaagggattgagtcactctaaggaatgactgttttttaggagtcaacaagaggcaaaggaaataaaatttattccaactaaatgaaaaagtgttactgaaatgttagccttttttttttttttttttttttgagacggagtctcgctctgtcgcccaggctggagtgcaggggcgcgatctcggctcactgcaagctctgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaatgttagccttttaagaatacaaaaaaatctaattatatatgaatacaatacctgaacccatgaaacttctgtagaatacatgaatctgtaaagttatgtattctaaacatttgtagccagaataactttcttcatattttccacattcttggtacacttacgtgtcacacatgttccctgtttttcaaacaaggtcaatgttttcattatatacatttacattgttattgtaactattttccaggtctgtcagtaaaatttagtctcacacattgataccacattcttgcaattatattgtaattctcacatagtaattcaagcctttttgaatatacaaatcatctgaatttattatatcactgctatgacacctcatacacatgttgagaccatttatgccagaaaagattagatttagtattcaaagagccaaatgtaaataattctggattgcttatccaaatggggaactcagagaacttctatagtttaaatatgcaaatattcaaaagtaatttttttgtgaccataccctcctgctactgaatgtttccttgagctggtgtcagaagcagggtttacaatgttgtgctctatttcctgtttaacctattgccaagatgttaattcagagtgaaataataagaacttagtgagaactgggggtgataaacaaagtgtcctcacagcggagaaactggaaaatgtatccttgaaagcgtgtgaatcgggtgagcgtacaacgggtaacatcagtattggtgttctcactgctgggtcagcactgaccagcagagtctggtgggagccagcaggaccagaaacatgtcctcagtttgggccaatttaaagaagttgggaagctttctagagcccggccgtgtgtctctgcccttgctacaactcctccctctgtctcacagccagagatgcacccatgatgacattcatgtaggctattaagggcgagcatttctcggaaggtgaagcaagatatggtagtcattccaagaaaccttccttctcagctgcgatttgtcaagaggaaagaagtggagttttcagtggaaagcagatgtgaatttggagcagtggggcacttccagagaatgagcccgggtcaattttcataggcaattggcaacatgaatgcataggcactgggaagaatgtaaatggcaagtccaggaagcaagtagtagctaacaaatgcgtgaaagagtagaggagtaaaataacgatttcatcctctgaatgctgcccagagtcaatcccactgtaccccgtgcagagaaagtgactccaggagtgtgtgcccagtctagaagaaacaacaacactccttccatgtagagccaaaatcgtgtgtgtccctcggcctgaggagctggaagaatcctgaatcttctccatttagggcaggagttttagtggcatgtcaaatgtgcaacatcctccaagcctagaacctagaggtggttctagaacacttttcttccttgcttccacatctgtccaattacccacctcaattaatagttaccagaatattcccagagaatcataccagcacactctttgcaccaggaaggggtacagatatgttacaagaagagaggtggctgtcagagtggaccacatgtctttttatagtttggtgctttgtctttcacaataccagcttgccgtctagcaggggatgtctagcgtctcctacaaacatactgattatctaggaacatcatagcaccaaagaggccttctgccctcttccattcccacattgttaagaaaaaaaaaaactggttacgtaaattacagcatattcatttaatacttggaatataaaaaggggtggaaacattgttaaggcccctgtctgtgtaaggatatagaaagcagccaagatatatctgtaggtaactaaaatgcagatgtgcacaatgctgccatgcctgtagaaaacaaggccgggtgcggtggctcacgcctgtaatcccagtgcctgtagaaaacaaggccgggcgcggtggctcacgcctgtaatcccagtgcctataaaaaacaaggccagacgcggtggctcacgcctgtaatcccagcactttgggaggccgagatgggcagatcacagggtcaggggatggagaacatcttggccaacatggtgaaatcccgtgtctgctaaaaatacagaaattagctgggcgtgcctgtagttctagctacttgggaggctgaggcaggagaacctcttgaacctgggaggcagaggttatagtacgctgagatggcactattgcacactccagcctgggcaacagagcaagactccatctcagggaaaaaaaaaaacacaacaagcaagtacacaaaaacgccaaacacacaaaactatacagaacatatgatttttgccaatattccagggtaaaaacatctcaagagttgatagattccagagtctttgagtgagcacactcggttcctatccttgatcccctgccctccggaaggcctgtttctgtcttctccctcacactcaccacctgctatcaggactctctgctccctactgtcaagactagacgtgcctcagacacagattcctcccttcttcagcaggagttcccagggccgagttatttattctagaaggtgcccctggtgatagtggtggggaaagcttctacaggtcatctgcagttacttctggtcctgtgtgtcactccgaagaccacttgtcatgtggggcggcggcttcacagaagcatctaggttagccagagacacttaaagcctgtttctctttgagaatgatggtaagcagaagacctttctctttatcttgtatttattagtaactattaaatatatatttttatacacacagacatataccaaagatgaacattgatccttatcttacggattctctagactcaaatgcttactgaagtcaggcagataaaacaaaaaaaattcaacaacagcaaaccagcaaacagaaactcactgaggtagtgaagtgtaagcaggaagctgtgtggccaggtgtgaggaactgtgtagaactctgggaggaatgagagtagccccttcagcttcactgcttgctggtatgtgggagggagggccagggttccaaaacttccagttcttaaatagaagcctgcagtcctcattggaattgcttgtatgttgactcaaaaggttaaatattgtgcagatcaaacaaataatttctgtgaggaggatttagtcaatgggtaaggagtttgtgaccttttgtctaaacacatgaaaaggaaggggaccatttgcctgactgctctctactttgctacgttctttctacacctgagttagtgctggtggaagagtgtttcttctccttcatccagctgctttcagtcatgtacccccccgtgaccccctcactctggttcaaacgcaaacacaaactgagaataggaaaataatccactgctgaggcatgaacatagcaccaaaggatgcagtactctagttgcaaagaactctggctgaaatttcccccacctcacctgctttctccttttatcttactcaaggctcatctctcttccagttcctctctggggaaacaggagggagattcttcttgtcacataaatgtgtcctgaaaggattctctcctccttatatctactcctttaatctgagttcaagtcatcaacacctctcacctggcccacttgccaacttccataccgtctgtctccatcctctaaaacaaactttccatgtggacaaagctgtcctttctcatgcctcagacgccactgagggcacaccaaggccattggcggcgtggccgtggacttacacaaactttccatgtggacaaagctgtcctttctcatgcctcagatgccactgtgggcccaccaaggccgtttgcggcgtggccgtggactttccttatggtcaccaacctgcagccttaagctttcactcaccctctttgtctgtccccagacttaaatcttttcttcatgttgacccttgaaatacgtgtattcatgaagacctgttcaatcacactctggattttcaaagttgaaaataacaggaagttactacggcaatgatgatttagtgaaaaatatgaaggaatcagtgactcaacaatttttgggccccattttttttttccttcaccagaggataatgttaatatgaagaggttggttgtcaatattacaactttagaaagaggaatacatgtatgtatgtattcttttatatttatgggagttaccttctgaaacctttgaacatcaccaatattgcggataaccatatgttttgataagctcttgggtttatctcgcattgcgatcaagaattgttttcactgcatatcctccaactacattaaatgccttttcaacattctttacaattttctacgtggcaaaagataccataaacaaaactaaagacaaataacagactggagaaaatattgtttgctttgagtataacgtggtaagttacgaaggaaatgacaggacactaaatatgggaaaatgagtaaatataccaagagcaaattcagaaagacctgtgcaatgagacacaaaattatttttaaaattataaaaataagcttaatctcactaataatctgaggactacatgttaaaatggcaatggaatttctttgatgaccaaatatcgttgtttgatcatgtcaagggcaagtgggcagggagaaatgtgtactcctcaactgcagataaaaagagaattgataaaacctcttaaaaaaatggattagatttagaagaatgaactatgtatacactctatgactcagttccatctgtgaacatgagtgtcagagaaaagtgtggcacatcttccagtggccaggtacacagtgttgtgcatgaccctgtgtgggaggaccacaaatacattttagttaagcacgttatggaagactatgtagtatttagaaagatgggaaggatctatatgtactgacatgaagtcataaaaattataaaaatcaaggtgcaaaatctgatgatttgatgccatgtgtgcaaaacattcttttatatgcatttcacaaaaaacaatattatgtatttctcattatccctaaaacaattctagaggattcatgacatgctgttacttgtctcaggtggacaaggattagaaatggtgaataaaaaaggttattttggcggggcacagtgacttatgcctgtaatcccagcactttgggaggccgaggtgggtggatcactggaggtcaggagttcgagaccagcctgaccaacatggtgaaaccccgtctctactaaaaatacaaaaaactagccaggcatggtggtgcgtgcctgtaatctagcgactcgggaggctgaggcaagagaattgcttgaacccgggaggcggaggttgcagtgttgcagtgagccgagattgcatcattgcattccagcgtgggcaacaagagtgaaactctgtctcaaaaaaaaaaaagaggttacttttgccaggcacagtggctcacacccgtaatcccagcactttcggaggacgaggtgggtagatcacttgaggtcaggagtttgagaccagcctggccaacatggtgaaaccccatctctactaaaagtacaaaaattagccaggtgtggtggcgtgcgcctgtaattccagttacttgggaggctgaggcaggagaattgcttgagccctagaggcggaggttgcagtgagccgagatcaagacactgcactccaggcccagagacagagagagaccccgtctcaaaaaaaaaaaaaagttatttttcacatggtagttcattaaaattttttaagtattaagctttatttatcaactgattaatattttttcctaatgaaacaaaattttactttttttaaaaagtctctttgtactattcaaatactgaatatacaaacattagctagtgaaggaatgaatactgagctgatagccaggcttacttgctagctgggtgactatctcacggaagtctagcaggatttgagatttcaatgagaaatattctgcaaaactttagagttgctgacaaaaggtaaaaaaaaaatgtgcttattaataaaataaggccaagtaatgaaaaatgtatttattaaatgaaggccagggaacactgtgtgaggcttcgtgggtgtgagtacttgctactggactgtcatttctcagttatacagagtgaaccagaggtagatagggaatagttattgtcagcaggatctatagaaatagcaacagtggtgaggagtagaaggatgttggatcaaataagatagtgcagataacaccatagaatgctagagccaaaaggatttaacacatacttttcttgataagaaataggagacaaataaaagttcaatgatttgctggaggtcacactgatatttagtggaagaacaaagacctagggcccttcaagagtagaaaatgttatacaaatgtcaaccgctaagcattgggggtatttattgatctttataatttagaggtaatgggctctgagcatcagaccatctgataactttagttcatcagattctcaaagtgttcatcactagaagaagctaaataactgcgttactctgaaaataaaaaatgaatattgagtctgttatacattctttgattttaggatgtaaaattccttttctacttctcacaggcagcactgagatctatgttgcaaagtaaattgggatagtattaaaaccatttgcctcaagggtttttttaataagtttcttgtgataatgtatgtgaatgccccaagtatatgtgacccatgggctggtctgtaggtgggacccactacatcggtgaatcatgctaagctcttaatgactcattgtaggtctctaaaataatggtatttacaaattcaagacacatctttcatgaatagcaaacgcttaccatacaatagcaaaatgaagataacaccaactgaactctctattttctgtttctgtttaacaccaactcaattgttcatttccccacgtggttgagagaggaacattaaataagtagcaatgttgggctggctggtggttctaaggatcacctagaaaatggaatgccagagattgtttagaaacagatctgagatactagataagatgaaaataacaatataagcacagtagtcttcgtaaccaagtcttatgtgattcagaaatcaataatctaaattacagagatcagtacctattacaggaaacagtcgatatcctctggggcagggttttacctctggtgtagcctcatataagtgaaaaagaaaggctaaacgtctttgacccccaattcccattcccttcacagaaaactagctaaatatctaaattgctaccattaaatcacattaaatattgctcttctgcactttctggtctggtgttgtaaaaagcagttggttgtgcatataagaatgagggaaatggaggctatcattgggacacaacgtatatcataacagtacgtgaagtgggtggagcgctaacctcagtgtttctgcaagggagtctggactgcccagagtgcatccgtgtcatcctgcatttggacatcatcaccaatttctttccaaggacccttgtgcccaaacaaaacttgcacacatcagatacatgctgccaatcctgaaaagtgaacatttaaaaccttaaaactgaatttgaatgtacctgatcaatgtaatcacgtttattctgttctcagctctgtgatgtgttctgtctaccaaaaggaagctctattgcagccattcaatggtaatcctgcttgtactcacagagtactactattctaagagcttggtaatatactgcacatttttctcttctcttttctcttctcttctcttcttctcttctctttctttttcttttgacggagtcttgctctgtcgcccaggctggagtgcagtggcaccatcttggctcattgcaacctccacctgccaggttcaagcaattctcctgcctcagccacctgagtagctgggattataggcacatgccaccatgcccagctaacttttgtatttttttttttttagtagagatggggtttcaccacattggccaggctggtcttgaactcccaaccttgtgatctgcccaccttggcctcccaaagtgctgggattacaagcgtgagccactgtgcctagcctgtactgcagattttctaaaatagtatagcctatgttaaaacttgtcctaatagacattataagattacttagacattgttttactttaaagactgtgtatggctttctcacaaccccagggccattactagtaagataagattttcatggaagacattaaaaatcatgttacactttaatagtgatattgtttcaatctttcatcacattaggtcatttccatttagaaaatttgatattcatatggaacctttttgtatcaaaaattatccacatgtgcttcaattttagaacttaactactttcatgcaagtagtttctcttaagtcagctaaggtaatcatgcatcttccttgattctttaagactcccctgccctgaaatatctcccctaaaagtctgacacaattatagaacaaaggatactatgtcttattaagaagtttaatctcatcgttattaataagtaaatatgtgatatggtttggctctgtgtcccctcccaaatctcatcttgtagctcccataattccacgtgttgtgggcaggacccggtgggagatgattgaatcatggggtgggtctttcctatgctgttcttgtgatagtgaatgggtttctgatggttttaaaatggggagttcccctgcacaagctctctctttgcctgttgccatccatgtaagatgtgacttgctcctccttgccttccactgtgattgtgaggcctccccagccatgtggaactgtaaggccaataagcttctttcttttgaaaattgcccagtctcggttatgtctttatcagcaatgtgaaaacagactaatacaatacgcatttttcttgagtatagaattaacctgttatatttttcctaacatagaggaggtagtctggagagatttgaaagaaacacagaggtacaattaatttattagccaagttcttcaggatctcctaagagagaaacagagagagaggtagtgcagtaaagcttccatctgatgcatagctagtgtgaggacacgtgcctagaggcagaaccagggaactgggaaataggaacatctgtattaattttgctgatgatctaccctgaacacatgctttatgttatgggttggctgtgtccccacccaaatctcttcttgaatgaattcccacgcattgtgggagggacctggtgggaggtgattggatcatgggggcaggtcttacctgtgctgttctcatgatagtgaatgagtctctcgagatctgatggttttaaaagggggagtttccccgcacaagctctctctttgcctgccaccatccatgtaagatgtgacttgctcttccttgccttctgccatgattgtgaggcctccccagccatgtggaactgtgagtccattaaacctctttttcttcccagtctcgggtatgtctttatcagcagtgtgaaaatggactaatacagtaaattggtaccagtagagtagggtgctgctgaaatacccaaaaatgtggaagcgactttggaactgggtaacaggcagaggttggaaaaatttggagggctcagaagaagacaggaaagtgtgggaaagtttggaactccctagagatttgttgaatggctttgccccaaatgctgatagcgatatagacaatgaagtccaggttgaggtggtcccagattaaatgaggaacttgtaggaactggagcaaaggtgactcttgttatgttttagcaaagacactggtgacattttgccccttccctagagatttgttgaactttgaacttgagagagatgatttagggtatctggcagaagaaatttctaagcagcaaagcattcaagaggtgacttaagtactgtcgaggcattcagttttaaaagggaagcagagcataaaagttcagaaaatttgtagcctgacaaaacaatagaaaagaaaaccctggttgggcatggtggctcacgcctgtaatccagcactttggaaggccgaggtggatggatcacgaggtcaggcattcgagaccagccctggccaacataatgaaaccccgtttctactaaaaatgcaaaaaattagccaggcgtggtggcaggtgcctgtaatcccagctactcaggaggctgaggcaggagaattgcttgaacacaggaggcagaggttacagtgagccgagatagcgccactgcactccagcccgggcaatggtgtgagactaggtctcaaaaaaaaaaaaaaaaattcccattttctgaggagaaattcaagctggctgcagaaatttcataagtaacgaggagccaaatgttaatccccaagacaatggggaatatatctccagggcatatcagaggtcttcatggcagaccctctcatcactggccaggaggcctaggaggaaaaagtggttttgtggaccagacccaggatccctgtgttgtgtgcagtctagggacttggtgccctgcttcccagatgctccagctgtgactgaaaggggccaaggtacagcttgggctattgcttcagatggtgaaagccccaagccctggcagcttccatgcggtgttgagccttcgggttcacagaagtcaagcattgaggtttgggaacttctacctagatttcaaagcatgtatggaaatacctggttgtccaggcagaagttggctgcaggggtggggctctcatgaagaacctctgctagggcaatgtgaaagggcaatgtggggtcggagcccccacacagagtccctactggggcactgcctagtggagctgtgaaaagagggccaccgtcctccagacctcagaatggtagatccactgacagcttgcactgtgcacctggaaaaaccacagacattcaacaccagcccatgaaaggagccaggagggaggctgtatcctgaagagccacagagccaggagggaggctgtatcctgaagagccacagggtgaagctgcccaaggccatgggaacctacctcttacgttaccgtgacctggatgtgagccatagactcaaaggaggtcattttggagcttaaagatctgagtgccctgctggattttggacttgcatggggcctgtagcccctttattttggctaatttctcccatttggaaaggctgtatttacccaatgcctgaacccctttgtatctaggaagtaactaacttgcttttgattttacaggctcataggtggaagggacttgccttgtcttgaatgagactttggactgtggacttttgaattaatgctgaaatgagttacaactttgggggactgctgggaaggcatgattggttttgaaatgtgaggacatgagatttgggaggggccagaggcagaatgatatggtttggctgtgtctccacctaaatctcattttgaattcccccatgttgtggcagggatctggtgggaggtgactggatcatggaggcaggtcttacctgtgctgttctcatgatagtgaatgagtctctcaagatctgatggttttaaaagggggagtttccctgcacaagctctctctttgcctgccaccatccatgtaagatgtgacctgctcctccttgccttcaccatgattgtgaggcctccccagccatgtggaactgtgagtccattaaacctctttttcttcccagttttgggtatgtctttatcagcagtgtgaaaacagagtaatacactttattacattttccttctacaaaatttacattttttataacaatagttttcatttgtatttctttttggatgacaaagacattttacagacattttatcattgaactctacaatattaagtgttagagcaagttttagctatttaacaataaggaaatggagcttcagcgacctgttgtagttaacatacataataagctgaataactgggtcatgtattctatgctatgttttcctgagttatgtaggtatcctgtataagaaaaaaaatctgtttcatgattctatgaaagtattttgataacttttgatatataagacttattagtatgggtatgcatcaaattttctttcagtatacaacaaaataaatttagtaaagtaagtataatgtaattcaaattcctataaacaacatttagtaaatatctaaaaggaagtatcagaaatactactaaagttaatacacacacctgcctacactcacacacggcacacattttcaaagatataaaagcacataattgaaaagtatgttttctggggccgggcgcagtgactcacgcctgtaatcccagcactttgggaggccgaggcaggcggatcacaaggtcaggagatcaagaccatcctggctaacacggtgaaactaaaaatacaaaaaattagccgggcgtggtggcgggcgcctgtagtcccagctacttgggaggctgaagcaggagaatggcatgaacctgggaggcggagcttgcagtgagctgagatcgagccatcgcactccaggctgggtgacagagtgagactccgtctcaaaaaaaaagtttgttttccacttgtgtgtggtagccaggtgaacagtccagccaaacagtgacacccctagagaagatattgagcatgatttctttctgttttccttttctttttttaacacaaatgatttcatcctacaggttggtttcagcctttcttttatcacttatctattcacacaaagataagcacatgtgcatgcacacacacttttttcttctctctctttattccacagcagcacagaaagagttaccatcgtctttttaatggccataaaaatatatcataattgatttgaccggttgaacatttaaagtatttgcaagtgaatcttgctgtgcagacatcatttagagtgtgtgtagtatgtccataggataaattcctagaagcaaaattattaggcaaaagaaatcatgcatttttaattttaagaaatattcctaaattgcttcagtggatagtatataaatctatatttccactagtaatgcatgactgcatgttttcctcacagtgccacccacacactgtgtcatcaacatttgtgaactgtattaacctgagagataaaatatgttatgtaattaagttttaatttgtaacttttcctttataagtgagattgaggtttcccccactttcatatggtcttcccgtttgttcaccagactattagtcttttcccagatgattcatgaaaactggacatgttaagaatatgaaccccttagctattaaaatggttgtaattttttccaagttttttttgtattgtttatggaattattttatatatagattttaatttttatgcaattaaacatgtttattttatatattggagcattttgtcatattacaaaatccttctccaattccaaactttaaaattcttttttcccaatttattttagccttatatcctgtatttaacatctgtaatttattttagggtaaagtgtgaggtatgtatctcactttatttcttttccagatggtaatttatttattacaatctatcttataaaataaatcacctcctctactgatttgaaatgccacttttattgtataataaatttctgcacattagcaatattttactgtttatcaaaactacatcataattcctatttgtatattgctctattgttctttctagttattgtcagtctaatattttgaactgttctctaaacatacccattacagaaatatagtcctgtttatttacatatgcatgtttgcacttatttatgatgtatgtactacataagagttggggatcaatatataccaaaataaattacattgttcctgtccacatcacaaagtttaagataaattaaaaagttaaagtatatatgaaactatatatgccttttgagtaaaaacaaggaaattctttttcaaaaagcaaataaacaagtttattattttagattcatttattgtagttaataccttatttcactccaagttttctaataacgaatgtaaagacgaaacatgttgacatctactgtgataaagaaagttcatttcctagcagttaattctaagtaggatgctgggcctatgcaagtggtgatgaatagcataaataagttagcttttccaaaaaattaaatgtttagaagtatcttcaggccaggcatggtggctcacacctgtaatcccagcactttgggaggtcgaggaggatggatcacgaggtgaggagatcaaggccatcctgactaacacagtgaaagcccatctctattaaaaacacaaaaaattagccaggcgtggtggcgggcgcctgtagtcccagctactcaggaggctgaggcaggagaatggcgtgaacccgggaggcagagcttgcagtgagctgagatcgtgccactgcattccagcctgggcgagagagtgagactctgtctcaaaaacaaacaaacagacaaacaaacaaacaaacgtatcttcaaatggacatttcaaatgtttcttctttttataagttgagaaagtaacacagaagcatcagtaaaatgtcttcaggcaacaacgtagcatcatgttggtatgtcacttactggaaagaagattatatatcttttagactcttcccaaaattaaaaaaaatgcacctgtcaaatatgaaatactggtaaagttcaaagaatccgtaatgtttgtggatgattaaaaatgtgaaaactgtgacagattctttctcagtcagagtaatttgatttctgcagagcgggctatagaccggtcttcgggtactttctcaaagattaactgaattttcttaaacaaatatttaatttgattaccagaatatgaaagaaaaaaattttgtctaacaactctttctgaagtttgccaatagctttcttttactgccaatacgacttttctgaagcatttcattatcagttgatctttgtcttcttaagtcagttaatgatacgacacgaacaaaatatattatcatgcaggtaaataaaaactgtcctgttggaaaacttagtgtttcctatttaaatttcagaaaaattcagctttttttgtggttgatattcaatgcacaggcattagaaaaagggtctattgtgtctgaggttttttctggttttaagtgataaagccatctttggcatgaaggatacttggttctcattttcagtagaaagtggcatgcatcccagttacccaatagttatcctaaagcactgaactaaacttaagacataaaaaatgtaagtacattcttttgaacgtgattgagaattggaattttatttgtcaaaatattttacatatgcttattctggctgccatattatgatgcttactgtgtaaaagcttttgtggtattgtatcttactgagatagtatagttttttgatagatgatttctattcgtggactcaaagcctcataattatattatatatgttaggaaggattttccttattttcctggtgacatgaaaaatctatgtaagtgatttataaggagatatctgcacagagatctgtatgttcctttataaattattaatatagagatttaatttaaacattattatgacagttagccaatagtgatattttgagggaatattctatagactcatgagtttgttattctgtgacaataggttttcaccttttaaaataaaaaactatactcacattcccctctgagagaactctataggccgggtgcggtggctcatgcctgtaatcccagcactttggcagcccgaggtgggcggatcataaggtcaagagatcgagaccatgctggccaacatggtgaaacactgcttctactaaaaatacaaaaatgagctgggcatggtggcaggcgcctgtagtcccagctactcgggaggcggaggcaggagaatcacttgaacctgggaggtggacggtgcagtcagccaagattgtgccactgcacttcagcctggctacagggtgagactttgaaaaaaaacaaacaaaaaaaaaaccaaaagaaagaaagaaagtgagagagagagagagaaagaaagaaaggaaagggaaagaaaagaaaggaaagaaaagagaaagaaagaactctatctgtgcagttaaatgagagaaagaacacatagtttagaggacttttatagagaaagaacacatagtttagaggacttttatagagaaagaacacatagtttagaggacttttatagagaaagaacacatagtttagaggacttttatagagaaagaacacataggttagaggacttttatagagaaagaacacatagtttagaggacttttataggacagacccccaaatattcttgcagtgctaggcctcttgggagatattggtaaaatgaaataattatttaaaatctatgaaataaatgtaaatctttaggataagttgaagcatgtaaataagtcttgacatagagtaaaagagaggagtgagatttgtatgtgaatataagattcagatttttaaaattttaatttagtcatctaaatggtctcctgtactgattatactcagctacttaaaatgagtaattctacccgcaaaggtagctagtctctataattgacttaaatgatgtacttttaatcaatatttcaatttcatttgatgcccttgaaatgatgtggaaaataaaaggaaaactagaacattaagtccacatggagcaatataggaaaaaccaaataaaagatttcgaatgcccttttatgtaattaattgctttcaaagaagcaaattccaaatgtcagagatatataaatggatattcaagataatgtttatttttgttcctatttttatgtattacaaatagaggtaatatttaaaacaacaaaaggggtaaaatttaaaaatttagaaaaatatagactactgaagagtaactgccaatggcatgtcttattaatgagaattcttccctagggcttttaatttgaggtggagagagcagaagcagcgggcacggggcagcttctctctaaggtcacatgctgtggtgcaacactgatttaaagttgtctgcctcagatccacatcaagatggttagctactagtacagaggaactttactaggtaggattttctttctttctttctttctttttttttttttagaaaaagtttccttcttgttgcccaggctagagtgcaatggtgcaatctcggctcactgcaacctcagcctcccaggttcaagcaattctcctgcctcaccctccctagtagctgggattaccagtgtgcaccaccatgcccatgtaatttttgtatttttagtagacagggtttcggcatgttggccaggctggtctcaaactcctgaccttgtgacccacccgccttggcctcccaaagtgctgggattagaggtgtaagccacggcaccaggcctactaggtaggattttcttagccatgatatgaagcatctttcccctgcttcctggtcacatgcttctgtaagcacaaggcctctgacctttctccaaaggtgcagctagtagcccccgcttgctgccaagcgagtccacaggctctatttgacgtccagttagatctgatctttgaaataaaataagtaagctattggaaatcagtaaaaatatcaactagagtctgggcgcagtggctcatgcctgtaatcccagcactttgggaggccgaggcaggcggatcacgaggtcaggagatcgagaccatcctggctaacatggtgaaacctgtctctactaaaaatacaaaaaaaatagccaggcatggtggtgggcgcctgtagtcccagctactcgggaggctgaggcaggagaatggcgtgaacccgggaggtggagcttgcagtgagccaagattgcaccactgcactccggcctgggagacagagtgagactccgtcagaaaaaaaaaaaaaaaaaagaaaagaaagaaaacataaaagtagtaaatatccctaaaactttaattatactttgaatatgaatatttgggcatagttttttaaaaactgcaaatctgtccaagtaaaagattgtttttctgggtgatttagggataattaccttttttaaaatcatggtctgttttatgtgtttccaagagcatgcactttggtaattaaatgtggtagtagggatgtttgaatggaaaccagaaagatattttcataattaataattagtttataaaaatcactagcattcctgtacaccaccgacaaccaaactgagagccacatcagaaagataatttgccaccacacagaaaaaataaaataaaataaaataaaataaaataaaataaaataaaaaagacctgggaatgcagctaaccaaggaggggaaagatgtctacaatgagaattatgaaacactgctcaaagaagttagagaagacacaaacaaatggagaaacattccatgctcgtggataggaagattcaatataaataaaatagctatgctggacaaagcaatttacagattcaatgctattcctatcaaactatcagcgacatacttcacagaactagaaaaaattatttaaagatttatatggaaccaaaaaagagcccaaagagccaaggcaattctaagcaaaaagaataaagctggagaaatcatgttacctgacttcaaactatactacaaggctgcagtggccaaagcagaatggtactggtacaaaaacaggcacatagaccaatggaaccgaatagaaaccccagaaatacagccacacacctatgaccatctgacctttgacaaagctgacaaaaataagcaatagggaaaagactcccttttcaataaatggtgctgggataacttactagccatatgcagaaaattgaagctggactctttctttacaaaaatcagctcaagatggattaaagatctaaaactataaaaaccctgggaaacaacctaggtaataccatcctggacataggaacgggcaaagatttcataacaaagacaccaaaagcaatcacaacaaaagtaaaaattgactaacgggatctaattaaacgtaagagtttctgcacagcaaaataaatgatcaacagtgtaaacagacaacttacagaatgggagaaaatatttgtaaattatgcatctgacaaaggtctgatatccaccatctataagtaacttaaacacatttacaggagaaaaatcaaacaacctgattcaacagagggcaaaggacaggaacagacatacatgcagccaacaagcatgtgaaaaaaagctcagtatcactgaccattaaagaaatgcaaaacaaaaccccaatgagtaccatctcgcaccagtctgaatggctgttattagaaagtcaaaaaataacagctggtgaggttgtgaaggaaagggaacacttaaacactgttggtggaagtgtaaattagttcggccattgtagaagacagtgtggcgattcctcaaagacccgaagtcagaaataccattagacccagcaatcccattactgggtgtgtacccagaggagtgtaaagcattctacctaaaattcacatgcacgtgaatgctcattgcagcactattcacaatagcaaagacaaggaatcaacctcaatgcccaccagtgacagactggatcgagaaaatgtggtacatatagactatggaatactatgcagccagaaaaagaatgaggccatttcttttgtgagaacgttatggagctggaggctatcatccttagcaaactaatacatgaatagaaaatgaagtccaggtgcggtggctcacgcttgtaatcccagaactttgggaggacgaggcgggcagatcacttgaggtcaggagtttgagaccagcctggccaacatggtgaaaccccatctctactaaaaataaaaaaaaaaaaaaattagccaggcgtggtggtgcatgcctgtagtcccagctactcgggaggctgaggcaggagaattgcttgaatccaggaggcagaggttgtagtgagctgagattgcaccactgcactccagcaggggtgacagagcgagattccgtctcagaaaaaaaaaaattagaaaaccaaataccacatgttctcacttataagtgggagctacgtgataagaacttatgaacacgaaggaaacaacagatactggggactgcttgaggggggagggtgagaggagggagaggagcagaaaagatcactgttgggtattgagcttaatacctgggtgatgtaataatatgtacaacaaacccccatgtcacatgtttatctatgtaacaaaccttcatatgtacccccaaacctaaaataaaaactatgaaaagaaaaaataaaaaaataaaatctggggaatttgagttggcaaagcctctgaagttttagctattgtgctctagtctgtttcactacaccccacaaataaaaatttaatttgcaatactggaaaaagtcttttatgtaaaggatagatatgttagattttttaaatatgctaaattaagttctcctcttattccagttcaccttgctattgtaaatctatgtttaaataaaagtcatcttcaaacaatattaaccaagttgcctgaagtccaccccttaataatctgagctaattaatcattcttcttggtcacttcctgaaatctctatttcaagacatgtacattctagatgaaatgtattaaaaagacacacggaagtgaaatgctttgaaagcaggtacattttgcttccccagcctgtaagatgtcagagattatgtgttatttctatgtatactttgtcctgatgaaaataaaattttatttgtacctagtattttataatttgaataaaggattataatcaatattcttctcttctttgcttctcttagctgatggccctttttttcagcagttaattaaagtttgaatagctgtcacttgtgactaacttctgtggcgtttcctttgcctgcacctcagacatcatctccttccattcatttcttctcaaattgcgtacacaagtgctctacaaaatcatctacagtcaaatcccagagaagtagtaataagagccattgtagacaggaggaagtgtgttaggaaacaagaaggtagatctggagccagtatagactgcagccaggaccgcatgttccttagggcaatggaaagaagaggagataaatgctgtaagaagatgatatagaaaatttaaaaactgttatacactgttcaaatctcatcaaaggcatcaaagaggatcccattaaaaacactcttgagagcagctgagcgctgacgctttgctgcttagaatgcagggccaagggagatatgaggtcgggagggtttaggtgtgcacctgagcattcagagtaaagagaaatgagcactgggaaaagctaaaaggaggcagcctgagggggccagcaggaggccggccggccggccgggatggcaggccaccttcagcaggtcagccttcaccctggcaggcagatctaacgcggatttgggaaaaagagacactctcagtccctccagattctgggatggtttggtctctggctctgaggttcccaggtgaaactgatgctgctgcaccttgccgtgatgcagtgttactcatggccaagagcagaacttcagatgggagagggctgactctggcttctgctattcacagccatagtgtatgggaaagtcaaagaggcttcatcattcagtaacaaaaacaaatttcagtcacgtgaggaaaactaaactgagctttatgaactttcctttcccctgtcttactttgatgtcattttgtcttgtaatgcaaatatagatatgtttaatccatatttacctttctaattaataaacagctagttttatatagataaaagctttcaaattttattcaaaggaggttttctcagagtgctgattttcattgttcatcaggcaggtacatcatttagtggaaaccaagtaaaattgtatccatgagtccaagcacagtcctccagtattttgtaggattcatctaaagacttaagtttaacattcatgtaattccctctaggatgtacagttcctcagtctcacagaattagcccagtacctgctcttctgggtgctaggatgccatagacaccctgtagttcctttatccaaatcccattacacttcaggtttgggattctaattcattaaggaactgaggccttttcatgtagtatttgtataaatgctgagctctcaatatggaagaagaaacaggaaaggaagaaagaggggtggggaggaaaaggaataggaggaggagaagaaggaataggaggaggatgagaattaggaggaataggaacggggggcggggcgaggaataggaggaggattaggaagaggaggaaatttgcatatggctttaagtcccttaagcttctggttaagtggctcatctacacaaaccccatctcatgatcccgtgacataggagctatttcctctcatcactactgattgtcctccatgttccctttgacttatctttcatggccacatgaccccatccccaccctctaaatccaatccagtggacctccacactctgctgcccagccctcttggtgatttctgagctcttttgctgtaaacacaagtggacagtcatctgaggcagcgttctttactatctgcactctccagagcacagttgagcctgagttccaccccagcacatctcaacctcagttgatttcagaacctttcaatcatttctgtgacatttctgaatttcctgacttcaccaatgccaggaggataaccctccgaatcaaatcgaagatcatttcattgtaaagttcctcctatattgacatttctggggaactatgacaaactcaaggcctcggagggccctagactccatttcattaaatacaatttttgaatgggtatcagggaccttgacctcaggaaataacttgggcaccatttatgtcaacataggggtcatcaacgttgctatgatgtttcctttgggttcatttaaccctatttaaccacatatttcaacaacagaaagatttaaactcagagcaaggtggtcaacagcacacatctattatgtaccatttacagactcctgaagacctgttgttctctctctaccatttggtctcttgccatatttcttcaggtttattagtgatttatctctttttgttaggtattttcctggtccaacattattttataattcaaatattagggcacagaaacaaaaatagaatgtgggtttgaatacacatgaaatacctacatctatgtcatacatatacacatacactaaaatagtttgcaatgggtatagaaattagaagggggataatataaagtaaacttaaacagcttcagaattttgccagaaaccagccctgaacttaacgataaccccatctcagtagaaagaagagaggctgagtaaaggcatgtttactcggaaatgagttccccagcgtgaaactcaagagtgaggagagagaacttttagaatttgccacacacctgctttctgttgcatattaaccacacggtgcactttccactggctgcttgaacaggcacgtcatgtgtgaatgaagtgggtcaaggtcagaaaaatagcgattgttggtgtatgtgataaattgatgtgtacttgccctgggtcagtcactactcacctgcagaagattcctgccttataggaagtaaaatctgtattgctgaatctcacacatttccagaaaaagccaggaagtgtggctactacaggaaatttcctaatttttaaatatgaaatgattcaaacatactgtagaaaaaaactatacaatgtacagtaaccacgcaatagaaatacatctgatgaatggatttggctcatgggccgccagcttgtgacttctgatcaatgttttgaaattatccctgggagacatggggaagaaagattcaatctgtaaggagccacatgcagttttgtgagacaatttgcagacttcaaagtgactgagtcagagtatgtacataaaacgtggcccaagggagaacagaaatctaaaatgaaacacattaaggttaatactggccgggcgcagtggctcatgcctgtaatcccagcactttggggaccgagtcaggaggattacttgaagacaggagatcgagaccaacctgggcaacatcatgagacccatttctacaaaacaaatggaaaaatagttactacccataggaatgaaaagtcactcatttgctatcacacagacatacacatgtatgatagccaactaccggattaaatcaggcagtcagaaagagaaaacaaaaagaaaaggaggcaaaaatacaacagaaaaacatgaaatttaatctttcaatttcgaactttttatcagacaaggactagaaacccaatgaagatgacaaaaaaaaaaaagacaaaattgctttcctatgtatcaagctcaggtgtaattatagttccacactaaactgcaggcttcatacaaggacttgccacaactcttagttttagtaccggctgtaatttatgttgtgtttagataaattcctgagctctctgtacctaattttttttaattagtgaaaaaacacagaaatagcttacatgcttgctttaagaaatagataaatagaatattatatttttaaacctcattatgcctaagtatttaatatctactggtgattttattcttggcgagcatagcaggggccatatgagaaatgtaaatatggttattgacctgttgtgctggtgacaagatgagtcttttctctaggagactggattagcttggctgaaaatattcgttgcataccaaattagactatacattgtatttctgtcactgaatgttttccttagttgttttgtgagtaaaataaattggatgtatgttcaatgtatataattcaggcaccttatttcaaaagtaattaatgtcttactcacttgagaccagataattacagttaatgtcatcttaaaggagcccccaggactgttagccattggtaaacgcataagaattggaataaattgactttcatgatcactgaagcttcgttgggagaactaggagcagagaaaagaatgataaatcaaaaattcgtctcctaagactgatgaagataacatatatattttttcatttactcttagacaacccttacaagatttttgcccagcgaaagtggcacgtggaacatggaatgacatttcataaagataaatccagagattagtgctgaagactacacccctgtgtagtcccacacaggctaccccagaccagcctggcgggctctgcactaggcctcccatcaggcgagagccaacgctcctcagcccggctccacctcattcagaagaaagtgtgtctcccggcctcacattgcgctgaatgcaaggataccgagataaaccaggctttccttcgctcagagtacagttgcagacttggtaatgactgagccaagccagactgactgtgataagataataaattaactaccagtcaggagctaagtcagcagatgtgcgaacattttagaggtaacatcataaactagaacagaggagctcttgggaagaaaaagggcttggaaattatacctggaaagataccgctaataatgatcaagaagaaaaaacaaatccagtttggaagtgagcaatcatttatgatgtaaaatatttcttagaaatggaatctagataatgcttggaatatgctttaaactacctatatttaatttgtttttcttgtgatttttgtattgtttggtgtaaaataatcttaatctttccaggtggtgtctaattaaggcacatttactgatatgagtcattttctaaatatactttatctaagaaaatttaaaatttttggatcaactaaaaactctctcaattattttagagttaactcttccaaattctaaaatgtattcataaattatatacaactattttaatggtcactgtgggcccaacttctgtatataaatttaccttcttattttacaggtgctaatgtttaaagatacttaaatatgccaatttctttcctctatgtagaagtttgaaatacattctatgccctgagagaaccctttgaaatttgaacacatagagtattgttatgtgctttcaaaactttgtgttgtataggaccctcttttagctgaatatttttcaagcagtaagcctgtcctgcatcgcacatgtactgggacacccatggacaaaatcataagactctgtcttcctgacagatttccctcctctcctggggaattctctaatgatgtcactctttttttgtgccctgtatggtttttttttttcagtttcttctgtgtgatgcacgtgatgctgttacactgcagggtagcgtttttaaaaaatctgatttacagtttgtcctactattatatattttgcttataaaaaccttgtgttttttcaaaaattcctaacagacttatttaggtctaactgacctaaaataaaccacacatggtacagtgtacagtttgatgggcttcgacataagcacatataatgggttgaattatgtccctcacgagatatgttaaagtcctaaaccctgtttctcatttgcgaatagggcctttatttggaaatagggtcattgcaggtataattagctaagatgaggttgtagtggagtggagtgggcccttaatccccttaatcctaaatgaggggtgtcatcataagaaagacactggcaaacagatacagacacagagggaagaacgccacatgacaaggaggcagggggtggagtgatgctgccacacgtcaagaagaacctgcggccaccagagttagaagaggcaagaaaggattctctcgtggaggcctcggactggcatcgccttgccaacaacgctgatggtgggcttccagcctccagaattgtaaggcaataaattcatgttgttttaagccaaccagtttgtggtgaaatagccccaggaaacggatccaatctacaatcatgaaaccatctgaaaataaaaatagcaaacatatccctcacctcaacaagtttcctgaaggccctcccatcacacagtcccaagtcccacctccttcctcaggaaaccactgaactcttttgtcactatagaccgtattttgtagaattaatataaattttacataaatttatataaatccccaaattatagaaaatatatttactgtatacatgcggtatatactggctgctttcagcataattatttggaggtttattcatcattcttttgaacattcatttttttgctcctttgtttagctaagtagtactcccttgatatatcacaatttgtttatccattcacctgtttatggacattttagttgtttccaacttttggctatcacgaatgcatctgctgtatgtgcacatatacatgtacaactatttgaacagagatacacttttgtttctcttggtagacacctaattgtggaacagctgagtcctgtaacaggcatatgtttaacttttaaagaaactgccaaaccactttctaaagtaaacatactatgtacaatctcactagcagaatataggagttccagttcctccacatcttcatcaacagttcgtatgattacgctttgaaattttttcctttctaataggtatgtagtagtgtctcattgtggttttttatttacatttccctaatgactaataatactaaatgtctttcataggcttatttgtcatggcatgcctctggcataccatctgttcagatcttttgtctattgtctaatttttatgggtttgatcttatcaatttttgaagattattctggatacaatgaatttgttagatatatgattcctatttttcatggtctgtggtttatcttttctttctcttaacgatattcttgaagagcaggtgttcttatttttacgaaatttcttttatcactattttcttctatggattgtgtttttctatgaagcaacctttctaacccaaagtaataaagtttctgttatacagcttattctagaagtttgatagttttaggctttaccttggttctatagtcctttctgaattaactttcacatgttatgttaggtataaagtctttttggtttgtttgcttttgcttttgtatattggtatccagttgttctagtactagttaaaaatactatttttctttattaagctgcctttgtacatttataaaagatgaattgatcatatatgtgtaggtctgtttctaaactttctcttctattttattgatgtatttgttggtcttgaggcaaatatcacattgtcttgattattgtacctttataatgattattgattgctatacgtgcaagatcctcaactttgttgttttgcaaagttgttttgactaccttgggaactttgcatttttctagtaaccctgttttgatatagattattttgaatagggaatgttttgacttaaaaataatatcaaacttttataattaagatataagtagtgtgaaaggagagaaacatcttcattctatcattcagcccctttcaggaacctcatccaacctcaccactctaggctatcagagttagcacattacatctctatacagacatgcattcgttaatgatgaggatatgttctgagaaatgcattattaggcaattttgttggtgaacatcacagagtgtacttacacagacctagctggtgtagcccatcagttaccttggcaatatggtatagacgattgttcctgggctgcaaacatgtacagcaggttactgcactgaataccgcaggcaattgtaatacaatgataagtatttgtgtatttaaacgtagaaaaggtacagtacaaatttgatataaaagattaaaaaacagaagacctgcttaagcccattctgttacaatcttatgggaccagcattgtatatgcagagtccatcgtggaccgaaatgtcactgtgtggagcacaactgtatctccatccatactgacacacacacgccttctgaaacccatgcctacaaccatattggtatctgtatattggtgctttatagtataaaatataccctcttgaggctgagcctcagtaaatactcatgcttagccactgtcagcctgcttcttcctctaatctccaaaatgaagtaagttcattgacagcactggagatgcctgcattgctggatttacactctattttattattaaagaaagggtttttttctccctaaagatatccctatttctattaatcttttctggctcattatttttctttgataggcatagagggcagtatggtggaagtattctgcctgtctgtgagtattttaaaaaatggaaaatgttggaaatcaatttcttgtgcatttactttttcttaaatactattactgtttcctttccaatcttagactgctgaattctgaataaatctctcacctttgtggttttcttgaagtagaccttaatttgaattttttttttttttttttgacagagtctcacactgttgcccaggcgggagtgcagtggcacaatctcggctcactgaaacctccacctcccaggttcaagcgattctcctgcctcagcctcttgagtaactgggattacaggtgcccgccaccatgcccggctaattttttgtatttttagtagagatggggtttcactatgttggccaggctggtctcgaacacctgacctcatgatccatctgcctcagctcccaaagtgctgggattacaggtgtgagccactgcacccagccgaaatattttcttttctttttctttctttccttctttttaaaaaaattctgtagctgatccctgatggcttttaatttgaataaaactttatttaaagaaagtgtttattcattgatacgaatcacacagagtataatttcaagcccattaccatgaagatattttcctatgttttactccagaatttttaattattttatctttcaaatttagatctatattccagctagaattgtgtgtgtgtgtgtgtgtgtgtgtgatgtgaaggtcaaagtttatttttctttttttacatataaatatgtaattgatccagcaccacttaatgaaaagactactcttttcagccactctcaggtggtacctacgtcgtgacccaagtgactgagtatcgagtcggtctggttttcaactttctattcagttcggttgctctgtagttccccccttgatggtttacattgtctgtgaatattgacagttatagttcttactttaccattcttttaaggaatcatttgaaaaattcacatattggtgaagccatacaggcttagagttttctttgtggcaagtttcctaatgacagatttaatttctttaatagatacaatatattccaaatagatttttttcaatgagttttggtaagctatatttttctaggaatttgacaatttcttctaaattttgaaatatattggtatataggtcaaaaaattgtatgtctttatctttttaatatatgtaatgtctgttgggatgtacctttttaaaaatttcttatattattcatttctcttttctggcctgatcctagcaattgttatagggagtttataaaaattattcgtctttttagggaaataaatttttgctttttaatttttctactatatgtttgttacttcatcaaatttaaattaaatttttttggattaacctacatttccttcttcccatttttattaggattagtttgttcttatttttccaactactttagaacattctttagcttttcctctttgctaatatgtagatatacatttgtttctttcttcctttcttttttttgagacggagtctggctctgtcacccaggctggagtgcagtggtgggatctcagctcactgcaagctccgcctcccaggttcacgccattctcctgcctcagcctcctgagtagcttggactacaggcgcccaccaccacgcctggataatattttttgtatttttagtagagacaggggtttcaccctgttagccaggatggtcttgatcccctgaccttgtgatccacccaccttggcctcccgaagtgctgggattacaggcgtgagccaccgtgcccgggcccccatatagatatacatttctctaagcagttttacctgcctctctaaaattttgagatgtatttttattaaattcagtttaaaagattttctgatttttcattgagttgtctttctttactagtgcgttatttttaaatacattgcttaattttcaaacatattgacatattccaatcactttttcattattgctttccagtgtaactacaccatggtcaggagaacagattccaaattattgtagtatttcaaacttgttgagacttgctttatagctaagtttaaaatacattttggaaaatgctccgtgtaaatttcaatagaatctgagtgtgcttctatgctgtactatagtacttcccaggcatccttcaggtcaggtttctcctcaacctaatggatcttctgtatacttactggtctatatgattgcagaattttttctatttggtctactaattatgaaaaatgtgttttaaaatctattattatacatacattcatttctccttttacttttgtcattctgttttgtatatacagtcatgctccaaataacatttctttcaacaacagactgcatattcaacggtggcctcctaaggttacagtggagctgaacaactcctatagcctattgctgtctgagccttcataatgtcagagtgcggtgcattttaccttttctatgtttagctatgatcagatacacaaatacttactgttgcattacagttgcctagagcaggggtgtacaatcttttggcttccctgggacacattggaagaagaattgtcttgggccacacataagatacgccagcactaacaacagctgatgagctaaaaaaaaaattgcaaaaaattctaataacattataagaaagtttatgaatttgtgttgggctgcattcaaagtcatcttaggctgggtcacgggttggacaagcttggcctagggtagtcagtggagtagcatgctttctaggtgttgcctaggaatagtaggctgtaccatttagcccaggtgtgtagtaggttatgccatctaggtttgtgtcagtgcactctgtgatgtttgcacaacaatacatgtgcctgatgatgcatctcacaggatatgttcccactgttaagccaaacaccactgtatttgaaagttttgttgttaggtgtatacaagtttagaatttttctttctgaagaattgactctttcagtaggaaatgtctctttctagctctgatgattcttcttgccttaaaatctgtcttgtttggtcttgtcataatgcacaaaaattcttttggatagtacttaaacaaaatttttctcatctttaatttttagcactttaatggttttctatgtttatgtctgggattattttgcttctacttaaaggactccctcctttagtatttattttaatgcagatctagtggtggtgaatactctttattttaatttttttaggagtatctttatttaacctttgaaagggtttcactgaacacagaattttctatgggtaattatgttgtttaaagaagtcattgccatttcttccatttctgtggagaattcaactatcagtcttactgtaagtcttttggattgcagctgagaaaacctgttgttatttatatgatcactcacttgactaccaagatataacaaaactactgaaaggaaggaaaagtttgaagtgagaagaaaataaaagatgaataaaattacattacaataagcttagctacaattatggagagaaaaactagaatacagctgataaaacaagtaagtggcaccctattttgggtaaagttagtagtccaactgaaatctgattattagctgacaaaacaggtaatactccactgtcacttaatttgccataatattttagaaaatgccctttagtagaaagttatcatttcatgtttgcattagttgccacagatatataaacatgatattaggtaagactgcctaaaatcttctcccctgtatttttatggtaattatataatatagagcatgtgatgctctctgaccatatattgtgaatggtttttgctcttatagcagaatttaaagccagcacaaggacatatttggtgtaagaaatgtaataagacttgtggtcaaagttatgaatatttaaatgacattatatatacaaagaaaattatgctgttatttggtttcagtaaaatccagcataaaaattaattttgactcacacccaaatcctaaaatgtaaggggaactatttttaataatatgtatatttgggaaaataattgatttattaattggccaaatatttattgtgacaagccattttctttcattatagtttatttggtaagatgttttcttaaagagcctatgatgaatatttataatataactcaataaaaatgaacattagtttgtcttgcagggaagctatgacacgtatggatattacacaaaaatacaagccttaaggaaataggggatttggtccaccttgttctctgtggtatctctagcattcagattaaggcttatctcatagttaatgttcagacatacatgttaagtaaatgaattattatttttttaaatttgattttgtaacatctgaagtatgaagattataataatcagcattaaaatctggtttggagagacctgtattagaggtgtgtaaacattggtctcctttatttgctattaacatgtatatagtcagtgttgaatttaaaatgatgtaaatcttgagtgttcgctgaggttgactaccagtattttcaggagatcaccatgtggtatgatctgagatgtcttcagacctactttgctctaaaaagttatttacactttgcaatgtttgttaaactaccaagatctgtatattttcactatgtttgtgaagatgacagtttgaaaataagaagatgaaaaacaatatattacatatgtatgtttgggagacaaagataaccccaagtttagaaatgtgaggcaggcctatatttctctccaatagtattttatgattgtctccaattcctgcttggtttgaagtcccttaacgcagaataatttggtcagcagaatgatttagttagacagtaatgacactcttactccagacatatttaataaatgccatgtcttctactgtcttggcacaatatgagaatgtctgagtggtataaggtgcataaagtagtctgtttttatggggatcacaattttgttttctgcaaggaaaaatgaaagatatccacacttggttaaaaatgtattagaaatctgactctgaaaccacacagcaggattatgtgcttcggatccatatcttgacctactttcctaaaaatgtccaagttggtaaaactagatagttctgttatcttgtgaggctttcctgacgcactagttttgggttaagataatgatattactgttggaaaagagaagagtgattttttttttcctcttagaaattgtttttcattttatgtgttagctttctctctctattgggtgaaatgtccttgaggacagtgataaaggtttactctgtttataaaaccagtagtcaggcagctatgactgtgcgaaactctggacaggttattcaccagcttcagaagtggacttgtcctcccacctgatgattgatattggttaatctgtatccatctgtctgttggtctctctatccattcatccattccaggcattctataccataatatagatagataccatataccatgtaccataataccataccaaaatatagatagaaatgtaccataatataccataatatagatagaaatgtacttcaacatttctggatttattgttaaatttggtatgttattccttgaatactctgaacaaaataatagtaggttttatataaatagtagagactcattattatagctcattagataaataaaccttttaggttctattataaaataaatgtttcagtttctattcacaatgattaattcattcaaataaattataaagaaaaagatgagtttcttttacaaacacagttagaatcaaaattcaagtgctaagctgataacattctcattaatagcaataaagcctacagcacttattcaacccgaaaaataattgacttatcccagaaaggcttttatttgtagagtttaaatgtctcttctcataaccagcaacttgtacctcatataattactcagataaagaggctttcgattttcttgtataaaagaaaacactacagactatttaaaacaaacaagtggccgggcacagtggctcactcctgtaatcccagtcctttaggaggctgaggcaggttgatcacaaggtcaggagtttgagaccagcctggccaatatggtgaaaccccatctctactaaaaatacaaaaattagccaggcatggtggcacacacctgtagtcccagctacttgggaggctgaggcaggagaattgcttgaacccaggagtcagaggtcacagtgagctgaaatcacaccactgactccagcctgggcgacagagcaagactctgtctcaaaaaacaaaacaaaacaaagcaaacaagtaccaccaatataatactttatagtgaggatttcaaggcagcctatgttcctaatgatatagagttccagggagggaaataaatccaaggtctttacatataaccatggaatgaggatgtgcaagagaacacctgaaagaaaatcagatttcctataactgaaaacaacaacgacaagaacaacaatacccagcttctcaaatggttaattcacgtatggtaaagagcagagaatggaaaggtgctgatcacaaaacagttactaacactcccctcaccctccaaaaaaggtggtaatttatatttatcaggcagttatggaagtttcttaaaaagcaaggttatttttccttgcattatttacactgcaatatattttttaaatttatggaatgatgaatctgtttacaaaaaatgttttttatcacacgtaggatatttatagtgaaatgaaaatgaataaatcttgatagaattgagacactaaagatattttaaaaatcaataaatttctaagagataattatgtggtttgtatgataacataacctttaattattctcattttttctttttttttcagaccactcaatctctggctactccttaaacatgtgtctgtatctacagttttgctgatatagtactgtcagcctgcattttccaccatgtagtttattctaatacatacaagtgcccagtggctttcattacttctgttccatgtactctcaaattcaacatgtttaaaattgagctcactctgcctctggctatgcttccccagaggtggatggcaacagattccatccattcatccaaacttggaacctgagatttacctttgatctcaaattatacctgtttccccttatccaaacactaacccagtgtacacagatttttacctccttagtttttcttaacttttctttctttccatcattactgctgctttgctaatacaggccctcactaaatctagcattctgcctctagtcttattttctccaaatccattttccaaagaagtcttatgtatcaattcagtctcatgatatgactctgaagtgttttttttcaatggctctagattttcttcaaaattaacttccaatcttccttacctcgtgtgtgagagaagaaactggcacacccctttccttatctgcaagcaaaggtggggacgggaagaagttttaactttaaatcaaacaggaaattttgattatgttatatcatttgaataattaactgaaagaactgactgggaaaatcaggaggtctatctgagtttcagttatccccagaggaagaactaggcccaccaggtaaatgtgaggactcatgagcagtgaagaggctgtgtgatactttcatcccaagtgtggctggttcaatatgccagttacgtttgtgattttctatactcaatactgtttctgtacttcaggttcacagggtcctgtttgtgttgtttattctaatgctctctccttaatttcgaatgtgtcatctcattctcctgccttaattggataatcactcttcatcctttaacacagaaatagtcacctcactagttcagatcttggtttgtattctgcgtctttgtttgtctcatgtcttttgactgatgcttgccatcttacttacaatactgggttttagtcatgtttttcagtctgactgtcccatggtccatgaatgccttaaactcagggaatgtgtctcattcatctttgttattttcagagctgagaactgggtctgaaatgttagataatctgtaaacaaaatgaatgaaatgatgttgcagaggagagacatgtgggatagtcatcaacagtaacagagaggtggtcatgattattttccagatggctggggagctccaccttggaaggtccatctctaatggcaaaagactttttaacagggcttcctgaggacataaagagcccaattgttgttgaaatcgcatggaaagttcagcaagtgtagtatcgttgggatgctttgaattgcactctttgtctgttagaagctgaactgggcatccaggagttacaaagaacaaaaatatggcacctgtgctttggaacaactttgtagccacctgtcacttttggggaataatcgtcttctgagaagatatgttttattcctgagatacagagaacacagggaattctctcaattgcttaataataaaactaaaacaaaagtcttcttactctcaaccagactcatttggtctaagggaaagaaaatgactctcccgtgcttcatatgtgataaaatagcactgagttaactgttgtattgattcaatacacaaatagaaaatagaatgatttggctacagacaattcaagtatgaagattgcagttcctcttataaaggaagatgtcttgatactggttttaagtatttcttttaagaaaactctataaaaaccctgttttttggccaatattaaaaaaaggaaaaatactataaaattagtagcatatgtttcttttttcttttgaaaagctaccccagactagaagatgacttttagtaacactgtggctgtatatttatgtgtgtgtgtgtatgcacacatttttctatcaagaactatctctttacttttctattttcttatgctaccctttatttagttacttattttgaactttataagactacctgaagttttaagaatttcttttgttgaaaaaactcgggtttatcaccctagttattccaataaaaatgaagaagaaagcaaggcatcttagaaacagactataataaccattatataaccactagaagggaaatggagtaagaaactattttatagaattaacagtgcttaactactgtttcatgttatactaaaagcactcaacgtaaaataaaattaaatgacccaaccagcataaacatgccaccaaggttgagtaacaaggtgtaagggtcagactggttagggctgccttgagtcttaagagttcatctccaaagccgttgtctcgcccacctcagctttgcggtgacatcccagtgtgcagtgctcactcacggcaccgtcatctctctgagtgatttatgggctcagaagtcatcagcaaggaaactgcaggaagcccctgctgagaaccacgagcactgaaggaaaacagctgcacacatccgagcagattatttctttaacactcgtgtgaaacaaggcatcacgctggacataccgagtcttcctctttttcttttttttaaatggaaatatccttatctgggtgggtgaaggatggatatgacttcttaagtgaaaaacaaccgtttttgtggagctgctgaaaagattaaaacacactcatatacacactcagtttctcttcctcatcaaaaaatgagcaacaaaatagcttactgaatgtgcatgttcacacatgtacatatatttgcatatttaacttatttcgttgaaatcttttctctttctaaaagcaaagctgcactggaaaggaagactacattttatgagcaaagataaaacactctttgaatagtaaattgtttttaacaaaagaagaattcaggctaaaatgagaagaataatcagtttttgggaattttgccttttgtttaagttttttagtttatttaaatctttactgaactagaaaacaaggtaaattattctccaggttttctgcttagcatgccaggaagttctgggacattatttgaggatgttttgacaaacaaaatcatcccgatatggaataaagtcaacattcagtaacgcataattgaattttattttcgtggatgttagaataatgatatctatgtgttaaaccacaagcttcttgagggctttataatgtgtggttaggggactttccagctgccacagatcctgccagatgcttcagcattttggtttgttccacagttgaggaatgaagaaacttattccacagaagtgctgtcgccatgttctgacggctttccacagctgtgtcctcacatgcggtgtgtccataggagctctgtcaatcatgcacttgggcttgggttttaaaatactgatcacaacaacagactagaatagctacttttagttacatgaattagtaccatttggttgtgttttgagatttttttgatatggctatttatataaaattgtctcacacagctatcaaatgcacaggattaaaaatataagaccaaaataatatttaagtaagatgtaaaacatagcaaaaccacaaagttgtaaactcgtttccaaaagtcacgatagaatactgatctcattaacttcaaatggtgctagttatataaagatatgtatgcatgatcaaagcttaggcccgggtgcggtggctcatgcctgtaatcccagcactttgggaggccaaggcgggcagatcatgaggtcaacagatggagaccatcctggccaacatggtgaaaccccatctctactaaaaatacatatcagctggacgtggtagcacgtgtctgtaatcccagctactcgggaggctggggcaggagaattgcttgaaccatggagtcggagcttgcagtgagccgagaatgcgccactgcactccagcctggcaacagaacaagactccatctcaataaaaaaaaatatagcttagatatctctgccatgaacatatgtaatccaaataatcttttcggcaaatgtgtgcacagggaatatttaaaaactcataatgctcgtcaagaggaaattaatttccacttgaactaagccaacgtaaaagtcaaaaatgccctttggaaatttaaacacaaaacaaaagattgtgcgtaaggagtgaatctgtatatataagaataatcttcaacatggtctaaacgttctcttaatacagcccggtttagtgaataacttagctgcgtgaccttgggtaagtcatttagtttcaatgttttcacataaataactgaattgtgagggtatattgaggcatgcatttcgtagtactttaaaaaataatgcaaatttatgatacattattttaaacgttattataaatgcttacattatatacatatgcgttatatatgtatatagatataacagctgcatatctaatgatgattatactcttctatttctacattaaatatatttttatgtgttcttttgaaaagttcgattactagaactaacaatatttcttcattttatgagatggttctcacattaaaggaagaaaaatgccacgacgtctttctcttcagtagtaggaacaagtgagagaattaattgttttaaaatgactgttgaagaatgatgagaggctctctgtacaataaacaagccaaactcaaatatatggctagagttctgggttgttaatgcacacactataaacttttatgttgggaaatcaagctagtgatgtccaaaaatcatttcttttttagatttccagaaattcatgaccaagaatggtttagctcatgtgcatattacctttggacacagatcaagcaaacaaatataaaaaaccaagtgaaaaatgtttgtcaggctttgttaaacggtgaaacaggatacagtcttattttaagagcagacgaaaatttgcattttatttcaatttgccaaaccaatttttgtagaacctcatcatagcaacattcttgtggcaagtaaagtcagcatgttgttcctatcagtagagggggaatcagaaacagattctggacatattccaatttcaaggggttcagaaagaaaattaaaattaaacttcaaagctgaagtgctcaagactaaactagactaataatacataaagtggaaaattaagtaattctaaatgtcatgggcatgtgaatatcactgactcatctttaattttatagaataagttagtgttataagtgacgagattaattcaagctgactaacacaggttgatcattttgttatttatgcttttgtttccctcttttatttttgttaacaagcttagtgcttggcaataataaatgggtagctcaaatattatcttctctaaaaaactttgttgatcttttctaaaaatacatacttggtttattcacacttctatgacaacccttttaactctgctttaaagtttggattatatgtctatttctctgtggttttttggagtgcaaagaccatgttccctgttggattttccttttctacacaaagtatggtatttggcatataaacatgttaaaagtggtgaacaagcatttcacaaaagaattaatgagtgaagcagtaagtgggttcatagcaaccctcagttgttgacgggatcaactagattattacaagcaaatcctgttgtttcattcattcattctacaaatattgatcaagttcttggtataaataaaatacctggatccatagctgttcatcagcccttcatttaaggtgtcatccatgggagtgaagatgagagacaagaaagtggtgcctgaaagctcagcagttagggaatttgaggccattctaggttctaaaaacactgtggtgaccttagcgcttaaactttctggttttcagtttcctcatttgtaatacgaagggatggccttaatggtctttacattccctgtaagtttaacattttattatgatgattgatagtagtactgctgaggcacaagctctgcagggtcctcatcacatacagcctgaggcaggggtatagaatcattataaggatatcagcactgagagactataattctaaagtcatgcgggacgcaaaatacagcagaggtggcacagaggcagagaggaggcacgtggaggtggtggggtgtgtgtgtgtttgtgtgagagagagagagagaaagagagagagatggagagaaagtgtgactgttcaggggaagaatttgtaaaacatgacactgaaactcagtttttaaggatgaattctgcaggggcacagccagggggtgggtgattccaaatgtcagaaacagcatgcacaaaagcatcgagtttagaaacagtggggcataaagaaaattggaagcacttaggttttgttggagaatgaatgtgtttgacaggttgacaggttggagactggaactgtaggtaagaggctgacctaaaggctctggattccaggcctgagggtacagactgcagtctatactcagagagagatgacagatgctggtttcaaaagctcgtggcagctgctgtggaaggcggaactcaaggcagtaaaactaggagcagtgggccttttgagagcaaactgaggtgagaggtgagatccaggtgagagagggaggggtaagagacgggtaagctggagcttgggcagtggcatgtaaaagagttcctagtgaaggacatttaggaggaagaaccaatcgatagcatttggtaatagactagcatcaatcatcagggaagaataggaacttttttaggttgtccaagtgaggggagatgattttcttaacagataccagccacatggaagcataaatatacctgtggtagaaagatgatgaatttggttttggatagattgaatttgaagtgcctttggggcattcagaaggactagcccattgcgtttagaataacatccagaagccttactagcctggccctgaaagcccactgctgctgctcagccctcatctcctgccgcgccccttcatcctgcccctggccactccaccgttcctgcaccccccgatcccctaaaactagcccgcccctgagttttgcacttgccgtttgctccactggcaacaatgtctcctcaaacatctacagggctggtttatgtgtgttcagcctgtttatggagtctccgaagatcatcttgacagagtccccttcggagaccatcccaagctgcatggccctgggcatttctgtcgcgccgtgttttattttccgcaaagcttatacaactatttacggtgatcatggttattttcgtattcgcttgctctctacttgagggaaaagctctgtgagaacagagaattggtttcgcttgccgttgcgaccccgcacctagcacagtgcctgatgtgcactaaccgcgctgacggttgagtaactgtgcacctgcccgtggaactgtggagagagccggcggatacgcaggtgcagcagagcaggacggacggaggagcgcatggacttgcttccattgttcaagcgccttcatgtagtcagatattgctacaaaataagatattttaaccacaactggttttttcactctgacttcccctcttccactcatctcatgttagttgatatgaaaaagtgtattggggacacagctaatgagacattgaattagaatacattagatttggttctaataggatgtatttgtacaatttgcgacatacataatcataaatgccaaattacatagagaaatgcatatttatttagaacgagaagagaaataataatactagcttttgaaaaactaacaaatatctaatcttcacaaagtctagaaaatcacgtgtttttatgttgttttgccggatattgttccatagtccttcttttcctatgtttttggctgaatagtatttaatctcctcttccaatggcagcgcttttgtaatgtcactttctataaaaaggaaagataattctatttttctactagtatggttgatttattttaaacagtgtttagaaaagtatttttagcattataacttgttaatgaaacataaaaatttcaaggattgttttcaaatttaggaaaaacttgttttttcttttttttgttgctgttgttgttttcgagacggagtctcgctttgtcacccaggttggagtgcagtggtgcgatcttggctcactgcaacctctgcctctggggttcaagcgattctcctgctgggactataggtgcccccgccactaggtccggctaatttttgtatttttagtagaaactggtttcaccatgttgtccagggtggtcttgaactcctgacttcaggtgatccctcctcctcagcctcccaaagtgctgggattacaggcgtgagcccccatgcccggctgatctcgtttttcacacagggtttgttacttacatgcttgctgtttttggagctgcttcagatttgtgccctacacatgcagtaattctgataaattctattttatgaaattttccaccaaagttaatgtactgatttctgtatatgctttattatatcatatatttttgaaaagagagaatttccattacttgagagaaaattttcaattcatactttattcattcaatttttaattatgtacatttcaaaatgtatttcttttccattccttgcatgcgtccggtgacaggtcccccaggacattctgtcttggccttgcccctttgtcacagtggaatacaattcagctgagaaaaggagaaagtcctgtcagtcacaaaaccatagatgatcctggaggacattattctaagataaataagccaggcatagaaacacaatactgtatgatcccacttaaatgtgggatgtaaacaagtcgaacccatagaagcagaaagtagaatggtatgagaatgtgtcggtcgaagtgtacaaagtttcagttaggagaactatattctggagatctatttggcggatgtagtaacaataatgtactctacccttgaaaattgctgaaagtaggttttaaatgttcccacaacacaaaaataagtatgtgtgatatgttaattagcttgatttaattatttcagaatgtacacatatgtcaaaacatcatgttgtatcccataagcatgtacaataaaaaataatttaaaacaatgacaaaaatccagaacacacaaaatacctataaaatataaataaaaatataatagccaggcatggtggcatgcctgtgatcccagctactctggaggctgaggcaggagttttgcttaagcccaggagttcaaggctgcagtgagctgtgatcatacaactgcattccaggctgggtgacagggcaagactctatctcaaatatatatatatatcatatcattatatatgtgatataaccataaactataaaatatacatttaaaatattatatatgtaaatatacatttatgaattacatttgagttcttgctgcccttttttttaatggcagcatctaaaagactggaatttgtccaagtagaaaatcctacttttgttaaccattacttggctgaatgtcaataaatgcccatggtatgagaacatggttgtttataagaaatcatcaacagataactgtatatttataaacagttaacccttaaacaacatgggtttgaattgcatggtccactcataagcagattttttccctctctgccacccctgagacagcaagaccaagccctcttcttcctcctcttctgctcaatgtgaagaagatgagaattaagacccttgtgatgatccacttccacttaatagtaaatttatttcctctgtctctctctttttttttttttttagttgtggggggtctctctattttgccgaggctggcctcaaactcctgggctcaaatgatcctcctgcctcagcctcccaagtagctgggatgttgaagcaggtcacaggacatcatgcctggcttccttgtgatgtttcaaaataacattttcttttctctagtctcaggttttttgtaaaagtatagtgagtatagtatgtaatacatataacatgcaaaatatgcattagtcaactatgttatcagtaaggctacaggtcaacagtagactattagtagttaagtttttttttttttgtcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactaagaatgatgatttccaatttcatccatgtccctgcaaaggacatgaactcatcctttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgtgtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtcaatttgtttgagttcatcgtagattctggatattagccctttgtcagatgagtaagttgtgaaaattttctcccattttgtaggttgcctgttcactctgatggtagtttcttttgctgtgcagaagctctttagtttaattagatcccttttgtcaattttgtcttttgttgccatttcttttggtgttttagacatgaagtccttgcccatgcctatgtcctgaatggtaatgcctaggttttcttctagggtttttatggttttaggtctaacgtttaagcctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagcttcgttcttttggcgtaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatcttgattcttcctacccatgagcatagaatgttcttccatttgtttgtatcctcttttatttccttgagcagtggtttgtagttctcctcgaagaggtccttcacatcccttgtaagttggattcctaagtattttattctctttgaagcaattgtgaatgggagttcactcacgatttggctgtttgtctgttgttggtgtataagaatgcttgtgatttttgtacattgattttgtatcctgaaactttgctgaagttgcttatcagcttaaggagattttaggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgctgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttggttggtaaactattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctatgggatcggtggtgacatcccctttatcattttttattgtgtctatttgattcttctctctttttttctttattagtcttgctagcggtctatcaattttgttgatcctttcaaaaaaccagctcctggtttcattaattttttgaaggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgcgtctttgttctcgttgatttcaaagaacatctttatttctgccttcatttcgttacgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggagagttagctcttcttgttgaattgatccctttaccattatgtaatggccttctttgtctcttttgatctttgttggtttaaagtctgttttatcagagattaggattgcaaccctttttttgttttccattggcttggtagatcttcctccatccttttattttgagcctatgtgtgtctctgcacgtgagatgggtttcctgaatacaacacactgatgggtcttggctctttatccaatttgccagtctgtgtcttttaattggatcatttagtccatttacatttaaagttaatattgttatgtgtgaatttgatcctgtcattgtgatgttagctggttattttgctctttagttgatgcagtttcttcctagtctcgatggtctttacattttggcatgattttgcagcggctggtaccggtcgttcctttccatgtttagtgcttccttcaggagctcttgtaaggcaggcctggtggtgacaaaatctctcagcatttgcttgtctgtaaagttttttatttctccttcacttatgaagcttagtttggctggatatgaaattctgggttgaaaattcttttctttaagaatgttgaatatcggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgcctttctacattggggaagttctcctggataatatcctgcagagtgttttccaacttggttccattctccccatcactttcaggtacaccaatcagatgtagatttggtctcttcacatagtcccatatttcttggaggctctgctcatttctttttattctttttctctaaacttcccttctcacttcatttcattcatttcatcttccatcactgataccctttcttccagttgatcacattggcttctgaggcttctgcattcttcacgtatttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccattgctggtgacgaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgagatgtcagtgtgcccctgctggggggtgcctcccagttaggctactcaggggtcaggggtcagggacccatttgaggaggctgtctgcccgttctcagatctccagctgcgtgctgggagaaccactgctctcttcaaagctgtcagacagggacatttaagtctgcagcggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggtgggcgcccctcccccagcctcgctgccgccttgcagtttgatctcagactgctgtgctagcaatcagcgagactccgtgggcgtaggaccctccaagccaggtgcaggatataatctcctggtgtgccattttttaagcccgtcggaaaagtgcagtattcgggtgggagtgacctgattttccaggtgccgtcggtcacccctttctttgactcagaaagggaactccctgaccccttgcgcttcccaagtgaggcaatgcctcgccctgcttccgctcgcacacggtgcgcgcacccactgacctgagcccactgtctggcactgcctagtgagatgaacccagtacctcagatggaaatgcagaaatcaccgtcttctgcgtcgctcacgctgggagctgtagaccggagctgttcctattcggccatctttgctcctccccccttagtagttaagtttttgaggagtcaaaaatttcaactctgagtcagtaacccccatgttgttcaaggatcaaatgtatatatttccatatgtgtgtttagatacatgtatgtgtgtgtgtatatattcatgcatgtgagcctatgtgcgtgtagactattctctaaaactcaaaatcagagaaaaataacctttgtgtaaagtaaaatatatcaatgaccataatcagatatgaatcataattctaatatgtagttgacgtatagaaaaaagcataagaatttgtattgatatgtttatttaaattaaattataaaattgcatagagttagaaaaagcaaaattagtttattgcaattattattttctcaacttgatattaataaagttatttttataataatggcacatattaaaaagcaattttactctgtccttcagagcatttgctccacattggagctatttccattgtagatttttttgtaaggctataattctatcacatgggcagattgtgctaaaacaagcagaaagggtcacaaccttctgtctaacctttgctatttagaatgaacgcccagggctttcgagaatgtaaattgtcctggcctgttctctgacaaaataagaacatacagttgaagaattattttttgtaaaacctaaatttgccttttttcctcacactaagctcttctcaagtgttaagtttaaagacagttaattatcagctattctttagagcacgggaaaaacagtttagtactcagtaaagtgagcatgcaatctaccttattcctgtttttttcgatggatgaatgtgaagaatttacacagtcatgcaagagaggcaacgatagtgttctcttaagaagacaaaattataagattggaggttaacacttgctcaacccagtaaaaaggcatttggtagatatttctgatctttccctgactgatgaaaagtgctgatatttctaagaaactggtaggaaactttaaaaaaaaaaaactccccgaagcctaccaccaggcatgccatgaactttcagatgacacatcgtgctactaatttttagtgacctttgctaaatttatcaaaaaatgctctcactaaatccatttctgtagaaataaagaaaatatccgtgatgtgcaaactcacagtacaaatctgtgcggcttctgactgcaaaagatcctgcatatttcatcaaagcctcagggttgtggttattgatgtttcccagaacgtggagtgaaaccccacacaaacagattgccaaaggggagaaaactatgatttgtgaaattcaacattatctcttgaatgcctttgctttttattttgaacatactttattttttagaccagttttaggatcacagcaaaattaagcagaggtatagagatttcctatatatccactgcccccatacaggcatagcctcccccattatcaaaagcccccacaagagtggtaaatgtgttacaactgattaacctccattgacacatcattctcaccccaaatttaccttaggtgttagacattctgtgggcttggagaaatgtataatgatgtgtacacacaattacggcattatacagggtaggtttcttgtcctaaacgttctctgtgctccacctattcagtctccctctctcttaagtctgggcaaccattgattatttttactgtctccatagtttgcctttaaaaaaatgtcatatagtggctcacgcctgtaattccagcactttgggaggccgaggcaggcagatcaacgaggtcaggagttcgagaccatcctggccaacatggtgaaaccctgtctctaacaaaaatacaaaaattagctgggtgtggtgatgcttgcctgtaatcccagctactcagagggctgaggcaggagaatcacttgaaccagggagttgacgttgcagtgagccgagattgcgccactgcactccagcctggcgagagagcgagactctgtctaaaaaaaaaaaaaaaaagtcatatagttggaatcgtgtattatgtagccttttcaatttggcttttttcacttggtaatatgcatttaagtttcttccacatgattttatggcttgaaagcttatttctttttaacgctgagaaaatttccattgtctggatgtacaacggcttattccttcgcctattctaggctatctaaatttcttctaagttttagcaattatgaatagaaatgctctaagtgcaagtttttatgtagacatgttttcatcttctttgggtaaataccaaggagagtgattatagtatcatataataaaagaatgtttagtttggtaagaaacggtcaaactctcttccaaagtgactgccattttgcattcccatcagcaacgaaagagaattcattgttctttaacctcactagcatttggtgttggatctggagcttggccattacaataagtgagtagtaatatctcattgttttaatttgcatttccctgaggacgtatggtatggagcatctttcacgtgcttatttgccatctgtatattttctttggttgggtgtctatttaggtctttggaccattttttaattaagttttttttttttatcgtttagatttaagggattctttctatattttgaatagcagtcccttatcagatatggcctcccacatgagaatgtaattcttctgacagtgcctctcatggagcagaactttttaattgtaatgaagttcagtttatcaattgtttctctcagagattatgcttttggtatatctaaaaagtcattgccaaactcttgctaatctagatttttctcctatgttatcttctaggagttttataattttgtgttttagaatccactttgagttaatttttgtgaagagtataaggtctgtgtctaggtttatttatttttgcatgtggatgttcagttgttatagtactatttgtagaaaagactgtttttgctccatcgtctttgctcctttgtcaaagatcagttggctctatttatgtaggtctacttctgggctcctcattctgtttctttgacatgtttgtctgttgttttaccaataccacactgtcttgattactgtagctttatagtaagtcttgaaatctggtaatatctgtcctccagctttgttattctccttcaatattgtgatggttattgtgagtcttttgcctttccatagaatcagtttgtcaatatacactaaaataacttgctggaattttgattggggttgcatttaatgtatagattcagatgggaagaactgccagtatttagcctctctatccatgaacatgagatgtctctatttatttagttctttgatttttttcatcagagttttgtcattttcctcctataaatcttgtacatattttcttagatttatatcttcggtatttcattttgggtgtgctcatgtaaatggtattatgcttataatttaaaattgtacttgttcattgctggtatataggaaagcaatagggtttcgtatattaactttatgttttgccaccttatgataagttagtttcaggaggttttgttggtgttattaagttattgttgttgattatttttgattttctacataaataatcatgtcaactgcaaacaaagacagcttttttactctattggtgtgttttatttatttattatttatttatttacttatttatttattttctcattgcattagttagggcttccagtgtgctgttgaaaagaagtggtgagaggtaatatccttgccttgtttttcatcttagcacaaaagtttccactttctcaccattaaatgtaatgttagctgtatgtttttgtaaatatcacttgttagtctgaaaatgtctttttattattattattatactttaagttttagggtacatgtgcacaacgtgcaggtttgttacatatgtatacatgtgccatgttggtgtgctgcacccattaactcgtcatttacattaggtatatctcctaatgctatccctccccactccctcccaccccacaacaggccccgctgtgtgatgttccccttcctgtgtccatgtgttctcattgttcagttcccacctatgagtgagaacatgcctgcaggttctgtccatttgtggtagagggacattaaagtgttcaactataatagtgaatttgtttctctttgtggttctatcagtgtttgtctcatagctctaatgtctgctctgaattcacataactactcctgctttctcttgactaatgttagtatggtgtatttttctctatttatttacttttgatctataggtatctttatatttaaattggatttcttgcaaacaatatatagttgagtcttgttttttgatccactctgccaatttctgactttcaattggtgcatttagaccattgatactccaagcgattactgatatagttggattactgtctataatattttttattcttttctatttgttgccctttgcttctatttttgaattctacttctttctgcttttttgtagcttgagtttgttttttattgaacagaatgaacaagaagttgttggctcctcaaaatcaattattatttttatatcaaactggaaaattaaaactaaacttcaagttttatcagcttgttatttgacaagtacttttttttcccaggcactgccctttacatctaagccaatgggttttctatctatctgtttcctactttctagtttaggttttaatagtttttaaatctttgtggttattattgatattctcaatttttactattaaaatgaagcattatggatagtaaagcatattttgaagaatttctacggtgattaaaaatttttctattttgtaatatggtgttatttttacatagaaaaacacctgatacttttgagacctcagttatctctcacataaactctcactgaatttatctgtacccaagtcatggtgttaagaagtcttgctgtgaaatgtagaggtcagtcacatacatgttgaaatacaacagaatgtgtgtgggttgcttccgggctcttctgcttaccagctgtgtgtccttgcacaagttaactaaattcttgcctgtcagcttctcatcagtaaactagggagtataaagacaatccatagtattattgtggatgttagctaaaatattttaatgcaaagtatcaattaaaattttttgaaatataatagatgtcccaaaatgctggcttaccattcattattattttaatctttgcatttcagtcttttgtgatactttctccaacatacaacagtctagaatggaaatatgggctatatttttgaatttctaagcattttacctggctattagtatgaattcaagaagcatttgttgaaagaaaaataagattctcaaattgtaagcattagtgcaaacatttacttggccactaagaaaatttaataattaattaatatactttagaatttgtttcaaaactctaaatgtttatgataaaactaaactttctggtatttggatttattcttaataacttcttttcctacattgcctttgtgaagttttctctctaataagccacctttaaagtttgaaactgcagaatcacaaagtgtacacttgctgcatactgtagagtccttttggttgcaccaaatcctgttgagagttttaccattttaataggcatcagtcagcgtctgcaaaaactttgcacacatgtaaagctgttgctgaaatcttttattatctggagaaggaaaagcactaattttttcatgccataaaattcctaaaaatgatgctctgatggtaacataatgccctatatgtgagtaccatggttatagatttaatctaaaatatgaaatcatcaatactatacagccaatatcaaaaacatgttgatcaatccataaaagatatgttgatcaataatgatcaaagcttaccgataccaccgtgtccagtgttcattctaacagcacagcacaatggttccagacaattacctagtcttgttctccatatcaagtggagttattagccaatgggtgaaaattttctgttaagcaagatgaataaattctagacatcttctgtatagcattccacctataggcaaccatattgcactgtacattgaaaattttgttaagaagatagatcttacgttaagcgttcttaccacaatttaaaatagttttttaaattagctagtaaaccttttttatggtctagatactaatttccaaatataaagatggataatttaattgtctttaaaatttaagcccaggtgaagtgtcaagaatgtcagcatttatttctgtgttgacaaatcagaacataaacataaacaaatcaaaacatcaactacattcaggtctccaactttaatatcaactatctgttaattgattttaggtccacatctttgtccacaatggcacatttctaaacgcatcatctggaattaaaactacttacctactctctatacagttgccacttaacgggaatttcctggttgggtcaggaatgtgtttattcttatgcattctttgcaggctgcattgcccagagttcaatctggtttcatattgtgaagcacaggggagagtgggaagaggtaaatattccctacaccttcccacccatccaccctgaccctatcctcttccccactgtctgagggctttagacagtggctacatttttccatggctccgtccagaaaggtccactgttacttcagttttaaccaaataatccctgcccctgagctctggtaaatgcctcttctctttgctactctggcctcggagaaataattccttactgggattcatgatatctgggttttctctcagtgatttcactggtgtctcagcccttccattacccttgcagccagtccccaactcgaaattattgttgtccagggaactcaaacaactcaacaagaaaaaacacaggtagccccattgaatagtgggcaaatgacatgaacacatatttttccaaagaagacatgcaaatagtcaacaagcatatgaaaaactgctaaatatcactaatcagagaaaaatcaaattaaagccataataagataatatcttacagcattaaaaaatatggtggtgaggatgtggagacaagggaatgctttgtacactgttggtgggagtgcaaattagtgcaacctctatggaaaacagtatggagatttttcaaagaactaaaaatagatgtaccatttgacccagtcatcccagtactgtgtatctacgcagaagaaaagtaatcattacaccaaaatatacctgcactcatatgtgtactactcaaagcagcaaagatatggaatcaacctgagtgtccatcaaaggatgattggataaagaaaatgtgttattatatatatatacacatatataaaaacacattttcgtgatatatatatatatatatataccatgaaaaaatactcagctataaaaaagaatgaaattatgtctttttcagaaacataagtggaactggaggcctttatcttaagtaaagtaactcagaaacgaaagtcaaatacggcatattctcacttataagtgggagctaaacaatgtgtacacatgaacatagagagtggaataatagacattggaggcttggaaaggtgggagggtgggagtggggtgaaggatgagcaattacctctcgggtacaatgtgcactatttgggtgatgattacactaaaagctcaggcttcaccagcacataatatatccatgtaacaaaactgcacttgtaccttctaaatctgtaaaaataaaaattaaattgtccttatttcaaatgcagtaggtggtttctgttttgtttttgtgtttttgctttttgacaaaattgcgatatatatgcgctgtataatgatatcctaggagtcacgtttctggatctactttttcagggtcatttctaagcattgtggattatgtatctgttttagattgaaaatactgaaccatatagctttcatgggatttgagaatgaaatcatgttttccctaagaaatgatatcttttcttctaaaaacacaaagcagtctaactttgataattaattctaatatgcattgggaacacatgcataggtagatggaaagtttgatgaaatgctaccatgtgatatatgattttcatatatatctcatttattcttgcaaccactcaacagggatattatgtaacataacttgctgttgtgaaatctgtaaaatagctacaaaccaaatccaaggctgtctgagtccaaagcctagaccatttctactctgtaaaactatttcttcttcagagaaaatatttaaaacaacagtgacagactatgaatgttcaatatgtataatatggaaatttgtctcttttttctttatttttcttgctgtattagaaaaactccttgcagcgttttaagattaatgttcctttccctctaggaaagaggatagagcaaaacaagttttgttttattaatgatttcagtcctggatttaataaattttaaacctacactatgaaattaaaagggatgatgcattttgggatgaggatgagttagaggtagaatgacataaagataaagaagtgaaggaagtttatcaggcgtgaaacagaagcctggggcacgatgatggggaaggtttccaagtgggaggagctactgattagtgagtccagagggtagttcccaggaaggagcaacgtacatcaataaggaggttcaaaaacaaattgtctgtacctggtaaggacagaagtacaaattcattggtctgtgttaaaagtcttgttccttatcaaaatgcaatctatagagaacttcgttaatctggatattaggcaggcatcatgctgattcactaaatgatgacatcatctttatgagccttgataaaataaagtacaaataatccaaaatgtcctggaaatatacatgcatcatggaagatggtaggtaaacttcatggagaatcaggggcttgacaaattgatgttcttagaggattgaggtatgccacaggtagggaagaaacggttgcatgttgcacctccagttactaaggcagaagcccagatcttcatggattttggaggtagcattatttattgggtgatatggtttggctgtgtccccacccaaatctcatgttgaagtgtagctcccataattcccacgtgttgtgggagggacctatgggaggtaattgaatcacgggggcagttttcccccatactgttctcgcggtagtgaataagtctcatgagatctgagggttttataaggggttttccctttctcttggctctcattctctcctacctgctgccatgtaagatgtgcctttcaccttccaccatgattatgaggcctccccagccacgtggaactgtgagtccattaaacctctttttctttataaattacccagtctccagtatgtctttatcagcagcatgaaaacagagtaatacattgggaacttggaaactatcagttttaagtggaatccagagaaacagagggctgtgtagcacaatctgttctgcctcttaagccacatgactcagtaaatccagagatgctagatgtatctgtaatagataatgaagctacatggagtctctgacaagcccaaatataagggttgcagaacagacccatagggttttagataaaagccatgccttccttagcgtgcaactggaccccagcagactgagcaccgtaatgcgggatatgaagtgattttccaatcattctttcctcatgagttggatatgttcagatctgtcaatttatgacactgagggtttgcaacatcaatatattatacaatatttgatgggaaaagtattgtactgatgtttgtagttgtgtaacaaatcaccataaatttagcatcttaaacaacacgcatgtattatttcacagattctatggatgaagagtgtgggcacagattaactgggtcttctgcttagggtttcaatggctgagaaatcaaggtgttgactagactgttttctcatctagagtttactggagaaaatccacttccaagttggaaaaattcatttccttgcagtcacagggttaaggtctccagcttcttgacagctggggctgggagccaccttcagcttctggaggctgccagtagttctgagaagccaccggcaattcctgccaatggccacttatacttcatcaagccaataaggagaatctctgtgacaagccagcctgcaaaacagggtaatatactgtaactatcatgtgagtgacatctcatcacattcaccaaattctatcgattagaagcaagtcaaggtcccattgacattccaggggatggaatgaggcacaaggcattcagcaccaagaggtggagatcatgggggcatcttagagtctgcctgctacagataaattcagagttaggcctgaaaaggtccagaagacacaagtaagttgtagccatgagtagcccaggtgcaatatcatatacctcagtagcaccagtgtcttctcctcagctaaggaaggtgtcaagagagacatcttatgatcaacctatggaggaagaaaaaatttgtggtattttgcatgtcggctcagggcaaagagtgcattttagaataaaggaggtgtggcaacgtgtgtgcatggccgtcagatgcacagggctaagaagcaactgctagaaaggtcaaatagctgtaataggttcagctcatgtggaacttgggacactgctctgtatgtttgagactctctcctccagaaaacagaatatttactgagccagcagtcaatacatggtgctgagactgacatgtctagaaaacacaggtctcaggaccacagggtgaaagagttgccccctcaccatcacacgtgagtatccacttgaagaatcactgtgttttccagtctcacaacattaggctctcctggattagggataatggttcccaagaaagaactgcttctatagggaatatagaaagaattccacataatataaagttacttcaagttagaactgctgtctgattactttgggtttctcatactaacgtactcagaggcaaagaaagaagatactcagctaaggaggtaattagtccaggttattatgagagacagtgacaaatgtagaatccaaaaagactaatatggccatctcctgttatttatctgttcagtaagaacaatgaacgggcacttatagcagtcatggtccagtaagaggaagaaagtatggattcaactctgtaggggtgatggtttgagtcaacgcaacagaccagcaacccagaccaaacaaagagatctgtcattcttcctgtgagtgacaccggaactgctctcgttaaccttacactgttcgtctctgacttcctgttccagacttctctgttggcacattgagagtaatgtcatggtgagctgctgtgcgctcaagaatgtgctacctggaggtttgggaagttaaacctttagagaaatcttttgaccaaaggaacttgggagaaaatggatacacattttcctataacttctccagaaagtcttgagacatagtccatagacttccgtaggagatcaacgaaatgaaggaagcagctgtcgatagttgtggctaacgtaaaaatgtatctctatattcagcctcccttctcccctgttttgttcccctgcttcctggattccactcctcgataaaatacttgcccttaagcctttgccttagctctggtgtctgaggaattagagctaagatactgctcattatgagaatgtcaacacccacgccaagtctactaattccagatgatctaaaattttaagacccttagggatccagttcactggaggattctactcaaaggtatagagaaaggcctttgttcaagctgcacatcacattttgttaattaggcatggaagtcactctcctcgtacccaaggtctcacatgtgctctcctaacgtactgattagcatccaagcaaaaccacaacccatcatataccactttaagcttctcttcccccagtggtattattgctctgtcctaattacgtgacaacaaccccacggatttgaattcaaatggcagcaagcggccaaaatgccaatttcttcatctactaatctgtacttctatagtttctctccgaatgttttcttcctccattttaaagttatatttctgtacatgaataactccattatacagttaatatggtaaaggaaacaaactctttcttatgtcaatgacacctttaatactttttttatcattcctctattttaaaatcttactacattttcctttttgaaggtattattttcccatatgcctacagaaaatatgcccattggcaaaataatgcaaaatgatgaagataataaaacaaaataaagaaaataaaaatccacagtgttcttgtttttgagccatttctttgaatggatacttagcctttgctattacgttattatgactttaacaccatcattgaaatttgcctggctgggcggggtagctcactcctgtaattccagcactttttgaggccaaagcatgtggatcacctgaggtcaggagttcaagaccagcctggcaaacatggtgaaaacccatctctacaaaaaaatacaaaaaattagctggccgtcgtggtgggtacctgcaatcccagcgactcaggaggctgaggcaggagaatcatttgaactcagcaggcggaggttgcagtgagccgagatccatgccactgcactccagcctcggcgacagagagacactccatctcaaaaataaaaaataaaaaaagaagaagaaagaaaagaaatttgcctatcactgagaacagttaatttcatacagggtcataacacgctagatgattgcactgttattattataggtagataacagaaggccaggacattagtctgttttgcattgctataaaggaatatctaaggctggtagtttattttttgtcttggctcatggttctgcagactatccaggaagcatagtgccagtgtctgcttctgtgaaagcctcaggaagcttacaatcatgacagagggcagagggggagcaggtgcatcacatggtgagacagggagcaagagaggggggaggtgccaggctcttctaaacaaccaggtctcgggaagtaagaactcataactgcagggagggcacgaagccattcgtgaggggtctgcccccatgacccaaacccctcccaccaggccccacctccaacgtcagggatcacatttcaacatgagatttgcaggggacaaacatccaaactacatcagcaagttctggactaaagtaagacacatttggtttgacgcccttccattttatttttaatataccctcttccaacctaacagacatcaacccaggtctcgttttttcctgatcagattggggttttattttaaaccaagcccatgttaacagccagttttttttccaaggaaaatatccccattattagctatggccaggattttctgaattctctttcctatttgcactttgcatttttactggggcttctctgcccttcataagaggcgcgcatccttagtggggcactgttaaagcagccgcgtctccctcagccctggctacaggcagcaggtgtttcttccatcttatgcccatactccgcctccttaggctttctacacaagggaccttaagtggaagcccacactcttcttgcaatcaaagctttctctttttcctgaggttcactgatgttgttgattctataatcttttgtggggttttaatttgtgataatgtaaagtgttaggagtcccccaaagcatttatattatgagaggttgttcccaaatatggaaacgtgttcaactcacagtatgcatttctaatggtagaatttacccccctttagtaggtgggtgctgtcaaaggggagtacatgtgtgtctatatggctctgtgtctgtccttgtctacctcacttctctacttattatctatccatttaccacccattctaaatagatctgatggtaatgccagagaagagacattatcatattttactgaataaaataatgagaaaaagcggggttgaagtcacatcacagaccgagaaaaacttctagagtattactgtgcagaaaatgcagtggactagaggaaatttagccagtacttctttctttatgatcctattattttcactacacagaagccagttttctccctgctttttcacttggtaggatttggccagtgtctgttagaaatttggttaaagctcaaacaagtcggattttcaaaagcaacctgaaggtcagctgtttagttttatgcatttccttcttctctgaccaaatactgcaagttctgccaataggcaaaggcaaagataatgtattttgtatggcctagttttgtatccatatgaaatactatagacttgtttgaggttacagtttgaatattaacaaaaatcaataaagctaagatgtactagataacattcaaagtccctttgaaataagaagaaatgctcaggaaaatctaaaagtaaaatatttatttttctcaattgatatttccataagtcatttttattttttgctcttaataaagaaaccataataatgtgagaataaagtgaaatcagtggtaccattattgaatacttatttaataccccctcactacaacaccaccccaagtcccattgctcaaagacaaccacttttgtttctctctctggtatttgggaacacatttattaataatataggtataatgtaattttctattgagtaatttacatgtttaaccattacaggcattttgctttcctgttccaatggataaaaattcaactctcctgatagaaatttcaaagacagaccaggcttggtggcttatccctgtgatcccagcactttgggaggttgaggcaggcggatcacaaggtcaggagtttgagaccagcctggccaacatggtgaaaccctatctctactaaaatacaaaaaattagccgggtgtggttgcaggcacctgtagtcccagctactcaggaggctgagacaagaatcacttgaacctgggaggcggagcttgcagtgagccgagattgtgccactgcactccagcctgggtgacagagtgagactccatctcaaaaaaaaaaaaaagagaaatttcaaagagaaaaagacaaatcacctagccatgagttagatttgttacatcataacatttcagtgttagattggattttccattgtgtctagttcacccagccatctaatgcttgaagtttttctaatcactcttttctttctcagaggacgttgacttctgcacgaatccctccaggttctgtgaaatatttctcaaggttgtcagttgcccatttcataaccctacagctaggatttctctccctgtctcactatctctctcctccacctcaagcctcagatcaaaaatctgtattcttgggacttctcccttttgagctagaattccacatggaatcactactgttctacctgagagatctataaatattttaaagacaatattagtttctgtccttagttttttctcttcaatgttaatattataaattctgaacatgaatatatgtcaagttctctttccatctttaatgctatacgtaaatgttttaagtttcatggccaggcgcagtggctcacgcctgtaatcccagcactttgggaggccaaggcaggtggatcacaaggtcaggagtttgagatcagcctggccaagatggtgaaaccatgtctctactaaaaacacaaaaattagccgggcgtggtggcacacgcctgtagtcccagctactcgggaggctgaggcaggagaatcgctggaacccaggaggcagaggttgcagtgagccaggatcgcaccactgcactccagcctgtgtgacagagtgaaactctgtctcaaaaaaaaaaaaaaaaaaaaaaaaaaaaaggacaggcacagtagctcacgcctgtaatcctagcactttgggaggccaaggtgggtggatcacttgaggtcaggtgttccagaccagcctggccaacatcatgaaaccccgtctccactaaaaatacaaaaattagctgggcatgatggcacatgcctgtaatcccagctactcaggaggctgaggcaggaggatcacttgaatccgggaggcagaggttgcagtgagcagagattgtgccactgcactccagcctgggcgacagagccagactctgtctcaaaaaaaaaaaaaaaaaaagtttcttgtttctcgatgccgcctttaaagtgtagtgtttggagtggccgtgccagggagtgtctccacctctctttcctcacccacagatggttctggggaagctgcatcacagccgtcacttgtattgagctcacgtgcaaccaaaaccctttatagagttgggtttttagctgtgtctagacgcttttatgctgaattcttgaacacacatagactcagctggactcttttacgctgaattcatagacacagctagactcttttatgctgaattctaaattcttgaatttaagaatcttaaaattcttgaattttagacccaaaacagtgccaaatattttatctttgtcacattttctttctagtcagagctgacaggttgttaaatttaagaattttttgaatactggttcttttctattttctatttctgggtatgtccatatctgtatcaactaaaaatgtcccaagcctgccattactaccagtcccttagccattaataaagacatgcaaccagaaatgattgaggacagacctgctgggcatctcctgtccaggttgacactgattatttgatcaataattttgaaagatggattgtgtataagttacaatatatttgatattttgtaaaaaaaaaaaaaaaaagactcagtaagcccaagaatctaagaaaattaatactaaataactttcccaaatgttgacataagaaaaaattatacctgagaaaagcattattaatgtatttttaaaataatttatttaaaaaaattattgtggttttcttacataactagcaattatctataggctttgagaaaaatgagtcaaagcggaacacatactcacattactatagatgttttaattcagctgtaaacctttggaggataatgaccttgttttgccctatgtgcgtggggcagagggaggcaggaactcaggcctggaaggaacctcatgatagtgttgctttttcctttttccaacaaaaagttagagatgcatgatcaataaaataacaagcatataattgcattttgaggtaagtgagcagatgctgtgttgctagggaattgttgttgaatgagtataaaatatgaatttccagaaagttgtcatgtaggtaatatctgattttattggcaaggaaattctcagtccctgtgaagtcatcattaccaagttttgagaatttaatagggagtcaatgtatgcattggtgtgtttctttcttccttctatttcaggtactagtctcatcttttcccagaaacgaaggttggtcagaccatctgggattagaaacagacagcaaaagtgtccctttaacctgaggacactacaggaaaggtctttctttcctttgggcattttcttcatgattgctttacccctatactcatgctactgagctctctcctttccattttgtgaataaactgggactgaagataagatttggaataaatgtgtacttattatcaaaatgaatattttatctcttgctaattcgtagtaatttgcattggttagttcttgaagggaaatgatctaaaaatgtaaagatttatgaatacggaaaaacatgaactattatttcttttaatgtttccctttagtcaactttaggaatacaaaactgagttgttttacctcccttaagttttgggacatgtgattccagctctgttcctgttgatgacagaaagtcacattcaaatctcttgatatcatatctaaaaatcctgatttgtggtcaggcacggtggctcacgcctgtaatcccagcaatttgggaggccgaggtgggggatcacctgaggtcgggagttcgagaccagcctgagcaatatggagaaaccccatctctactaaaaatacaaaattagccgggtgtggtggcgcatgcctgtagtcctagctactcaggagactggggcaggagaatcgcttgaacccaggaggtggaggtaacggtgagccgagatcgccccactctactccatcctgggcaacagagcaaaactctgtctcgaaaaaaaaaaaaaatcctgatttattacagaaaggtccagagcaaaagcagcattttgaacttggtgtatggttaactggacagggatgtggatctgaaggagagcagagtatttgtactagcaaagggacagaaaggacaagttcgggtatcaaaaaaataggtgattaaaactataggaaaaaaccataagggtatgaattgccttgtaaagaaaccattttgagaaggagagcaggaagcaaaattagttaagaaggaatgtttttaagacaaagtaagtattcaacagtaaaaggaaataaaaggtttattgaatgttcccaacacaaagaaatgatgaatgtctgagttgctggatatgctaatgaccctgatctaatcatcatacattgtatgtattgaaacatcactatgtaccccataaatactcataattattatttgtcaatttaagaatattttaaaatcacacaaaacacaatagcagcattattatgtgacaatatactcccaaaatacagaactagtaagaaatattatcaatagacatggcttcaaagaaatagaaattgttttctaaaatatagactttgggcagtaaagcattgcagattgagagaaaacattctttttcccaaagagaagacaatttccaaataagatagtgtccataatgctttgtaactagtgggtgcctcttacgctatcagcaaacttagttccagttcaccctcctcaccttccacccagagactttagggcatgttgctgggggtcaaccttggaagatctctgcatttgaagcaatctactgtctccctgggatgggccgctttctcctttgagtggccgtaacccagcccagagctgctttcgcagaggcaatcaagctatggaaagccctgctcattttgtgttttcagggttgcctttgtttatctctaattcttaagggaaaatgcttctgtaggctcaatgagaccgagtggaaaccatagccaagtcctacagcttttgtagtttctgtgctggggagactacagatctatttggaaaaatagaaactgcattagatcaagctataactttaatatttatgaaaaagctctaattgttgactctctgcagctgaattctacattaaaccctgtagacagggtttataaaatatacatgtacaagttcatataataaggattatttgataatggtaaaaaattaaatgagtattcaaatataaacataaaaatatggcattttctcttctactctaatcctacagtgctatagtaattttttttccttctgaaacctttatggaaaccctaattaacgtaagtcaactgttcaacatctaatattgttgaaaaccttaagtaggaataaaattaagcatttatatttaagtacagttgatactttaaaaaattcttacataaaatctttaattatgatttgctttgtgtatactggcttctgcgatcataaaagaaattacttaactttgccatctctaaaagaaaagtccagagttggcattgtttccagcttatttttcaagacaacaaaaaagtaattttggaaaataagttattttagaaaataaaatataacattttttagaacctggagttctccaaatagtttgttctttcgagaatatgattgagctttctttgccactcaggttcaaagcactgggaagaagtgaaaacaattcaattattggatgcacatttttgaaagggccttacattgctaaattcaggagttgccataattctatgtcatgttgcaagcaagctaaacatcaagagaggtgttgtaaccagctaataattataaataatgtgtgaatactgtcttttttttctgattcctgtgagaaatcagaaggaacaattgcaaggaaatatgaaatcatgttcttcaaatccttcgactctgaaacacagataagaggactgctgacatgtagggaccaatagaatgacagctcgttgcatacaaagataaaaaagacagtgagtgactttggagttgtgttgccttctgcagccgagagaatttggacccaactgtcaaatgactattttttttagaggagtgtaaatggtgagtgtgtacggtgagctagtggtatggttcagaaggaatctgcagatgagctagtggtatggttcagaaggaatctgagcgctaataaacacccactttcccagtaagaaatgtagtgtgctgtgtattagaaagcttcatagactccagaaaaattcaaagaactaaacatgaatcctcctgtcagtaagtccaaggaaacctagactatttcatgcagaaatagcacatttataccgagtatcacttatcacttacagattatgttctcattcattgtcttgtttttaatcttcaaaacaatcttgaaaagaaaatccttgagagttgaaagaaatttaagtgacttggtaaattcatatggaagatggtaaaacattattgtcaatgtgctgcgtcttgcttaatgaatttcctcaaagttagagacagtgtctataatacttgtccttttaagctaagatcataaaatcaaccagtaagatgataaaatatgtagcaatgtatctaaatttatcaagctctgtaaaaccctaggatcaagcagtagcttggagaggtcagaaagctcctgagcttgcaccttcttaagaagaggagaggggaggggaggggaggaagggaaagaagagaggagaggagaggggaggggaagggagtggaggggacgggaggaagagagaaaagagaggagaggaaaggagaggctttagcatgaagcctctggatgctcagattctgctgggaattttggcagcgttatggaaggtccatcacaatcttgaagagaggctttcactatataccaagcatggcttagtctgaactggttcatctggacccaactctagccaactctagtgtgtctcatggtctggtgtgggccgagggcctccaggcctccagagccagccctgtccacaatttggtaatattccattgtttccttacagagctcaagattgcaaaccccaaggtgagaaatggaaaaaagtaatgggacctttaagctctgacgttctatgttcctacagcataagctggtggcttctgcgggtctctgcagccacctcagggcctttctgctcttctcaagagcaagagaagcagaacttcttctcttgcactggaaatacctgtggggtgtgtgtgtgtaagatggacattgagtgaagggacatgagcttcttgaatatcatgttttacgcaaacaaatgtttctgtttttttttttttttttttttttttttgagacggagtcttgctctgtcacccaggctggagtgcagtggcgcgatcttggctcactgtaacctccgcctcctgggttcaagcgattctcctgcctcagcctcctgagtagctgggactacaggcgtgcaccaccaaacccagctaagttttgtatttttagtagagacggggtttcaccatgttggccaggatggtctcgaactcctgacctcaggtgatccgtccaccttggcctcccaaagtgctgggattacaggcttgagccaccgctcccagcccacaaacaaatgtttagcattaagtattgtgtattaattaaaagactaagtctttttcataatagcttagagctcaatagaaaatacaagcaagaaatgatgagtacattcgtggttgcttatggctagaagagggaggagggatagagtgtgactcccaatgggtatgagatttttttttttctttcctgtcttttctttttgaaacaggatcttgctctgtcatgcaggttgaagtgtgtggtgcgaccatgactcagtgcagcctccacctattgggatcaagtgatcttcccatcaggcctttcaagtagctgggactgcagtgcacaccactatgcccagctaattatttactgattttttttttttgtagagatagtctcactatgttgcccaggctggtcttgaactcctgggatcaagcgatcttcccaccttggcctcccaaagtgctgggattacaggtgtgagtcactgcaaccagtctgggtatgatattacttttggcaaatatgaaaatgttctaaaattaggtaatggatgcacaactctgtgtactaaaaactcttgtttcccactttaagctagttgttgtgctttgtgatatgtaaagttcatctcaataaagctgttttaaacagaaagatgataaggacttcttttttttttctgaagcaagccagggtaaggtatttacaaattatgctgttctctttatctctgcaatgacttttaaatcttgtccattcttttcatccattatgtctgtgtcatagtttgaaccctcatccagttttggtccaatacagatggtccccgagttatgatgtttcaaagtatgattttttgaccttatgatgatgagaaggtgatacattttaagtagaaacggtacttccagtacccacacaacctttctgtttttcaccttcagtgtaatgttaaataaattacaggagatattcagcacttcatcataacataggctttgtgttacctgattttgtccagcggtaggctaatgtgagtgttctgagcatgtttaaggcaggctaggctaaggtatgatgtggtaggttagtgtatgaaatgaattttgaacttagtgatattttcaagttatgtgatggatttatcaggatgtaaccccgttgtaagtcgaagagtgtctgtagttacacagaaataataatatgtggttttggttggtttctagttgtaagttgtaaggccttttatgcagactgctgcatttgactttaacatggttttcttacccccgttctttctcaggctttcctaaagcacagttctgatcatgttatattcttactgaacacttcacatggttcaacattgtctacaggatgaaatgcaaactttttaacttgatctatgattctgtcttttttgtcttatttttcacatcatgatcttactaagccacaattcatttttggcatacaaaacatcctggcgttgacttaaagtatactccacttttccacttctctgctttttgcccttctcctaaattcaagctgtcaacatttcacccattcagctcaaatgcttcctcctacatagtcttcaatcgcacgcagcagaattacagccttgaaaattacaaacttctttgtattttaattacttgtctatgtgcttgcctttctactctgcctatctattcaaattattgttcagttgaattttcaaattaatattgtattgtaagcctctttatttgtaattatagagaaaatagattcttatagaaatgatgaagagcaaaattccatcagagccaatacggaccttcggtctacagggaagaataagtaacagatttccctcgcccagcacaagatcgatggctgagaccccaacaacagaagacagactaacaacagaaaaacatagaaacttatttaatataaattttacatgacacacgagccttcagaaatgatgcaaataaacagggagtctgtattttttggacggttgtgcaaaattggactggaggacaaagggaatggtctaatggaaatagacaggggaggctgttcacattcctcttggtgtcctcatgtcacgtgctttcctcccagatgtaggacaagccaggatgctctcccaggaggctcttcaggagagaggggagggagaaggtcagagagtcaccttcccaggtttcatggctgctgcagggagaaagggcgaggggaaggtgagcaaggccttcctgcttctgttgttttctcaaacgcccaggcaccatgttttggggtggcatgtcctgaacctggtctggcctcacctcactataggctcctgtttcttttcttttttttttttctgtttccgcctccctccctctaaacattctaatttaccccaagctctcttccccagaactctcgtgtctgacagagctcgaattctgtcaaccaggctggtcagctccagactctgactaatgaaatgcacttgttattaacttatctccttcaggagcaactctcaatccatgactgaattgtacagatggaacacaggagggtgagatgtctccttgctggaaactgcacagtgtgaaggctctcgggaattgctttatggaatcagactccttcgttccttcgtgtacacctcctagatgcatttttacagaatcagactccttcatgtacacttcctaggtgcattttcctggagctcatctggagtccaggcctcagcttctgttgtacaatgagggatgataatggcagatacttagatacttttgagaaggccacctgagacgtgattgccaaaagcaagtgaggatgactgaatgagagaacggtgaatagcagttattttaaaatttatttttaacatccctacatttattgcaactgattcttgtaggaccacaaaatgtgaaacggatttcaaaccctagcagtgcacaggaatcatcctgtaaagcctttaaaagtacagatctggccgggcgcggtggctcacgcctgtaatcccagcactttgggaggctgaggtgggcggatcatgaggtcaggagatcaagaccatcctggctaacacggtgaaaccccgtctctactaaaaatacaaaaaattagctgggcgtggtgacgggcgcctgtagttccagctactcgggaggctgaggcaggagaattgcttgaacccgggaggtggaggttgcagtgagtggagatcgcaccactgcactccagcctggcagcagagcaagactccatctcaaaggaaaaaataaaagaaaaaaaaagtacagatctttgagtgatcacttttagaaggtccagggctgtgacccgtaagctaatgttttcaaagcttctcaggtaatttagaagtaactggtccttaggttgtcacgtgggaattactgattcttccgtacatatttagtaacatctagagtattctgatccatgagaatattgtctagatttcagagcttctttctgaaatttaccgagaatgaaactctcctgaagataggctttagatctcatcctatgatagtctcacagaaaagaaggtagcttgatggagagtttatggatattctacaacagaccttaatccaggtggtattttattttattttttttaattttttgagatgacgtctcacactgttgccaggctggagtgcagtggctcgaactcggctcacggcaacctccacctcccgggttcaagccattctcctgcttcagcctcctgagtagctgggactacaggtgcctgccaccatgcctggctaatttttgtatttttagtagaggcagggtttcaccatgttagccaggatggtctcgatctcctgacctcatgattcacccacctcagcctccaaagtgctgagattacaggtgtgagccaccgtgcccagccaatccaagtggtatgtcaaatctagcctaaagagctttaaacatttttcatgcatttatttaataaatatatatatatacacacacacacacacacacatttgcatacatgtatatgtctacaaacatatatacatatacacatatacatatataaatgtgtaaatatatacatatacacacacatataaatgtgtgtatatatatttattaaataaatgcatttttcatccacttattaaagatatacacacatatacacatatttgtatatatgtatgtatatatatataaaaatctgcaattttaaaaaacagcacaactggaataaatgtagacatatagtttatagtactttgtaattgtaattaaatactttcttcagaaaattgcattaaaaatttttttatggctgagtgtggtggttcatgtctataattccggcatgctgggaggctgaggttagaggatttcttgagcccaggtgtatgagaccagcctagacaacatagtgaaacccatctctacaaaaatttataaattagcctggcatggtggtgcacacctgtaggcccagctacttggaaggctgaggtgggaggatcacttgagcccaggagatcgaggttgcagtgagctgtggtcacactactgcactccagcctgggcaacagagtgagaacttgtctcaagaaataaacaaaaattatcataatatgaaagtattgataatttaatattcttttgttttttaaatggtaggataataatgtgatttctaacttgccttaccttcgtgtccactgctttaaagacagaactaacatgaggagagaaattagaaaataataaagaaaacgaaattcataaattaaaacatgaagacattatatctgaagggctcttagattgtataagtcaatttttccctagaatatgaaattcttacctatgagaatgaatgttaatgtacttttcaaactaactttcaccttacctttagatgaccttatttcatcagaaaagaagtaaaaaccaattcttactcagaatagtttgaacttacacttaattatcatctatgctgttatttactatagatttcatttaacacagatttttaaatgattattataattggtttcatgggtgagtttattttataatgagtaagagaaagaaaatgtacccctattttatgtcaaatatttttatagtatataatatcttcaaattgtaaatgaatatagagatttaaaaatgttaatagcttctaaggctgggtgcggtggctcatgcctgtaatcccagcactttgggaggccaaggtgggtggatcacaaggtcaggagatcgagaccatcctggccaacatggtgaaaccccgtctctactaaaaatataaaaaattagctgggtttggtggcaggtacctgtagtcccatctacttgggaggctgaggcaggagaatggcgtgaacccaggaggtggaagttgcagtgagctgagatcatgccactgcaatccagcctgggtgacagagggagactccatgtcaaaaacaaaaacaaacaaacaaacaaacaaaagttaatagcttctgaatcattataatttctcaagtgagtaggaatatatttttcttcaaagctcttgcaagattttctgccaatacatgatttagaatttcataatcaatatttattgtttagaaaccctaaaagactgctttcatatttaattttttgtttctgtgattattaaattatttgcctttttaactaaaagaaaaaagacttactcctttttcttctaggtactaccaaaatgcttttctgggaagaacacaatgtacacatccaaactgtaatcagctattttctcttgtgcttgcggcttttcagagctggattatttgacgaagtacatgctgagggctccatcagagcaatagagatagagatgatagagatggagagagatagctacctctgtctaggtgcagatataaatgatgtagatgcagatataaggtgttccatgaaagggccataaatgcaaagtggtcccctcaaatgcaaggaaccgaagaaagaggcggacaaatccagtttgcccataaaggatttattctatttatttgttagagaagttaaagacagaagtgtggtcttgggcaaccacaagacagctagatctctgcactaaaatccccaagacccagaacttacatcatgcggaaaagtatgtgtgttctggaagaatgtgtaggtggctgagagaatgctgtgggcaccacagtctatgagggacacagcaacaccaaggctggttttggaggaaaggcgaaacttacagtaaataggtccttctacaaaaagggtttacatcaactaaatatcttggaggcattccggggctcgagattcatcaggaggcacgtggtggattagcatctaaaatgaagtcactctcgtccctatacagggaataatttgatgcttgatgtcactaaggcacccatcatgagtaagatcagtaatacggaactgacggcattacatttgttctacagagttattaatctagattcaaaatttggataagagacaatatcatcttttctgttcttagagcctctctgagcctaattgggcccgagttgagtgtttccatttcagaaattgtggtgtcagcatgctcaactataaaataaactggttctttatgcttttagtaagtcatacctcttgcaatttactggaaaagtagaaatgcaaagagctccttatgcaacttaatcagaagaacacaaatcagggtcttttaatgaaggtttaagctgagctttgacatgcgaattaggagacaatgcagtaatatctagtatatcttaagttttgatatttgaaagatgattgtgaaataatttttctagtttcattggcatatctactatactctaggcaaggggctggaatcaacaagcaaaaatcaacaagttttgctcttgaccatctcacagacttgtgtttctttatttttttctctatcaagccaagctctatatgaaggcaattttatgatgttgcagattttatgatgttgtgcacttactttaaagaatagcctttacaactcttgagtacactcaattatatttcttatgcccactgaagtttttaagtacctaataaaaaatagtgtatcagaagaggtggcaccgtcaggaatatttcaccagtattaggccaatgaacattagctgtcatgttttcagcattatgtggagagctctgagtcaggtgcacacctccaaaaaacctggtgtgaatatttcagtctcagcaataaaatcacacttcatgtgttacgcataaaggaagatttattaccttcatatcctcttattaatttctttctttcttacatcaggtataattccatacctcagccctttggccttaaagagtaatttaatctattagcccagaaaaccttttaagtcaatccttgacatggaaggaaggcagatatttctttaagggtctggtgtactagaaggtcagtttctgtcacagatcccaggagccgtgcagctaaaaacaaaaccctctggtgctccgtcttttcgccagtacacgcctttaaataagaaacaagacaaaagagacagatcaacgctcatccctgggcttgagcctcaggaaaatggttttaagagaagacgcctgttagcgccagacaaaaggcaattagtgctcattcgggggacatcacgtggtgagggcatgtggactcccttcatccacaagccaagtacgaagggctattgctctgttactaacagggattcatctttaattattcacatttgtatttttttccccagtaggaaaataataatgtttttcatcctttcctgcatatatttattatttttatgtaaattaagagttacactacagagtttctcatgaagaaaaggaaaatacctaaaagatagttacattacaaagaagaaaacacaaatgtagcttcctgaatttttcatgaaaactcacccagaaggcactccatatttcagaaacaaatagcatgggggccttaggacacataaacaatataactgaataaaagaaatttcagaagtcttgtagtcctacaaatatttctctttttggaaaagatttattgaagcaaataaaatgataaaattatgcatgaattgaaaaatatagtgggatggaggaatagaacatttgtgatgattcttgataaagccacacaacataaggtatagaaagtttggtcaccagccaggcctggtggctcacgcttgtaattccagcactttgggaggctgaggtgggcagatcacgagttcaggagtttgagaccagcctggccaacacagtgaaaccgcatctctactaaaaatacagatagtagctgagtgtggtgatgggcacctgtaatcccagctacttcgaaggatgaggcaggagaatcagttaaactcgggaggtggaggttgcagtgaactgagattgcgccattgcactccagcctgggcaacagagaccgtgtctccaaaaaaaaaaaaaaaaaaaaaaaagtttggtcaccatccaagtaaagaaaaaagagaactaaatctaagaaagtggcagttaagtggaaaaggagaaaggttaaaaggaagtcatcgaaaaagagaaacagaataaaactagatgttttaaaggagaaaaaatagacagtggcatcaagaattgcttttaggtttcaagttgcaattcctttaagaagtactgtctgtgaataaatattttcaaagcaaggagaaaaaattaatttagagataagggccatagaaatgataaggtttgttttggttatgctgctcatatcaaaatatttaagtaacagtaatgagcaagtaggtagagatatgagtttggaggttaagaaataggtcctgatagccaggcgtggtggtgggtgcctgtagtcccagctactcgggaggctgaggcaggagaattgcttgaacccgggaggtggaagttgtagtgagcagacattgtgccactgcactccagcctggaccaccgagcaagactctgtctccacaaaaaaagataaaaaaaaaaaaaaaggtggggggaaagaaagagagagaggtcctgagattatgaaaaagaaatgagatctattcacaaactggcagcaccaacaatagagaatgtaagatgttggttgctattgggaactaagtgaggatgatagttgttagagcacattttaaaatatataaccagcatggcagatgtatacatatgtaactaacctgcacattgtgcacgtgtaccctaaaacttaaagtataataataaaaaaaaagaaaaaaaagaaaaatttacctgccctttaaaaaaaaaattacaacactgtctgaaataacagaaaaaaaatatatatatataaactgatgcaagaacttcataaatgataatgtccattcttcttacagaaatagtggaatggtcaaaattaaaactatcatgcagaatcaagggtgagttaggttcaagaaacaagggatgtttaccctggtcagatattgaagtcgatcgaagtgaaggctgagcaaagggttccagactggttattatcaagtatttgtagtgaaagtcactatgcaagaagtgaaagaatgataggattttgggaaagaatcataactactgtttcacaaggtttagtagcaagaagacaagacaaattgaaccttgggagactgccagcgtgaggaaaggctttgtcaggagacagagaaatgaaggcacgtttgtgggcagagcaaatgtaagaagaaaggcagaaatatggacaatgattaattaatgaaataagttttaaagaacagaaaaaaagggttaatatcgaagtccagatagtgagttaagcactaaaataggaaggcaatatgtctgtttttatcttttctttgagacagtaaaaaagaataagaggctggatatacgggatgcctttgtatagagaagatttatacagattatctggggtggtgttgatacacatggtcaaatgaaaaaatggagatttcaaacctgagaaggagaaaatagattaggatataaggagaaggaggaaagtcttttagacgatgaagtcatatcgaatcaggagacacatggtagtagagctacagaaataggactggacagtagggatctggagtggattagtatgagttttcttatccacttttctccagctgtgctaaaataggctgctagcagtgaagaaacaccataatgatcacagagttggggttaattagagtacagggatcgaaagtccaacaggtaagagatttgagagcatcagtgagaagacaattaaataaacttaatatggctctcacaatctaagttaaggagaaaagtgaagccagacagaggttgataaatcagaactataaggccagttcaagggagtagacctcacagtgagaacaaagctcaagttagttgctaataaaggcacagaaaaggtggaaagtaagatctattaaaaaagaaaatcgtaaaattcaaaatcagtaatactgatcaagcgcccattgtgagcaaaagggtaagcttttattgattcagaatgactaagaattgagatatctgatgagttaagaatgttaacttacaattagtgtttcatatataatatgtatataaatatatataatattatacataatattgatgtaatcactcctatagctaattaagtacatgatattttgccaggtcaactgttatgtttattagcaacagtcacgggaatatctgaaatgttggaaatcccctatcccaattcaatattaatgaaagtaacagaaagttacatctttctgttattatatatagttacatctattcttatatctatctttctgtatcaaatatttatctccctatataggtatatttttaatctgtatctttatacataaagtattctgggtaaactgcacagaccttagcatattaaattctcttcttcggccgggcgcggtggcttacacctgtaatcctagcactttgtgggaggccaaggcaggtggatcacttgaggtcaggagttcgagaccagcctggccaacatggtgaaactctgtgctactaaaaatacaaaaattagtcaggtgtgatggtgtgtgcctgtaatcccagctactcaggaggctgaggcacaagaacccgggaggcggaggttgcaataagctgagatcaggccactgcactccagcctgggtgacagagagagactccatctcaaaataaatcaaataaaataaaatctcctctcacacactaccatcttccctaacaggtgtgctaggctctagaagtttgaaagacagaggggtgaattacttctgtattcactcagttgtataaaccatatgtcctcatccattttctactactatacagaatactacaaactggataatttataaagaaaagaaatttatttggcttatgtttctgggggctgagaagtccaagatgatggcactagtatctgcttagcatttgattaaggtgttcttactacctcacacatggcagaagagcaagagagagagagagagtgagagtaagagaacaggaggaggcagaacttcaccttattttcaggaaccaactcccatgatagcccagttctgagataacagcgtcaacacaggcatacctcagagatatttgtggtctggttccacactacctcaataaagtgaatattgcaataaagtgaattacacaaaatttttggtttcccagtacatataaaagttatgtatacactatactgtagtctattaagtattcagtatcattacattaaaaaattagatactttaaaaaaatcctgttagctttatctccagaatatcttccaatctacccacttttctttatgtctatcagtaccgtcatggtctaagccaacagcgtgctttcctcaggctatcaaagtaggcttttaactggctcctcacaggagaccaaaatgaagaaaaagaacaataacaacaacaaaaatagatactttaatttaaaaatattttattggcaaaaaatgttaacagtcatttgaaccttcagcaagtcattttcattttgctggtggaggatcttgccttgatattaacagctgctgactgatcagcatgatggttgctgaaggttaacgtggttgtagcagttcttaaaataagacaacaatgaagctaccacatcaactgattcttctttcacaaaagactgcaccgtattctatgatgctatttgatagcattttactcacagaagaacgtctttcaaaattggagtcaatcctctgaaaccctgtcactgctttatcaactaagtttatgtaattttctaatttccttgttgtcatttcaaccatgtttatagcatcttcaccaggagcagatttcatctcaagaaaccactctctttgctcatccgtaagagtagttctttatctattaaagtgttattatgagattgcagaaattcaatcacatcttcagattccagttctaattctagttctcttgctattctcactacatctgcagtgatttttctccaccgaagtcttaaactcttcaaaaccattcatgacagttggaatgaacttcttccaaactcttgttaatgttgatattttgacttcctcccatgaatcatgaatgttcttaattgtatctagaatggtaaatccttctgagattttcaatttactttgcccagatccatcagaggaatgatccatcactatctatgggagatatcgccctacaaaatgcatttcttaataggacttgaaatttaaaactactccttgatccatgcactgcagaatggatcaagaatggctgcagaatggatgttgtattagcaggcatgaaaaccacatttatctccttgtacatctccatcagagctcttgggtaactaggtacattgttgatgagcagcaatattttgaagcacttttttttttaagcagtaggtctaaatggtgggcttaaaatattcagtaaactatgctataaatagatgtgccatcttgcagggtttgttactgtattcctagagcacaggtagggtagatttaatgtactttttaagggacctaaggttttcagaatgctaaacgagcactggcttcaacttacagtcattagttgtattggctcttaacaagcgagtcaacttgtcctttgaagctttgaaaccaggcattgactgctcttgctgtgaaagttctagatggcattttcttccaatagaaggctgctttgtctccagtgaaaatctgttgtttagtgtagccaccttcattaattatcttagttagaccttctggataacttgttgcagtttctccatcgacactgctactgcactttgcacttttatgttatggagacggtgtctttccttaaactgcatgaaccatcctctgctagctttcaacctttcttcttcagcttcttcacctctctcagccttcgcagaattgaaaagagtagtgccttgtgctgaattaggatttggtttaagggaatattgtagctggtttggttttctttcacgaccactcaaactttctccatatcagcaataaggctgttttgctttcttatcatttgtgtactcattggaaaagatttccatcagaagctttttgtttacagtcacagtttagctaactgcttgacataagaggcctagctttcagcctatctcagcccttatcatgccttcctcactaagcttaatcatttctagactaaaaacacttagtcacttgaaaagttagaggccattgtaaggttattaattggtctaatttcaatattgttgtgtcttaggtagtaggaaggcctgaggagaaggacagagatggggaaatagttaaatagttgtttgatgaagccgtcagtacacatacaacacttaataagttcagtgtcttatatgagcacaattcatggtgccccagaacaattgcaatagtaacatcaaagatcactcatcacagatcaccacaacagatataaaataaaaagtctgaaatattgcaagaattagcaacatgtgacccagagacagattaagcacatgctgttggaaaagcggtactgatatatttacttaatgcaggggtgccaccactttcaatttctaaaaaatgaattatctcaaaagctcaataaagcaaaatgcaataaaacgaggtatgcacatcctaatcacatcctaaaggcctcacctcttaatactgtcgtaatggcaattatgtttccaactgataaactttggaggaggcacattcacatcgtagcaccatataaatgaatgcaaagcaaaatgggcccaagtaggttgttgaaaaactaatgggtagaagggtcttggatgctcacattaattggaggaaaatgaaaaagagacagtaggataatcaatggcaataagatttcttgccatggaaaggtctaaactagatatgaatgaaaatccagctaaatgcaaagatcaggatcggtcttttcccttttttcccaaatatacactatgttattttctactttatgtctttggtacacaaagtgaaatatggcatgggttgccaaattttgcaaagtaaataatacatagaattcagaccctactggataaatacattctatttttaatgattcagaagggccctcatgaggatgattatttttatttgtttatttacttatttattttttgtgacagagtttcgctcttttgcccaggctggagtgcagtggcacaatctcggctcactgcaacctctaccttctggtttcaagctgttctcctgcctcagcctcccgagtagctgggattacaggcgcccgccaccatgcccggctaatttttgtatttttagtagagacggggtttcaccatgttggccaggctagtttcaaactcctgacctcgtgatctacccacctcagcctcccaaagtgctgagattgcagatgcgagccaccatgcctggccatgatgatgatgatagattccttctcagcaatccagaggaattaaatctagtctatcttaatccatgtttatcaacctgtattgtgtaattcaattaggcacttaacattagaaacttataaaaacaaaagtagcataatactcagctgtgttaagaaaaatgtgatatcaactactcctcctttattacagtgactcagaacacccgtgtccttcccaacattggatgcaatgctaaagacatgatgttgctcctgctggaccacaccttgaaggaattgcctaccccacctcacctccaaaattaaagtctttcgttttgacaaaagttaatgataaggtttgatgtgctaatttcagcacctccacttcatgtctacactgtggacatatacttttttgttgttttggggtttttgtcatgtttcactcactttctctattattctttatagcaggacttgctttagagtcattactttctgttaaagttgttccttcaaaagttgacaattactggctgggcacggtggctcacgcctgtaatcccagcactttgggaggctgaggcgggtggatcacctgagattgggagttcgagaccagcctgaccaacacggagaaaccccgtctccattaaaaatacaaaattagccaggcgtggtggtgcatgcctgtaatcccagctactcgggaggctgaggcaggagaatcgcttgaacccgggaggcagaggttgcagtgagccaagatcacgccactgcactccagcctgggcaacaaagagtgaaactgtctaaaaaaaaaaagctgacaattacttttcattggcttcttcacacctaacacctatcttttcacacaaggcagaaataaattgctattagctaatctgctaaatccacttagaaatataatcaagaaaaaggaaaacatccttgtgtccaaggcattctgatttgtaaaaatggtttgtatgtgtcatttactcaaatcaactcatttcaccaaaagtactcagaaacataaccctaaacatatgtgtattccatcccaaagtttttcatgtagtcagtatttttgtatagtcacattataaaaatattttatttaatagtgttgttgatatattagtatatagtgtgagattcagatacttaaattttttgaaaacttgcattcattaacatatcaacatatattttctccttttatttacattaatctgtgatatcaacatgagagcaagaattatattgaaatttatatttttcctggaaagaaagtgaagttctgtgaacatgagtaatttgctcaccaccatctagccagtatgtctgtagaactgagatcaaaatccagttcttctaactctttctattttcaaagtagagattcctcctaatgccaaacaagagttccctggctctgttttctatcctaggaggtgattgtcttaatgattttgttttaaattgtatcttttttcagttttatgtgcagaggatataacatatacaaatataattcatggaaacactcaggttgttcagagttggaatgtcagtgattttgttgttttaagcactatgacgtgtaggagacacttacatatactaacagtatagaaaggaatgatcttaatattatattaattataattaattaacaaatttgcataaattttactaaaagtatgacatcagccaacagaatattagtagtcaagtgtgcacattggtgtcaaaataagacagtttctagcctcaaagagagtagttaggaaagcatcattatatacacaatatcatatagtatatcatatttctatagtgcttacaactacaaagcacttcccctccttttcttcctactcaaaatgatcttgtgaactaagcagggcagggcttcattctattttacagataaggcagccctagatcagaattcatggcagacattcaatcttcaaacacgtatcaagagactgctatgtgtcagcagtgatttgggggcactgggcatgggaagctaacaccagtagggtgcctcccacaggcttccagagtaagggagaagaaggaaccatcatccgtcactgggaggctgtggtgactgccataccagaggacaagggaggcagaaacagtctgaaggctcaaccgtgaacaatgtgtgtctttgaactgtgaacccagtgtgtctgtgtttgattccagtgcctttttcaggagcaattgagtcacaagccatgagattctgatgataaatgttactggaattcagagaaggaaagaacattgggatgtgctggaaccgttagagtaagtgaggttcagtgttggctttacaggatgggttagtggttggatagctacagggaaggggaagcattccaaagaagcaaattacaaagcaggagcttggcgagagacagtgggtcttgctatggtggttaattctgtgtcaacttaactgggttaagggatacacagagagcagataaagcatcgtttctgggtgagtttgctggggtgattctggaagaggatagcctttgaatcagcagatcaagtaaagatttgccctcaccaatgtgggcaggcatcatcccatccattaagggtccaaatagaccaaaaaggcagagacaggatgaattctctcttcccttcagctgggacttccatcttctgcctttggagatcagagctcttggttctcggatcttccaactccaggatgtacaccaacacatcccccacttccccacccaggctctggctcagactgggatttacatgatcagccctcctacttttggactcaggcagaattacaccacaggctttcttgggtctccagctcacagagggcagatggtgggtcttctcagcttccatgagcatgtgaacgaatgcccatgttaatgagtgtgtgcatatgtatacacacataccgatagattagatagacagatgatagatgatagacagatgatagatgatagacagatgatagatgatagacagatagatgatagatagatagatagatagatagatagatagatagatagatagattctctggagaaccttgactaatgcagttgggaatgaagtgagttgtcaaatctgacagaggtagtgtatgtagactgagaaaaattagaaaatgaagcttcaccagtagaacggcacaaaattataagtgaccattaaggctgggagagagagtttgatctttatgcagaagaaaatagggtgtggtatgcagaagggtggcatgacaatatgagtgatttagaaagcttatcgcagtgaaagatggattccagaaggaatgggtagagacagatttatcagttaaagagctgctgtaacattccaggcatgaagggtgaaagtctgagcttcagcctcagtagccagactcgagaagaaagggtaaattcaagagacactttagaagggaaaatgatgagcacagtgacagactgcctctagcgaatttcaaaatggcaagcatcaaacattactcttctctttgtactcattatgcttttcatctcattgtactttccattaattctttatgacgtgtcatttgagcaacaataatttaaacatttaagaagatgtgtgactatcattttctgagaagtacaatgagatgaaagatgttaaaagtacactgcatatagtaagtgctcaataaatgttcatgaagaaattaaaatttaaaattgctaacatataaatcctttcagagataagttttgggatctagagttgtcacacttgagttatacaaagcttgaagtcaagaacaaagaaatgggggttttaagcagtaaaatgttacaggagactgctttggaaattcaagaaaagaaattgatacaaacaactcgagagatgatatattaaaatacaaatgagaagtatcccatctaatttttataccagaggtatactattgaatcagcaaaattatgaaatttttatggattggtagtactagaatatactcaagagagctcagaaatgaaaacgtatctgtctagtgacaaaaaactaaaaatgaagttttatctctgtcaatgatttgtatatgataatgactgtattattattatgaacaaaagctgaataaaaataaagatattattaggtcacttcatgaaattaaatttttgaataacaagttaattataaatacaaatcttccaacatttttcgatccagatgattctcacaaaatttagagacaaatgtgttgtgcactgacttcacaattgaggaatggaatcaaaatcattgctcaaatgttaattataccattttgcttgttcagaaaaacatatctcagtaaaatctgatatttataagtttataaaaatattcacggaaattttttacaaagaaagaaaagccaacccagtcaatataaaaatattaattttataaataagaagtttgcctcttattcagaaaaatgtttttccccagaaaaattttacttacattaaacatcctaagcaaacagctgaaattgttttgaaacatacaaaatattgatgcgatgactgtctagtaaactagtttatttggaaattttcaatcatgtcattcatatagattctgaaattaaatacagaaaaacatctccaatgtacgtacagtttatgcactgttaggaggttttttctctgtgggaacaccatagggtacccttacccaaacctagatggtatagcctactacacatctgggctgtatggcatagcctactgcttaggcaatgagcctgtacagaatgtcactgacagcaggttactgtgctgaatactgcaggcaatttaacacagtgtaaatatttgtgtatctaaacatatctattataattttatgaaacctctattacatatgaggttcatcactgaaacattgttatgggaaacatggctgtatattcccctgaaatcattaattttcatcatttatatgctcagcatcatttatatgctcatttatatgattttatagagttgttcagatttagttcatgaatgctttcttcggttgcatcctacctaaacctttacagagattcatagctggaattaatctgatttttttccatagtacatgtttatctcctttacagcacttatataacaatgctgctatagatcagccttccctggcatgtgtgaggaattcattcagtatttgttcaataagcaatacattgaactttgaacacctcttctttcttctctggtaccctggatacggaaggtgctcagaaaattgattctaatctcttcatatttttgcagccctcagcaatgttaaataacgtgtttaaaatgagatacataatttagggttaaacttcttttttacacatattagaagtattttaaaaactaaaagagattcaaaccgcaatcaaatttgcctttgttttactaaatgagaaatgctaatattaggtttatgataaaaatattttatcaggaacaacagtaagtaaataatttttttaaaattttgacatcacttgtcctaatgttatatcagaaatcttatctaatctgttttttacctgccattgttctctgagaggaatacttgacataatgaactcaaaatacgactccatgtttatttttgtgtccttcctcagttttacttcagtgctcaagttgtttgtctctattttaaaacattttctttaaataaaaatgcgtgtacaaatcaaggttgaagctagatgcatctttcagtgatcattgactttatctgtgtctttatcaagaataaagagctagctaatgtcagaaccagggtttaatttgttggccggggcaggggtgggggaggctctgttttttcctattaaaaaatccaacactgaagtatcctcctgaatacgtacattgatatattgtgtataaagagaaaaatgaacatgtaatttgtctcctttaaaaattgacttttttagtataatgacacacacaaagtgcaataaggcaattctcccgaatgcattttctttgggcagacagatgtaagatgacttcaggagcctcaataattcatgcagcttcctatattgtcttttacattcataacactttaatctattgttccattgtcttgcttggccaatatagagaagtgatgactgaattcggtttgaagtctcagtcttttctcaccctggttttcttgtttctattctcccacaccaataaatacgtgaaacctaataaggataaaaaaattctgttgagagtagaacgatattttaaaaacacgaggtgtgacttctagagataggtaagtttagacacatgcgtgctgcatgccaatggacttgttatgctcttttttctcttcaattaatcagtactagaattataccagagacacatcttatagccagtttagtgacattgcttgacaacgctcacatacttactgaacgaagtttataatttttcatcctcatagcaccttctatccttattacaactaagtatgtcagaattgccttattatatatcacacacgaaaaactaattctaagagaagttccatcatttactcaaggtggcaggattactgtcttaatcgaaatttaaactgaagttttctgattaaaatcatgtgataatagcattactctctgggaactcacctgtcagaggtaacaacattttgtagctttcctaaagattttttctcaaggagaaaaatttagggttctagatgaataagaggttacatcttaataaccttcaacacatatcacctgtctctaaaaataagcctgtaattgtcagactcctgttgattaatttcctttgctgggaagacttgatcccattttcattgcttccctgctagcaaagccctgttcctgtcaaatcatgtgtattacagtgcttttgatttcctctacaattagtctagttttttaatgatagcggtatgtgcccatgataaaactgtagtctgcaaaataggaaatggtgttaagaacaacataagaagacttttgtttcccctataattagagcggtccaaaatggaataggctttctcctaaaagaaatatttataggtgtgctgaagctggtattgtatgacggcaggtcagaatggcaagaagaaaaatcctgcatcgactgaggggtggatctagattagtcttttctagcactttcctcgtaagaatcatctagggagtttgttaaaatacattttcccttggttctggctatctgtgtgtcagctagatcccgaggtcatttttacgatctggaagttttgacaatattgcctcggcagatgactaacagaacttccgcctcagcaaaagtctttgcactggggctaggaatgtgtcaagtgagagcttttgtgttttgcgttttttaaattagtattatttttattgacaaatcataattttatatgtttatggggtacaatgtgatattttgatatataacaatgtgaaatgattaaattgagctaattaacatatccatcatctcgtttaccgatcattttttatggcgagacgtttgaaatgtactcttttagtcatcttgaaatatacagtatagtactgactagagttgttctgtcgtgcagcagggggagggagggagggcatgggaagttgttgaatgaggggtacaaagtgatagctttaagttgtgattaagctgtggttcctagctcgagggttgaaaacagttgatggactgcaaagaatataaggcataaaaaaaaacgcaagaagatatagaaaaagaaaggaaaggattgaaggggtgggagaaggaagaaagaaatgaatgtaaggagaagaaaacatgaagaaaggaagagagagcgagaaaaaaaggaaggagggaaggaaaagctgagctcagatggaagaggggtatttaatgctcgttgaatgcatgtgccaaatttcagggataaattgggcagagtagaaaataaattaaatatgactcaaatccatagtaaaatataaactggatcccaggccaatttttttttcttttcatctactgtcagaaaagtaaagtttttgtagtagggaaataaggaacatttgatttttataaatctcctaaaacattaagaaatttttgagtttgaggtgaactaggaaaccaaatatcaaatatctgtctcttttgtaattatttcttgcctggctctcaacctactgtcttctcttttttaattaaaggcttcctgggatacatatgtactcatatttggtcatgatatcttttgatacaattataattcaaataatttaaattatcaaagaataatttccatttgtagagatgctgaacagactctaaggatgaccgtatgttccaaggcagacatgatccacacccaaaagcgtaaatagcttatatgagcagctcttagaatgacagccatatgcaataatcagctggacacctgtctctttgtgtttgcatacagcaaaatatacttagggagcatttctacatcacaaaaggaagttttattcagctttattatcaatgaataatatatcagaatacagtttgcatagtgccactcataccaaaattacagtgaattttcctcttgagatgactcagtctcaataagagatcatttgtctatatacatataacctgcacagaatgcaatttttgtgcataaatattaaatcattatgattcattttgtttaaggaactaaaaatacagttaaatctattattgtgcctaactataagagttttctgactatgcattacaatgtttgaatcaatataattttattatatgtatgttgttatacagtttaaaagtatgttagcttagagtatttaatatgtggcactcacagacaaataacaaaacgaagtccctagaaaatagcatgatattaaatgttttatcatgaataaaaaaatatttgaatagtgcttcatagaataattacctttctctgggtttataatattggtaaagtctaaagatcttctgattggaaaggaagataataatggtgtcttaagataacctcttgaatcttctcagaatcactcagaatgagacagaaatgctagagggttcacaacgagcatgctgttttgtcagtccccctcttcatccttaccatggtacagcagaaagttgctaaggatttctctcggtgaaatctgagctttgaccacattttgaagtcactccatatatacctttggaagaaatgccaaagacaatcttttgcaaaatttcttgtatttatttgtaactgaaaaatgattgagcagctattttgtgccaggatgtgggcaaggtattgagaaaaaagaaatgattatggcattaattatttttctccagcagttcacaatattctacaaaaaagagatactggggcaaaaccagaaacaaaactaaacatcagtaactaaatttttccacactaaagacacaaatgaggtaatatatacattaagacttaaaatttaaatacatccaagcccctcaagctttttcccacccagattatgccctctgcaaatcactctacagctgctgggatttgtttacagtggagctgggcacctagaactgttgtgaacatcaggtctggcatgtgtggcatagggtcagggccgtgcatgttcccttaggcttcgcatgctggtcaggatgtgcacatacttggccaagcctgtgcccagggcagcagtgtcctttgccctctgtgaagggctgactggcccggatttgttcagttcagcctgtttggtgagaaatctctcatggaccttttctcactggataaccacaaagagatgaatttagattatattctctaaatataatctacattataaaggagggaactggaaaaaggatgctggagttgaatttgccttccatctttttctacggtttccttgtgtcaaaaccatttctgtcctcatattgccctttcaaatgctaattacatttaaagtttttttcacagagcactttacagtttacaaaagtaattcaatgtgatttcatggaataggaaaataacatgttggtgtgaatatctgaggctttattctcactaagtacagggtacagatacagtaagtgaagctggtgaatatttgagagccgtgggtggtggtccgcacctgtggtcccagctacatggtcactaagtacagggtacagatacagtaagtgaagctggtgaatattcgagagccatgggtggtggtcggcacctgtggtcccagctacatgggagaccgaggagggaggattggctgagtgcaggcctggaaggcaatgtgctaggatcatggcgctgcactccagcttggcaacacagtgagatcccgcctctaaaacaacttaaattttttaaacaatgaatattttatcatagtaacagtagcaaattttaaagcatttattattgaccaggtatagtggtatagtgataagtaggtacatatattgttttatttagtgtttaaccctcaggaataagtatgcttattgcccttcacaggtgggaaaagcaaggcaaagagaaagtgaacaacaatgaaactaggaacgtaacccaagcgctcgtgccagagcgtgtatgctcgatcttgggaccacaccacttcccttggtaaattttcaagcatttagtatttgtgtgaaggcaatcatattgtgcagaggaatgaccaggctacaaaacacagtgtgtgggagaccgcttaatgctaacactaattctatgggtgacattcagatctataaaagattaagtgaatagagctgacttattgagaggggtttgttgtagtcgacttaaaaccaataaaagacaacatgatgtcttaaagtcacttcaagataaattaatcaacttataagcacatatagccattaagatcaattcactttacaaagattagaaaatgataaaggggcataaaatacaaacttactatctgagaaaatcaggttgtagggcttttctcctgcaaaatgaagtaattgtcagcaatgtccacttggtagaacagtgttttccactgttctcttcatagctttttctaatacgatagttaaaagaggaactagctcttcagacccaggcagttgaaaaccagctcattgggttccagctccacgggtccttctctacatgtttattgcacataataatgttcctcttggggaaaatatgctgcaatatccctctgatttattgtatttctacatattgttaatgtaaggactctggtattcaacaaagaaattatggcacatctgggtacacagaatattctaccttccacagaaaaggtcaggagagaaagaaaagagagaactgaaatataaacccttcaaattgaggtgaaatcctgactttgccccttggttggcatcatcattaatcactactaagcaactgcaattagaagagattaactggaacttagagttgctaaacaaaaagaaaaaaatagaaaggaaataaagctgtcttcctacgatagacaaaatcacagggccattttcttccattgatttttgctctcattaagatatattcatttactttccttttgaagcttgacgtaagaatcttgaaactagaattgtcttcaatgaattattttgcccattactcttcttatacagaggtgaattccagattggcttgggacaatgactgtttatgctttaaccatctccaaacgcaaataactagcaaaactctttatctcattctagtattaggcactccaagttctgcagcaaatattcactctgatgaccatatggaaaataacacataatttctgctttcttgtatcttaaaatcagaagatgaagccaaaacacaagataaataggaaatccaaacagtgaccccaaaattgtgttttgtgaaagaagaatagaaacacaaaagtggagagagagacctcattaggatgtgagtagcaaagggggttcagtgaagcagcagagcttccgttatgtttataagagggataacatttagagataaatcttaagatagagaaaaaagaagctgatgcaccaagaaagagaagaggagagcattagcatagtggtgcaggggctggaaccagcaccatgtgtttgtggaaacaaggaagacaggattatcagtcagcttctggaaggtatgttggaaagggtttcacaaatgtaaaagaggttattgataaatgggaagtatatacaccatatatttaaatacaatgtatttttattaagcagtgacctctttaaatgtaaagaatgtgtgctttctgacaaaggttgaatatccagcatcataaggaacttaaatttacaagaaacaaaacccataaaaaagtaggctaaggacatgaacagacacttttcaaaagaagacacacatgcaaccaacaatcccacaaaaaaaaggtcaacatcactgatcattacagaaatgcaactcaaaaccacaatgagacactacctcacaccagtcagaatggctattactaaaaagttaaaaaataacagagctggcaagattgtagagaaaaaagaatgtttatacactgggagtgagagtgtaaattagttcagccattgtagaagacagtgtggtgattcctcaaagacctaaatacagtaataccatttgacccagcaatcccattactggggatatatacgaaggaagataaatcattctattatagagacacatgcatatgtatgttcattgcagcactgttcacaaccgcaaagacatggaatcaacctaaatgctcatcaatggtagactggataaacaaactgtggtacatacacaccatggaatactatgcagtcatagaaaaagatcccgtgctttgtaggaatatggatggagctgcagaccattatccttaacaaactaacacaagaacagaaaaccaaacaccgcatgtactcacttataagtgggagctaatgatgagaacacatggacacacagaggggagcaacacacactggggccttttggagggtggagggtcggaggagggagaggatcaagaacaactactaatgagtactaggcttaaaacttgggtgatgaagtaatctgtacaccaaacccccacaaaacaagtttacctatgtaacaaacctgcgcttttactaaacttaaaaaaagaataaccacatgtgcccttaaaaaggaatgcacgccttatgcttagaattttagtaaaaaatggttaaacaggtggttttacatgcacacacattttgacagctaaatgagactaaaaggttgagtcctatggcagccagaaaacaactgtaattttatcttgcaacaataggaaaaaagttcatcttaaagtccacctgggatatcactattttgttttacaggcagttagacatgataataatcattcatctacaatatttactggtcatctactatagccaaggtacacaatttttgtaattcagaagcttagacaggtcctgataaaagactttcatacagacatatgtttatgacatatacctatggcatacatttataacatggtgtgtccggaattggtttcttccagtgggttcttggtctcactcacttcaagaatgaagccatggaccctcgaggtgagtgttaacagttgttaaagatggtgcgtccggagtttgttccttcagatgtgtccagagtttcttccttctggtgggtttgtgatctcgcttgacttcaggagtgaagccacagaacttcctggggagtgttacagcttttgtctggagttgtttgttcctcccaacgggttcgtggtcttgctgacttcaggaatgaagccacagaccttcacaatgagtgttatagctcataaaggtagtgcagacccaaagagcaagcagcaccaagatttattgtgaagagccaaagaagaaagcctccacagcatggaaagggacaccagcgggttggctgggtggccagcttttattcccttatttggcactgcccacgtcctgctgattggtccattttacagagtgctgattggtccattttacagagtgctgattggtccatttttacagagtgctgattggtgcatttacaaacctttagctagacacagagtgctgactggtgcgtttacaatcctttagctagacagaaaatttctccaagtccccacctgacccagaagcccagccagcttcacctctcaatagttataacagttaataagagcaatgttgaagatatgcataggtagaaaaagggggttcagtgaatttaatctgtattagggattgttaatgatgaagtatagtaattatatttagccaaatggaagagggataggtattctgcatagaaggcacaacatcaagctataggggcaaaaaactagtatttatgaagctacaaagagtttggtattgttggacataaagtagatgggaggaagaatgagactgacctatagaaaacataaagcagatgatggaaacctttatacaccagttaagggtttgcttcttgttgtctatgggtagccattgagaggtctaaaaaggggagaatcatgataatcgtagttggagagagataaccctgatggctggtaagaatgtagagagggaggctatttggaagttaagtaagaaggatggtcactcctaaggccaagatctccagcctcactggtctccttgttgttcctccaaccacacacccaccctgacttggtcctcctctttctgggacactcttctcccatttattcatggctagctcatacattctttaagtctttactcagttatgacttcatcagtgaggcctacactgacaagcccatttaaagcttgggatttttttttgttttttgctttttgttgtttgttttgagacaggatttctccccttcacccaggctgaagtgtagtggtgtgatcaaggcttatgccagtttcaaacttctgagcacaagtgattctcctgtcttagcctcccaattgcctggggctacaggtgcccaccatcatgcccagactccatttaaagttttaatctcctctacattcctaatcctccttatcctgttccatttatcttactctatcctgggtaccagcttctgatagccaatgtattataatcattgtttattttctgtcttccccaactagaattaagcttgagaaaggcaggattttgctttgttttcttggccaaatcaaactcaaaactcagctttaggagtgctagcacatattaggcattcggtaaacatgaacttaataaatgaagaagattaagatggaaggtccagttttttttttttgttttttttgtttttttgttttttttttgagatggagtcttgctctgtcacccaggctggagtgcagtggcacgatctcggctcactgcaagctccacctcccggggttcatgccattctcctgcctcagcctcccgagtagctgggactacaggcgcccaccaccatgcctggctaatttttgtatttttagtagagatggggtttcaccttgttagccaggatggtcttgatctcctgacctcgtgatctgcccgcctcggcctcccaaagtgctgggattacaggcgtgagccactgcacccagtcaatggaaggtccaatttaagaaacattgagactggtgaattattggatatggaggctaagagaaagagccaagaattgctccattttccagcatgggtgactagtgggttattatttccctaatggacaaagagaagctggagaaggagttgatgtagaaagaaggtgctgaattctgttttgaatatgtggagcttgtcatgcctgtgggatgtgctggcagatcccacagatttgtcccacagagatgtccctttaaagctcagagaagcagctaggatagaaaagaaaaatttggagtcatcagttcccaagtgatgtgaagaccctaaagtggaggggaggccagggagagtggtgcccgagatgacagtgtactaaggacaggattttaatgaatatcatgaataatgatagatgtatagtaccatgacctgtcaatagttaagtacatcttcctataagatgatttgggaagctaacttgtggtgatgacgtgacctgggacaatcccaagaggcaagggggttggttgaattatcacagtcctcacagctgctcaagcttctgtttgtgtgtcgccaattatgctgaaggatctagaaagatgtgccctccctgctcctcctcaggcttagcatgcactcagtggtttctgcagcaaagttgcaaactttaatgctctgtatttgtcggcagaaataagacccaaattcctaaacgcatttctaattaaactatttgattctcagctaattgatattcaattagcagatatccctaaaatgactaggacactggggccatgtagcgatgttctggaatgtgactttgaaagctgcgttgactttagaactggctacattcattttggctgaagaggtcacctagagtataggattaaaaggaaagtgtatttttaaaaatattatgcgatatttaaaaaataacatactttaggttcaatattattttatgactcacacatgccatatttgtgtgaaaatcaagaggcattctgaaatcattcgattctttttttctgcctgaattttttactttaaaaagattattatgacattccattagtggttttgacagagtgatattggattctcaaaatgaaagatgtgtgtgaaatatcagacttgtcttatttttgaaataaagacagtggcccctctcacctggaagagtgctgtctcaaacgattagatcctggcagacaacagagaacaaacatattttgattaaattatttttctattcaacctggtgcagtgcgtaacctctatgtctatggctctttgtttgatcttttcatggaggtgagtgattttatttacaaaatagaggccaagagaggaagttaaaatatagaatgatttgtgtactcatggatatgcaaaggaaggtttgaattagtcagaactacatttagagctaataagctactaatgtctaatgtctgcctttgagaatctgttttttgtttttgtttttgtttttttgtttgttggttttttttttttttgagatggagtctcctctgttgcccaggctggagtgcaatggccccatctcagctcactgcaacctctgcctcctgggttcaagcaattctcctgcctcagcctcccgagtagctgggactacaggtgtgcgccaccaggcccagctcattttttatttttagtagagatggggtttcaccatgttggccagcatggtcttgatctctttacccctgattcacccaccgtggcctcccaaagggcaggtattacaggcgtgagccaccgtgcccagctgagaacctgtttttaagggtaaacaatagtggatggtttataatgaagggatccagggtaagaagctatcccgagagagttgagcatccccaaactaggggactgagtttcaggatcctgagctcccagcagcagaaagttgtcatgttggtgacacatggatatgaatggcctgtgcagctgaaaaaggttgagaaggcagttggctaaaatttaaattgtcatccatgtaagtaaaatgatttgtgcagtgatgatcatacctggaaaaagcagtgctgggaaaaatagagccaagaaaaatgcgagcagaaaggcataaggcaagagactcgtcgggcacccagaccagctactcacagtggtttattctcttgaggagtcagaatggggcctggactcaatatgacgttttcacagggcattgagggaactgcaactgcaatgtgggttacttgctcgccgcatgcgcagcccaactaacaagagcgaagtttgggtacgaagcaagtgagcttattccgaagcctgcctgaggaaggggcacagcgtcctgcctttaaatatgccacttcacctttggagcagaaagtggtacttttataaggtagtggaggaagtgagcaagagcagggtcccccttgctagcttggtgccttacgtaccaggcaattgagttggtgccttcctgggcagaaataagttgtcaaagtggccaagtggacttgcttttcacatgccctcttggtggatgaaagttccgaggctgcgggggccgtgctttggtctgcaaattaatagactgtcaactctccaggagagatccctcttggagcacagagttaaacttgctctgcaggaaatgtctgcggggggtggccgtgaaaggttgtgtttacatttccaaagggctaagaaacagggaaaaggtggaaaggagaaaaaaagagaaaataatgtttaaaaactatctcttagaaaaatgtgggtacccggttacagaaccgcctgtggggccatgcatggggattatgaagacggggttgccacttactttctttgctaagaacttcctgtcatcttcccatcagcagcgagagcactgggaaaacttcttaccacctcactgcccgagagcctcacctcatccaaacatcaacaaatccagcctcatttttcagaagggccaccttagtctttccatgatcacaagtgaaataattaaatgactaaaagttgtacttgtacaggtcacagccagataatccttcatttgcagttaactaaacagcatgctacacaattggatgtaaggaatgaaggtgacatagcaattttccatctgtattatctgagaccatgttattggaaaacggatggtcctaaaagtagaaatgaaaagttcacaagggcaatgatgggaagttgttttaatgggatcctaaggtctgcttctactaagcaggaaacagagagtgaagcagttactattttcttgctcaacaagtgaaagcaaaaagagaaatccacgttacagagaagactgaaacagaatcccataaaaatgtttctcagtatcatttctcagaccaaccaaattgttgtgtttcttaaactgagaagttgaaataccagagagaggtcagaattctgctgagatgtattagaatggttgaggtttggcctattggagttgcagagattcttctgcttaagacctcttatgaatgtttgtagataataacagtccctcgccagaggcttagcttgtcacctctgcctaccatcaacagatgctttcctgatcacactgttttttttagccttagccactttgctctctcaagcagtggctttcaaggtttttgaccacaatcttctgaaagagacataactacatcttgaaatgtaagtgcagaaatgtatactttcagtaaaagagtcacaagacaatactactttggcagatactttaatatttccttttgtctattctattctattctattctattctattctattctattctattctattctattctattctattctattctattctattcttctattctattctattctaatgctgatcccaacttaccaatgtttgttcatgggcaacttacaggctgtatgtaatctgcagtatgaaccacactgctttaagctttttttaaaaaaaaattgaagcagaatttacttataagcttatttcttagaaatgaaaccaaaaaattaaaatattttatagaaattaaataaaataagaatatagagcagcgatagtttctggtgaatcttaactaaatattaagctacagcttaatgttcaacttatcaaccatctgagggataaatagggtcagtccagattaaaaatttctattacactgtataatttcggtctgtgtttacttgttggtgtatttatatacagaattaatatttctaatacaaattttcttactaattataattttactttaggagacaagatatatttttaaataaacaaattcactctacataaatataaccagagatttattttcaaagaagttaattctggaaggcattatgacttttatctttaatcatggaaacaaacttttgtggaacacctgtatttgagacataggaaaagacttcctgataatttttaaaaatccatttcagtttttaacacctacgtattttttcctatgtgcaaaatatctgaggaagaaatcaaaatagttaaataatccagaaattacattcagtcaataatgtcaacttaagacaaactgtgatttgggttgtattttataagtttgtttttccttttaactgaatgtatacgatgatttggtcaagttgcttggatttgatttatgctgaaataacactcagaatcaaaacaaagcttggtccaaattccagaaagtagggtaattccctaagtgtaacctgattgaaaatatatgaaaatttactctcatgtacaaaataaccattatggtttaggagaaatagaaattataagctaatgaagatagagacttggcaatttactaaaggatccaagagtatttatagcttattttttaaactgattaaaaatgtgtcaaaatattacattctaaataaaagttttgattaaattatttcattcactagctttgaggcatggttaaagtgaaatagagttcaaagaaagggaagaagtaaattgctaaaagagtaaaaccaattttgatgaattaagtcatagttaaaagagaaaaagaaagacaggtgaaaataagattaggctagaatagaagaaaaaaatgagaaaaagtctaacctcagtaagtaactagaaagtaagacttgagattaaataattccataggtatgtcatagttcaattgtacatttcatgaaattctaattctaatttgatgaaagataattccaggaaatttgcatgctattattaaatcactttaagatttttctccaaatgtgttatattagatatacatatatgatatatgtcaatttatatatatataaatatagctctctcctctttgagatatatacgattttagtaggtttctgaggtcactagttgtctccattttctctgcacttaaaatgatgcacagagtttagaagagaagattgggtgagagctctgcatctctaaaaacagctgcccttgcccggatcatgctccgcaaatgttctgacctaaggctcgaatcagatgcataggttatattgactcaagtcgaatatctatttttgggtttaagtgcatatgtattttcaatggcaaattaaagtttataaaatggaatatgataaaagataaatgcaaaaccaaagagaaattgataccttgatattttcagtgaactttatcaaaattcaaaattgaatatatatatttatttaattatatataatatgtatatatatgaatatatagagatatagatatccatatacataatatattatataaaatatataaatatatatatatatataaatgctacataaatatacgacctcagacttctaaagctgaatataacaatggaattaaaagttaaaaattagatcttctgggcatcttagaattttgaaatctttgaatataggaaatttagcaagaactttaaaatgcttaaatggttttaccattgtattctgctggattttattttatggtaatcaaagttgtcagaaggtcagagactcataaatagagaacagagcatcaaaaagctcattgacaagcctaatgcacatgctgtctcttctttaaaaaatgaataaagatgacaagaaacattttgctcttcttttgtaagacgcagaataaactgtcatcttttctcttatgaatagaaaatgcatgacataaaataggaaacaaaaaatatagaaacgtagaaaatgtgtcataaaatagaaaacagaaaatgtgccatctcatgtactaaatttatctgatgacatcgcaaaagaaataacctagtcactgagtttaacattttgatgtcttatgtaatcataaccattgacatgaactttatatgtgttttctgtctatcaaagttcatggtcatgaaaaaaaacgtaaactatttttactaacatttttaaagtgaagaagaaagccttattgtataatttatagtggattctaacttcattgccaagaataatacattatagtttcttagtcattttcattatttgtaagagtgttaaacaactcctaatcattttacttatttttaaagttaataaagcaatatatgtaatatgtaaaaacattttccatgtaaagttaaatttagaaagtgtaaaaattggtgtgtcactgttcacccttattccgcccttgctccctcaagttctgatttcccagtaggaattccataaaatagaatagcttattagaattgtagttgatatgcaattaggtaaaatgttaatttgagcacaacacatctttataatcttgaaccttcctctattactatagttttattattatttattagtatgttttttcatttattcagatattatttctgtctctcaatgtggttttataattttcttgatataaattccaagaacctaaaatcattgctttatcaccttttgatgcttttggacttgtcacccaggtgaaattcattttgaactacagataaagagatacttgttatcaataattgtgactgtctgagagttcactctctttacaagctagctgtttagcctgttccattttcatgactgtttcaagacagcaggaggttctgggtcagagacaaagaatagtttattactggaagcaatagccagtcacttgactctgggtcccagaagcctaaacacagggcattgtgaagagagccaggtgacacttgcctgccaagtagactgtggtacagcacaaacgaagctgtgggaatctcctcttctcatcgcgggcattcaacattcctgctctgcttcagaaggaggagctctatttttcaagactaaacaaacctgctcttctctctgtaaggtaatgggacctgtatcttccaaggctctgtggtatatgaacgtcctggaagaggtttttcagaataaagtgcagttatggtctcacaagatgttaagaaatgtgaattgaagtaaaagttctgtgatatattaagctatgatatactaaaacttttagtttgcatttttcatctgtgaaaagtctattgaatctttttcctgtgtataaatagattgttttctatgtaaaagtgaatttttggtttcggtcattgctaaatacctagtgcctgttgtagtgtctacacatagtagacactcaaataataaataatatttgttggataaatacatgaactaaacaagtaattcatgtttttttcttggttcctaattttttcccatatatatgtaaaatatatatgtataccgtatatatatatacggtatatatatgtgaaatatatatatatggtatatatatgtgcatatatatatatggtaaaaaagaatttcctttgaattatctataaattgggtggaggggaggtgcttttcaggagggccacagtgcgaggtatctttcatgccttccttataaacacatacacatacgaatatttaaaaagtataatcaggacaatcaaaactggcatgaggtattataacatcattgtaacacctgtggaaggaaagtaaatcttagggcccctgaaccactaagctaaaggcaaagtcaagctgggccaacctgcctcccattctgttcaaagtcagcccccctgctcactacatcaatgcatacttgactgccctctttggggaggcgcatcagaaactcagaagaacgcagccatttgtctcttatccacctatgacccagaagcctcctccccacttggagtcctcccacctttgcttctagttgtcctgcccttccagaccaaaccagtgctcatcttatacatgttaactgatgtctcagatctccctaaaatgtataaacaaaatgtgctctgaccccctcgggcctttctctctgttaatgggcttgtcctgaacattggcaaaataaactttctaaattcactgagacctgcctcagatattcaggattcacacaccttaatttcatagacagtaattaatgaataaaatgatctttgtcaaacacaaaaaaatgtatgttctcattttcttaccagaagttttagatttttactttgagggtaattttaaaacaccaggtcatgtgattcatggtctaacctcccatgccagtttggtagtctatgacacaatttcactcaactacttttcactccttgagtgttacacgtgttctccccgtcccctctctgtcttgtcttggatcagtttccaaacctctgcacctaagggctcatatctttatgtaatttgttcctcaaaaaaatattacatgttaattcttctaggaaatcttccttgaatacccatcaaaatgagtcaagggtccttacagtgagctcacctaccaatctatataattggtaatcacagaactcatactaccaaaattattgatatgtttgtttaaatcctttctggagtatgtatcacttggtatctttagcatttatttcaatgcttagagcatcagaaatggtcaatatggaagaaataaataacctcctgagtgcttggtaatagcagcaatatgcgttaacatttgagagcccctgtgtgcttattcattgtgacgcctctcactccgagaacttgtacttggattggccattgggagtttataattttttttttcataagagtctgatgctttaaaagcagctaccatttacttaccactattggaataattttaagtgtaaaattccatgaaagctgaaaactgagtaaaagagttgttcccctcaaacgggactgaagattagggaggtagacctgtacaagaaaaaaagacaaggaagtgggtgagaagtagagtaagggtagagaaatttgttgaaagtttcatttatataataatataaaacatctgtatgatgccattagaataagctgtaaattctgttaaaaaaagacaactggccaggcacggtggctcacgcctgtaatcccagcactttgggaggccgagggaggtggatcacgaggtcaggagatcgagaccatcctggctaacacggtgaaaccccgtctctactaaaaatacaaaaaattagccggggtggtggcaggtgcctgtagtcccagctactcgggaggctgagggaggagaatggcaggaacccgggaggcggagcttgcagtgagccgggatcgcaccaccgcactccagcctgggcgacagagcgagactccgtctcaaaaaaaaaaaaaaaaaaaaaaaagacgactaacatgaaaattttaacatgattgaaattttttttttttcgtttttactttaaggtcatggattttcttctgactctggacctgctgagaagagttctgtgttattttatggcacaaatcatagctaatgtattatccaaaatattgtttaatgagaactaaaaacataggaatttgggtgaagaacaaatttcttcacactttttatgattccttatcgacacctcctacccactaattcttcaatctggccaacaaaaatttgatcacagatatgtttgcttcacctttaaagtctttacaaagcacttaatctagtcttaaatacaactgttcacatgcatttcgcatcaatttatatagtacttagttataacattacaataataaatacactgcaaatcaggtttggtaacacatccacttatattaacaatgccctgatgcacgttcaataattttgtcttttcaccctcaacaggtaaagaggagagagagggagagagaaagaaacactaaatgtgttttataagcaaaatcagctgttacatcatgatgattgttcaaacagctttcttcgctgatacaattgcaaaaagattataatgtccagtcaattgcattggcctaatctagagtataagggttttgcttctgggaatttgtgtttatatataaagtaggttttttaagttagtatatattgaaaataattagtggcttaccataatactttctctaacaatcttctgatacacaatatctcttttttctatattaagcttattaaatttgttccctaggtacttaaaatatgtcttatattccatatagcaaacctacaagatggatatgaatatccttattctgcagattagaaaaatgaggacaatgttgtcaagtgactgaagtggacccataggtagctgtttcccaatactattttgaatctcagttgtatgctctgcattttcggctcaacactaccacctcctgaaaagacttttaagcagaatttagaggaaaacaaatcaaacacatcagaaaacatcaaagcaaatgcattaaataagattatactgaaataagttggacacactgtggagatttccacttctgcccatgaagaattaacagctacagaaattgctttctgagagtaaatgactagaaacctggaaaaaaagatatgaagcaacagttttaggtgacaaacagcacaagactaaaacacctgatgggggaagaaaacaaatgagataagatttatgtctggaggaattttctatagcaaagtgaagggaacctgaactaaagcccagcagtggattgaacagcttcaggatttcaggaggctgaggtaaccacagcagtggattgaacagcttcaggatttcaggaggctgaggtatccagaagttgaaaggtaaagtactttggtagaataagatacataccgggagaactttcaagatcttcagaagagactcttccagttttgcttgtttgttttgttttgttgcaaaatagagatgagaggaaattccatgagactggggaaagaaagcagtaggcaaaataattctacggcaactgcattaggaatacttcatgtcctatctgccagaatgtagggacttcttaatatatggggttagtgtagaatccagaaaggacacatcccttagtagaagggttaaattagttaattgtgctaaactagcacaagaatacagatgttctagacccaacctaacaaagctcaataggataaagtaggataaaactaacccataaggttcttacctgtgtgactaaacaaaatccaaaactctttaaaaaatgtaaaaaaaaatagcacaaataacataaaattcacaatgtctaccacccagtaaaaaattaccaggcatgcaaactaacaacatttggctcataaccgggagaaaaataaacccacagaaacatatgcagaaataacaaagatgatcaaattagtaaaaaaggatttcaaaagattattataaatcttatggttatgctcagtgaagtaaatgaagataaacataatatggagaaaataaaagatataaaaagactggaatggaacttcgagaaataaaaaacatgtcaaaaaggacaattacattcgattatagaaaaagcatctaaaagattagcaaacttgaaagcctaccaatcaaaattattcaaaatgaagcacagaatgcaaagaaaaccaggttgaacagaaaagaacaatctttcattcagttttaagacaatatttagtggtctaacacatttgcaattggagttctaatagataatttcaagggagaaaaatatttaaaaatgtatacccccaattttgcaaatttatttgtttaaataaaaacaaattgagcacataaacacaaaatatctgaaaaccaataatatagataattttaaaataaaccaggaaaaaaacacattatatacagagaaataaaaataaatgtggcagaaaattattactagagatcacatcaaccagaagtaaattgcatggcctctttaatgtgctagaaaatgttagctatgaattctatactcagtgaaaatatctttcaaaaatgaaggtgaaataagatttttcctggtcaacaaaaagagttttatcaaacataggcacaacaaatgatgtcaaaattgattcctcttgcaaaaggaatgataacaggctgactttctttctttctttctttttttttttttttttgagactaagtatctctttgtcacccaggctggagtgcagtggcggggtctcagctcactgcaacctcttcctctgaggttcaagcgattctcctgcctcagccaccctagaagctaggactacaggcgcctgccaccacgcccagctaattttttgtatttttagtagagacagcgtttcaccatgttggccaggatggtcttgatctcctgacctcgtgatcagcccgcctcggcctcccaaagtgctgggattacacacgcgagccaccaagcccagcctgacatttttacctatgcaaaggaataaagagcaccaaaatgggaaaagtgtgagtaaatataaaacaccctgttcttaatttttagcctctttaaaaagaaaattgagacttctggttctgtataagaagtttgaaagtaatgagggagaagaaaaggaaaaatcagttaggtaaacagttaaggctggtcctcggagaggcagcctgcctgaaaaatcgcagctacaggcaaaaatagagcagcctggggaaaactcaggatgcacctgcacagacaagcacgcaaggtccggcacagaagccttttgttcttcgtgtgattaaccagctcccagggaaaagtttccccttcttttcagacatgtatgcagtgggctcggtgggaacttgcacagggaggagggggcttccctaaaacaaacccacagttttacaaacaagagaagcggtgctttgtgcttgcctagagtcatacccacagctacacagacaagggggagggagttgagcagacagcttttcagatgaagaaaagttacgcaaacagctacagaactgagaggagtttcttatacaaacttttgggattcaactgtaaaaacggaaaaccacttggctccccgctcccctgcagagagctttcattttttgttcattacactttcactccaacctcaccattttcattttcacccatgctccttaattttctcagtcatgagacaataagctgagataacaccttagacaacaagttaggacaaagtgtccttttgaaacagacaatgagatgcagaagggcactgggctcctgtctttccagggcaaggacaagtcgggctcagctgtgtgcaacttgttcactaaagggctctgtgagaaacggaaactgccccttctggcatgaccaagggaagatgatggtggtgtgtaagcaccggctctgggggctgtgcaagaagggcgaccactgcaagttcctgcaccggttgacctcctgcgatgcccgaatgctacttctactccacgttcccgcaccagttgacctcactgtgatgcccaaatgctgcctctactccacgttcctacaccggttgacctcaccgtgatgcccaagtgctaattctactccacgttcctgcaccggttgacctcaccgcgatgcccaagtgctaattctactccacgttcctgcaccggttgacctcaccgcgatgcccgaattctacctctactccacgttcctgtacctgttgacctcaccgcgatgcccgaatgctacttctactccgtgttcctgcaccagttgacctcaccgcgatgcccgaatgctacctgtactccacgttcctacaccggttgacctcaccacgatgctggaatgctacctgtactccacgttcctgtaccggttgacctcaccacgatgccggaatgctacctgtactccacattcctgcaccggttgacctcaccgcgatgcccgagtgctacttctactccaagttttgtctccgtgtaaatatcgccatgtccccagaataatgtgtctcaactatttcgtggcttctgccctgagggacccaagtgccaatttgctcatcccaagatgaatcttttattcaacctgagttacacgaagtcatctccaccatacccctttgctgttccagatatttaaatggtgctcaggttaacaccacttatgccagcgctgcagctctttggatacacagagacaaatgtagggatccgagaggccacttccaacgactgttgctatctattgcctctacagattattctgttctatttttattttataagtttagaaagagagtattaagcactaaaaaagaggacactttgtcctaacaattgctaaaaagctaaactgaaaaatgaacttttctcagattcattagagaagtgaagccacggggaaaaggactgcccctatattggagagacagaaaggccgatacaggaatcacagtgtgccagagcagaaagtcaagagcaagaactctttgggaatcagtggtggaatctgaactggaattgacaaatttctgtaaggtagacgtggacaagtgtgagaattagaacccccaggaggacccagtcatagagaagcagccgtacatttacatcttgtatctccaggagtttcaccaggacctgatattgaagattagggaaaaatccccttgtacttccagcagggggtggggaaaaggaaccccaggttgaaataggaaacagggcagaacattcagttttggaaaagatttcccctcaagagaaactaacagagccaaacctgctgggattttcttagagcctaagtgaggtgggcaaggggagagtcccaaccccagctgctcaagcttttctgttccacttaagaagaaggggagggtggccgggtgctgtggctcactcctgtaatcccagcactttgggaggctgaggctggcagatcacgaggtcacgagttcgagatcagcatagccaacatggtgacattccatctctactaaaaatacaaaaattagctcggcgtggtcctgggcacctgtaatcccagctactcaggaggctgaggcaggagaatggcatgaacccgggaggtggagtttgcggtgagctgagatggtgccactgcactccagcctgagtgacagagcaagactctgacttgaaaaaaaaaaaaaagaagaggagggcagaagatgagaagcattgtggcttcccagaggcatagactcactaaagacagagctaatcacagggctgagaacacttcaaggctcaccataaagttctgcgttcacaacagtgtggtatttctataaagataaaatgtagaataaaggaacagaatagagatgtcagaaacagacttatacgtagttatttttcaagatgttgccaggtaattaacaggaaagaatagtcttttcaaaaaatgatgcaaggacattgggttatttatatgaaaaagaattcatttcaacccttattttataccatttaaaaaattaaatttacatggattattaaatttatgagctaaagttcaataattcctagaagaaaacatgaccttgatttggtaatcatttcttagataggacacaaaaagaacaaattataacagaaaattgataaattgaattagtaaaaatgggaaaaaattttaaatgacttttaagaaaaggaaaggtaagccacccctagttcaaagaaacttgcacagcaggtatctgatgaaggtctgtatccagaaacataatgtatcttgattagaagaaagtaatcaactcaattaagaaataaggaaaatgggtcgggtgcggtggctcacgcctgtaatcccagcactttgagagcccaaggcaggcggatcacgaggtcaggagatagagaccatcctggccaacatggtgaaaccctgtgtctactcaaataaaaaaaaaaaaattagccgggcatggtggcacacgcctgtggtcccaactactcaggaggctgagcagggaaatcgcttgaacccaggagggggaggttgcagtgagcccaggtcacaccaccgcactccagcctgggtgacagagcaggattctgtttcaaaaaaaaaaaagaggaaatggggaaaatgtttgacacttcactaagaaacgtgtataaatggctaataaacacaagaaaagatgtacggtatcattaatcattagggaaatgtacattaaaaccaccaggagtcaccaccacacatgtagaaagcttaaaccttttaaggttgacaaacctcaaataccgatgaggaagtaaaacaaccaccattctcagacattgctgaagagaatcagaatcattcggccactttggaaaacagtacacatcatgctttacagaaagaagtggtatagaaatgagcagaggcactagtgtccctttaggaccattatattctaaagtgccaattggtaaaattattctttagttctacctggaaaatctacttctataatttaacttgtaattctgatctatgatatctttcagaacacgcctatgtgaacttaattaaatcttggtccaaacatgcttatttttatttcttctttattttatttatttttacttattttttaaatgagaaccaggataatgagatatttcttcttttacaagaatatgaagtttacctttcatttaaaacagtactactggcaccttgtcatataaaattttacatggagttacatattctaagaacagctatctgagaaatgtgtaatttctttttcaatagttttttatgtttattatcctatgatgtatgtgaagacatatttcatatgtaattatgagattatacttaattatatttccaaaggtgaagaaatttttgtatttttattttaaaataacaatagaaaagtatttgaaatatctttttaaattctcaattatgattcataacatcttatttttatttcacttcttacttttgtgtcttttttccttccatccttcctttccttctttcttttctcatttggattatttttaactggtgcctcagttcttcttaagtatatagaacttctaaaattataagcagagaatggtctttggttcccagaaaacttagattaaagagttaaaagttactcattatcatatagagttcctcagcaggtcattttgtaatgagagcagactcagtattataatataaacctcactggtcctgtattctttacaatgaacaaccaaagaccctttatgaagcttgatatattttaaaacattcaacatagttttatttcatgtccttgctattttataaacaggccttcaatagtcacatgatgaggacttttgggataatctacctgaaatgtaccactctgccctttctgttcttctgcaaggcaaatctgaggaattttttttattgttcatttttccaagaattcctacaaactgatgtctttactgcctacaaagtagcaggattttaaaaagtcagataactctgtttgcactgatatggccaaatatttccaattttcaggttaattctccactttttaacccagacaaacaaacattggattagattttacaagatgtgcaattaagaataaatgacagttgcctctatatatcaaaaccaagcacggacacaaaaccatgcttgcactcagtcttctctgaagaaatcacattactcttttccttcttcctatttggttacttttatgaggaatgaaaccccatgttgcaaaaagaataaagaatactcttcaccattttttttttaattttgcaaatttataaataaatgggtacaatttcttactaagtttctcattttcagcctaggcagagacatacttgcagctatcttatttatctcagagaaaccagcaatgagagctttaagcctagcaaaagtcagaagacaaccaataagagattttggcataacattaaagatagaccaagctaagacaagaacgaggatttttttcaatatggataatccaggaagaaaccgcaagaataatgacttttaaaatatccaaacaaatgtaaatttctcttccccctaacccttacagaaagcaaacagaaaacatcaaaaccaattgagaaactccaagtaggcacaagcacttcaaaattaatacagaaaaggctaactttataaaatgagtaaatttcgatacagaattatattcacacaatgaatcaggattatttccaccccatacatggtctttatcaagagaaagggatgtaaagaatatgaacctaaacatcaccgttttctattttaggtgacagcattctgtgactcactagaattagaaaacagtgacattagaattagtgacaattagaagggaaaggaagaaagggaaagaatggcatcttttacttactcgtgataaaagcaacaggaaggagttggcatcagggaagatagattggacttaagctgattctcactgctataattatctactgtgtctggttttgatcctgtttactgtgtgatacttgatatcataatgaactgttgattgtgtttatgaacatttgcaaggtgctcgtttgctgctatttttcggttagaaatgttgttttgtgtgccaaaaatggcttgaccagctgaaaataattctatataatttcaatttaatagagatacactttcctaaattcaattttatgcagttttgttacaacttgctaaaccacaggaaaaagggaaaaaaaggacatactatgtatataattcccttcaaccacttcctctgcttgtacatttgttgccagaaacaattttatgatttgcgatcggcaatagcattttcaaaaaatggtaatttttttcccaaaaattaccaataattttttattctaaaagccatgacaacttgacaaaaaatatgttaaatttctagtctctttttaatgcaaatatattaaaaactaaaaatgaatttgtactcaaaaaatttctggcacagtctcccttaagaaaatccctaattggatagaataggcatgttcccataattcactattattaagaaactattggctgggcgcggtggctcacacctgtaatcccagtaccttgggaggccaaggcgggcagatcatgaggtcaagagatcgagaccatcctggttaacacggtgaaaccctgtctctactaaaaatacaaaaaattagccgggcgtggtggcaggtgcctgtagtcccagctacggggaggctgaggcaggagaatggcgtgaacccgggaggtggagcttgcagtgatccgagatggcgccactgcactccagcctgggcaacagagcaagactctgtctcaaaaaaaaaaaaaaaatagaaaagaaactattagtgagcaattaataccctagctggatctctccatcaacaacatttagtgaacatcattaggctgtgcagcttggagaaatgttcagaattatttaaaatttatccatgatgaagaataatagaattagcaatgtcatcattacctaggtacctggcctttaaaaacacaatattaacaattttatttcttcccaaaatgttgccccttttatcagtttcctgattgtgttttcagctgattttagttatttggtgctatgtaagatttaaggggtgtgtgtgtgtgtgtatcacagatattgaatgcatagcccaatgcccatatcttagttattgatatctgtataacatttatgcagaactttatggcttaaaacaacgggcacttgttatcccccagtttctgtgggacagggtttgagtcgctcagccagatattactagtgccagctcagggtctcctgtgtctgcaggtagaatgctgtcatgggccacagtcatctcaaggctccactgaggctggagcatccccttctggaactctcatggctataaaatgaagaagtcacttggttgctgttaccttgctgtgtgaacctctccacaaggttatttgagtgtcctcactaatggcatctggctttccccagagtgggcaaactctcaatagaggacaagtgaaggggaagctttttatggcttagtccctgtagtcaccccgccgttccttacacgtattcattggaatcaagccactacgtcccaccgatgttcaagggaaagggacttaggctctaattcttcaaggagaaggtgtcaaggaatttgtgaacatatttacaaatctttacaataactttttgcatacatccatgcactggtataacctagcatttatgctaataaagtgttatgtgcatgcttttggttagtgtctagatagaattttttttgtgtgtaatttactttcaatccatctgtgtccatatatttataatatgtttcttataaatggtgcataattggatcctatattgtatcctgtctcatagcttttgtcttcaagtagaatgttttcaccccttatactttttattttcttttatatatatactgctccttgcagagcagggatacccaataggcagtgtgccaagagtagcccaacccttatactttatgccattgctgatagagtgggatttatatagagaatgtttcagtttattatctatttgcactatctaattgttactttattctactgttattgccttcttttgaattaatccacttctcaatcttccattttatcccttctattagttgtttacattataattctagtggttgctctttacggcatgcacctccgacttgatagagtgtactctaaattagtataatggttttagcaattgttaaaaagtgtatgtggcctacaacattttaactccacttacagtcagtattcttttaaagttacctacacagttgtccttccttcattgctagggttctgcccctccatcttgaatcattttccatcagcgtggcatatttcctgtagtatttcttggtaattcagatctgttggtaaactttaaattttctcaatttgtaatttcttaaaaaaagttgtcatttggccttcatttttggtggttattttagcaggatttagactttcagtttgacaatatatttttctcctgaacgttacagataccatttcattcttttctgtgtatttaatttgttcaaggcaacaatactccttaaaagatgatgtgcctctttcctatgaatgtcctcacaatttttctccttacttttgaattacagcagtttgactacgacatgcctatgtgtggttttatttgtatttatcttgcttgggagttgctgagcttcataaacacatgtattttatcagttttaaggcctttatctctgcaaatactgctactgcttcactctcttggtccttcatcattagaacttcagtgcacatacatgagacattccgatcacatattttatatgtctgttgtgcgttgttttcttcttttcattctttattctctgtactaagttttggtattttctactgacctactgtagagtttattaatattgtcttctgttgtgttcagtctgttgttaaactatccaatgggtctttatatcaattaattcatgcattgaatgcacatcagttattatatcttttggttctagtgtatctattttttcttacaattccacttatacatcacaattcttccttgttcatttattttgtctcctctatttaacatatttataataattattttagttattttaaaattcttggcgtaattctaatgctattgtcgtcaatggacctactgattttgtttttttttctttgaattattggtcacatttttctgcctgtttatatgtatggtaattggctatttttaattttatacctctgacatatataaaagatggcagattattttaattttccctagaagttctcctcgttcctgtgtgaggaagatagggtgacaagctgatcactatgatgtaatcaggtctgtgcctgaggcaatttcagcaccactcagtctatttctagtttgcttctagtctgtgaatgtgcctttcatagaattttttaattgagagcctggcaattccctatctcctcaccccaccaagcaaagatggaaggatattcattattgtctttggaggatttttcatttagctcttgagattttactcatgtggctaaaaatctgacagccatcttgaggggagactggcagtgtgtttgaggacatctctcctccgtgcttcaaacacacggccagactaatcctgtcagactaatcacagtgcatctgatgagagttgattgtaattggggttttattttacattttccagttcactaaagagttggcatttaaaaaaatcatcctctcgtttataatttccatctctcagttgtaatattcttgttcttttcttttacccattttaaaattacattttctgtcttttccttatagatttgaggatctctttatatattctggaaatcattcctttgtaaattatgtcaaaagcaattacattatttccaagttcatcttgttcttttattctctttgtgatattctttaataaacaataatttttaattcgatatactcaacttcatttattaactttacagtatgttctttcttttacgtcatgcttaaaagaatttcctacttcaagatcgaaaggatactttcacttttttgtctttagtctccttgaaattgagttttgtgagtagtactaggcaggagtctaagctctttcgtttactcttcaattttccctccctcttgccctttctccatctgtcccttccttctttcctttctttcttccttcctttcctccattctcttttgccctcctttttgctcccacattctccttctccctgtccttccactttatccctctgtctctcatccttttcttttcttcttgggtcttatctctaattgtatgatcacaatttattggaaggctcattgtttttctatggttctgcacaaccatggcagtcctcaattgtctatatgaggtaatttcttggctctttattctcttttatcatttgagtgttaatgtttcattaccatactgttataaattttattatttataataaattgataacaaataattggtaaagcagcccctctcaccttgttagcattcttcaagaggattttgataattcatgaatgtttatactttgagatacattacagattcggcttataaatttacactgaacgcgtattggattttgagtgcattaaatttatagatactgttagagaagtttgaaatattattcattaactctttcaaaccatgaactagatatatcttctcatttattagaaataggtcttcctactatcttttaataaacaagcatttttataggtatcacatatcatgtttttaaatacgaccatattttcaattctattaaaaatgaagtattaaaaaatatatatttgttgacttatagaatacattttttatattgacatattttcactagcctttctaagccttattattactttacaaattgtctatagattcctttggattttctacacagacaattatataatattcaaagaaagtttgttttctttctaatctttcacacttttatctatttcctcaaaatttcaaatgtatcagttataattgattatgttggttgattgcaatgatgtcttcatatataattatttatttttactttctagtattatttgtgctttcagcaaacatttgttaatctgttagtcttttcacagagccagttcgtatgcctggatcaattgattcctgttatatcgttttcctctttttgtttctttttcacatttcttaaattgcatacataattattgccatctcttcttttataatatacattttataatacacatttgatgctataaattttcctctattgttttagccacatcacgttttcatatttagaattacagtcaattgtaaatattacttagctcaaatactttctaattttcattataatctttaagttttgtgaattatttagaggtatgttatctttctgttataaaatttaacccaatgtcattggtctagagatagaaatcaattgacaattggcaaactttgtttatgaaatgccttttgccaagtttcttaaatgattcatgagttattaaaaagaatgtatattatgcaactgttaggcgccatgttcacttgatcagctaattatgttgtttaagtattctgcgtactgtctccttactttctctctttatcttgctctcactctcatttgcttaatgaaatactaaaaagaaaacccttatccctttactgcagaaaatttggaaaatgaaatcagtaaaaaacattacttgtaatctcatcatccagtaaaattttaatgttatttttctaattaatcaattgtacctcttttgaaatatgttacatagagatttcagatataaatagatacagatagaggtggagattatagaagaaaagaaatatttttcccccatcttaggttcatggctgagacccctgtagcaaaagacagattactaagagaaacacatacaaatgtatttgatgtaagttttttatgacacggagctttcataaatggaaattgaaatatacaggtaaatctgtacattgttatgcttaggtttgaagaagagtgagtagttgtagagaaatatgattggaggacaactgtttggggaacttagcaaggcctatttgttcatgtgcttctctgtgtccttgtgtcttcagagataaggatgctcttttcttccaggtatagaagggcacattttgaatgaaagtcatacaacctgctttggagaagggcaggagaaggtccgagtaatcttcctgcttctgctgttttctcaaatgccaaggtgccatattttggggtagtgtgtcctgaaccccagagatggagatataccctggtatcccctccttgaaaatctgctaccacatcttcggggtttatttagccaaaagaagtcaggactgactgtctctaaactttagtgtcttgtcagtctactattggcaaagtttctaaaacagctatgtgttgtcactaatgaagaccagttctgtgtagtttcatacatttttttctgccctgatgatgcctggataatgatggaaagtggagccacagattttggaaaaccgcaagcatgactacaagtagaagcccattgaatatcaacaggaaaagtagttgcagtcataatccctttcttagtttggacccttttccccaaagaaatgtcccttctttttccatagggaccaactttgcacatgctgtaagagggagtcctgttaaaactccctcccccagcaatgggttgcctacttgtagattacatttgaatagctaagaagagaactcttcaacaattgctgccactcacagcctaaagtatattttcaaaagggaacattttattaacttgctaataaaagaaagagttttctttgttatttcaattggaagacagcttttctatcaaattctcatagtcttgtaataaaatagttttcgattgtctaccacgtcttaagaatcaggttgctaataaaatttagaaagataaagtattaattagtaaattgcctggattttagagaaatttaatggactatgttgattcctctttgtaaatttgtgataaacctagttaggtgtgatagttttgttttgcataggaattaatggttcagccaacacttccctgatgttcagaatagtttaaatagcataaatcaatatacagtacatgtaaaacgttggaggtcagaaactgatacctcaaaatgtagcgctttgacatgttgaactgaagtagaagcctcaggtctctctgaattcctgccaccttcccaactctcaatcctctgtctctcccaaagcagaggatggagtgttctctgaagtttcctcatttgcccaaggcttagatccacccaagaagaaagcagttaccactggtttctcccctgaggtccattaactcccatatcacaggaaaaaggactgaagtctgtcaacacagctggacagatttttgtcacaaaccattgtctggtttctaggccaaactgaccgtgccctaggccattgtatgttctccaagtccattgattttcctctgaaaatcactagccctcaaatttccatgttcctcctgtctcccctctcataaaaagaagggcatatacacatctgtatcccattgggctattgagtaatcattgtcctaagaatctccatgctgtgcatgttaataaatttgtatggcttttctgttattagcctgccttctatgagttgatttttcagcaaatcttcaaagggcaaagaggaacttttccattgtctcctacagaagcatttaaaattctgtaaaacaatgacaaaatcaaaagccatgtaaaatcgtgtgtgtttgtggtatttttagcaaaattttatttcatatttatataatccaaaattctaatataatagttctaaatcgaattttagggtccatgaactcatcctttgcacttttgaagcagaggaggactgtgacagagttagaatctcagtttctcagttccacaggctgctactcttcacatggcagctggataatgttcgattttcagtcctgtgtatttataacacatttcaacctgcagaatgcttgaaattatctgctagtcactcttctatcttgaccaacatacaaaatcattgatgtagaattcagtgttgcaaaattttgaaaaaaatagttttggtaataattttaaatatcattggcattagagtctgacagaccaaaattaactccttgtgttataattcattagcttaaaggcatgatgattgtgacaacctcactgagtcttgacttctccatttaaagataataacatgaacctaggttgcaagttcttcatgaagattaagtgacattttatatataatatgcagaaaataggtttgatatgttgtaagcatttgataaataacatttattataataattttcagcaacaataagaaagaaagtcaaggtgttcctaagagacttagaggtttaggtcctacattgcaaaaggtttagtatctgcactgttccaacagaaggagcagacatatagaactcagttcccatccttggtttatttattttgagtattcgacagaagaaaggagtcaatgaaatgagaagacctgtgcgggcaaactaaccttatgtagaatgtgtcctcttattataaaatgagaagacaaccccttttcacaactactacaaaacaatgccatacccatccattgttattaccagttatttccaactctcccctgctatttccagagtccaccttcctgtggggaaaagctaacctagaataactgtatttcctacacctgagaggccacacaagtattacattttacaaggagtaatatttttttttgcaatttctccccaatgtactttatatccatctagtccatagcagaaatagtaaaatttcaaaattcaataaaccaaaataaaaaggtctaaaagctggagccctatatagacagaattataaacgcacattattacaccattaagaaattgttttataacatttaacattattgtaacatgcctgtgttgcacaaattcatatatactatgaataaagtcacatacattaaaacatagagtatgttaaatatggtattcagttttgtaaaaccaaatttgtctgatgtgatgtttttctggaaaacacaataagaaagctttccgagtataaatgacaatgggtttttacacatatgtctagctctcaatgtgtaaatgacaatgggtttttacattcatgtctccaaactggattctgcaaattgtattctaaatgaaaaatatcgctctagtaaacaaatctcataagacagcaatttatctcaaataaatttttggccaaatgtttagtctgtaggagagaaaaagcaatatattttcctcacccatcacagagttcatagctgaaacccttgtaacaaaatacaaattaataagagaaaacatacaactttgtttaatataagttttacatgacatgggaaccttcagaaatgaagacctgaaaacccagggacaactgtgtgtttttatggacaatcgtgcagaagtgtgattggaggacaaacgggtatggtctaatggcactaaactggggggaacttatgaaggcctgtttgttcggattcttgctagagtccctgtgtgacagtccttccctctggctaaacagcaagacacttgtctcatgagggttttcaggagagaagaagcagggagaggtcacagtgaccttcctacctctgctgtttctctcaagtactagagtccatatttggggatattttgaaactcaataagtctttgctgaaatacagtgtatctatattcttttatctttaacttttgtatattacacaccattctacttttcttttttttaatttttttttttgagatggagtctcgctctgtcacccaggctggagtacagtggcgtggcgagatctcagctcactgcaagctctgcctcctgggttcatgccattctccagcctcagcctcccgagtacctgggactacaggtgcccgccaccacacccagccaattttttgtatttttttagtagagacggggtttcactgtgttagccaggatggtctcgatctcctgaccttgtgatctgtccgcctcggcctcccaaagtgttgggattataggcgtgagccatctacttttcaaataaagtgatatatttgctaaaattgtgtgtaaactaattatagcaaaatttttataaataaaattatttcaaagataaatcttacatcctacagttacacataaagagtagtgttgtatcagatctacagtgtctaacagcctttctctctgttaatgttacaaaacattgatcattggtagcccatgctactgtcattttaatacaagcccataaacttgaattttaaatgaatcacccaaatgatttttcaggtagtcatcttccagaaagattggcttgtagaattgaaattttattctacgttttctaactatcaatagttaaaatctacatctcaaaagtgagctgtcgagtcaatgaagcccgggagtttgcaggtttggctttgaggctccatgtgtttcaccgtgaataagtgtagactcacacattcaagaagcatgttccaccctgtatatgaataatagtcttcaacctgccaggcttgcggcttgataggcattatagcacactgtatattgaagacgtttattttatgtcactagaacaattactccagcgaaaatttagtttgttatgtactttgtataaaactcatgtcttctcacatgaattactgggaagccatactttttaaaaagttgtaatagaattaaagaaagttaactcctagaataatagcagaattggcaattgatattccatctagaaatggctttcaaatcttgagatgactcttaaattcaaaagtttgagagttgagaagacacattataggactttataataacagaaaaaattagctgtaggggttgtagggtagactcaggtttgtgcactgcattccatccatgttatcacaattagagacatcatctaaaaattgagtgagttggttctttttccaagagtcagtacaaactgaaattctaaagagaattttttaaaagttaaacaacttatggatgacaagtttaaaatgaaatattcaggaaaattagggcattaattaattcattcatccattcatagtatttatttggtaactattaggttctggaaaatgtgctaaaatatattaagaaataaaactttaaaagtccatactttcatgaaatttgagattatttggggactagagacaagaaatgttatcaaaaatgatgttagtggtatgataaaaagggcacagaattctatgaaagtaaatattagaagataattcaaatagaagtttcaggaaattattttgggggtacaaaataattaatagataacaaccttaagtactgaggggaactggttagataaaggagaagatgaaaagaaaagtgtttctcagggaaaagctgtatgtgagaggaggctgtgatcagataatggaaagaagctttgcaggtcaggggcaaggttcaaggtgagagagttggcagaaaggagggaatgcatcaggcgggtagcttaaagcatgccaaggattgcaaaatttagagcaatgggaaaccaccaagatttttatgctgacataattatacttgcatttttgaaatatcaatctagttgtagaattgagtctggaatgtagagtgagaactggcatgctgtgacagaggtcagacctgagagagtgggccagagaccaggaaaggtgcatgatttcaatagggagaatatgtagatatttgtgagtcatcagatgaggtgagtgaagaagatggaaatgtaaccaatggcaattaggtttcatacataagtgaatgaatactattactttttcctaaacgagaaaacactgaagagagaacctaatggagatcaatatagattcagttttggacatgttcatattttctatgagatacataaataaatctcacccatgggccacaatgggattgacataagatgtcagcaaatatataaggaaagacatgagatgcatagaaaacaaaccacaaaatagtagacacatattctaccttatcagtaattatattaatgtacatgaattgaacactgcaatttaaaggcagacactagcagataaatttttacaaatgatacaactgtatgctatctaaaagagacacactttggattcagagataggaagtaaaaggatagaaaaagacaagcaaacggtagccaaaataaacctgaagtgattatattaaagtcagacaaaatagtccagaaggtaaaatttgtagctaaagataatgaagagaatttcatgatgataaaagagtcaatccatcaggaagacataacaattataaacacatatacaagttccaaaatacatgaatcaaaacctgacagaattgaagggaaaatgtacatttcaacagccgggtttttaatatccatttcagcaatgagtatggtgattagggagaagatcaaaaagaaatagaagatgttaacaacatggtcaactaactagacctaacagacattgatggagcactttgctcaacatgagcaaaataccgattcttctcaaggaagttcaacgcacattctccaggacaggccatctgttggactgtaaaacaagcttcaataactctaaagagactgaaataacacagaatattataggtgctaaaggatgtgatgccttgcctcacccatcacaagggtcacggccaatacttctataataaaagatgagttaacaggagacaagcatgacaactttgtttaatctaagctttacatgataggagccttcaaaaataaagacctaaagacccaggggaagctatttttatgcttcctttcgatgaagaatggaccattgtgtagagatgtgattggaaaaaaaggataagatctaatgctaatagactgaggggagaaatccagcaaggcctttctggagtgaaagcataaagaaaacaaacattgaacatggattttgatccagtggcatttgatccagtgcatttttgagaagcaatcttgacagtggctaggaacaggagctgaatccctgtgcttcaattgccttatctgttaaatggggataatagtagccaccttatatggatgtcctaagaattaattgatgtaaagatttataatagtctctcggcaaacaatacaaatttaataaattgcagccaacatagttataatcatatcgattcttcagagtaaccacccagtctttgcattctcatccacacgttgccagaggagagcacaaaagcatacaaagactcgcctgaagccttgcagccacaccacacagcaccgagacctcatcaatccccctcactttctgctaaatcacctgccccacacgtgattaatgtgccccgacctctcatgtctcattttgtagtcctgatttatgtctttctgttgtgttgtgagtaatatgtttacagagggggagaaaattataatattgaagaaagggaaacaaaagtgaggcagtcaggtatgtgaaagttatagtaagatttttatgtcaatgcagctcaacatttctgctatattctgttttgtaggcagaacaaaatctctcttagttagaggctgaaatccaagggacttcgatttattccaattttcaagtagaagattttattttactcaggtaaacatagactgtgctgttacataaataaataaataaataaataaataaataaagcaagcagaaggtgcggcatagatttaaaaaactatacttggggaaaataaaattaaataaaatcatcgtcaaaagttcttgtgcactttgaaattcagattgcatcgtgagcttggattgccaatatccttcacgctgttgcttgccagactgatagctctttccattcattacagatagaaagtgactatgaagctttacaaagttacgggcaggtgcaaagctgttgatcccagcctagaagatacattttatatgcctgtgaagattgttcaaaaaaccccaactgtaacaccaagttgttagaatagtttaagaaagattaagccagagaagggagcttcattttttgtgctgacaacacttacggggttttagttgaacccagccaagaggataaattgcaaagtaattaagaggaagtctaaatccagatttgttcagtttgtttcttaggatcgttaatattaactgactttcacattcagattcacttaacttggcaaatgccatgaaaacgaaatcacataagattttgcagcctaacattctttccgaaatgggaaaagctactcagcctaagaaatatttcatttgattttgaggtgtttcacagactatgaaaaatttaatttcacaaacaagtgccaaacattttgtttgtctttgaaaaataatcatttcaagaagaaatcaatgactttcagaaataaaaccagtagccataacaactcctccaggcattttccctgaaatgagtgggtagtgactattttaaaggacattttcattgactttgctgtattatctgacactttaagaaatgtcagagggtattgtttcagggactcttatttaaattcaggttaacgttatacgcctgcttctcaggctccatccagcttcctttgtgactcagttcaataacaaataatgatgaaccattgaaccacagacatggataaagacaatcccatgtttccattacagacccaattcaatggtttcccatgttctttaattgtatggattagaatgcacagaaaaatggtatattagacattagagatttcctctcactttccccacaaaattttgacatgattctcccagaaaaaaatgcaaagtagaaatggagattcccgtgattgacagtgatgttggagcaaagcacatttccagcatctgcttgcgtgaccctggtaaagcatgggcatgtgcggttcaggctcagagaggcgtggagtttagaaaaaacagcttaatagcaaaacattcactctttgtttcatggatggaaagattaaaacgtatcaattacattgttcacaacaatttaaaaaatccagctttcttttccaagcatttctctcacatcatcagttatagtcccagactgcgaagtctagggttattcaggtcaaattatctaacatttgcaggtgccaatgatgagctagccattttgcatgataagtaatctgcaccccaattatcataacatcctcccttcttacagatggcttagccaaggaggagaaatgtaacttgcgcagattcacatagctgaatctatgtgaaatcaaaatgtttgatttcaaaacttacactttaatatcacactatgctgactctcattattcttaaagctgaattttgtaattgaggaagagttgatttcaaaatgtctcaaatcctcagctcaaattcatgggcagttttcattcacttctacacagcatacatgtgtaatatatgttatatataatatagattttattatgtaaatatagtttaaattatacatttttaaaataaaaatatgaattttctttttcattatttcaaggttttacatgtgcttagttttaaaaatgagttagcttcttttatctttaacttttgtttgttttccaaatgtctagttgagtcattccatttgagatggtaatttttaactttccttgcttacttctagagtaacaaacctttatccttaaacctctggatttggcattatttttccatctatactgaatctttattgtataggagccaggataaaaataagaataagaggaaaatattgaacagcagaatgagaaatgtatgtttgatgccatcaattcttcaaatttttcaatattattttagagagaaacatggaattatttgctgtaaaatgttaccctaaaacaacaatagaaagtgaaaaatctaaatatcacaattttcaactgctgaaataaaagaaaatatttaaaaaattgagtcaaatgtttaaaacaaattagtttttgaatggtcttaaattttaggaaagataaataattcattaaagttcaaagaatttactttctccattaccttaggtctatgcaacatattagtttacttttgaatgaggaaataattcacaaaaggttgatctttacttttagaagaaataatttaatatactataagaatgatcaaaagtttttattatgaatgaaaggcaaaatgcttgtgtaaacatttatatcttataagtaagttttctgttagtatgctgtgttctgacatcaatttgctgacactaactgggtgtcccgtaatccagtttaattctgacagttattgcctggagttagcacagacccacatattaagagcaaagtcgttcacaggactgtttccacttcagacaccagccacagctttgggtatccctaagctaccacacttctgcccagccagctacaaattcagggcttcccacaatctctttagattgaataatttgctagaatggctcacagtattcaggaaagtgctacttagaattatcatttcattataaaatttgctcaaatggctcacagtactcaggaaagtgctgcttagaattatcatttcattataaagaatatacataaactgccacatgaagaagtaatagggcaagctctaggagagtcctgagcccaggagctttcgtccctgggaagtcgtggcatgccagcatcctggttcacttacaggttcaccagtcaggaaggtcctttgagcctcaatggcccgagcttttattgaggtttcatcacctaggatgattgagtaaatcactggtcaggtgattaaattcaaccttcagcacccatgctttccccagaggtcaggctggtccagagttccaattctcgaaacacaagtttggcctttctgggtatcaatcccaatcctgaagccacctaggcaccctccatccccaccaggagctgcctcattaacataacagaaattttcccatcacgctggaaattccaagggtttttgcagctctgtaccagaaacatgggaccatgggatgaagaccagatctattttatattgtattatagatgtcctctgtgtgtttatctaggctcataattgatatggagctttaaatagttttttctgtcatatacatttcgatgttcttccactttgttgttttaaaattactttccaagatagtgaattccttgcataaggttcatattttctaaatgcacacaaattcttttgcactggtagcttaaaattgtttagtaatggtaaagatggtttgagactgagataatcacccagagaaagatatattttttccttaaaaattaggcaaagctacatagcattaagatcttttactagcagagtacattttcagatgcccctacattacataaattagtgcaagaccaatccagaaaaaaagaagtagccgatagaattatagtgtggaagtcaggcagtctttactttatactgacgtatcttttaacaattaagactaagagaaagaatgtttttcaatttgtgtatcacctcttagaaagctgaacaagtctgatatgacataggctagctaggccaattagggataaattagagaagaacacagacccaatacaggtggttcagactaatccattcgtctttcattcgtttaaacatttttattgagtgcctgtcattctagaatgacagcagttacaattctaggcatcaagagtgtagtccttaagatagaaacaaattccctgacgttggccaggtgcggtggctcacgcctgtaatcccagcactttgggaggctgaggcaggcggatcatgaggtcaggagatcgagaccatcctgggtaacacagtgaaaccccgtctctactaaaaaacacaaaaaattagccgggcgtggtggtgggcatctgtagtcccagctactcgggagcctgaggcaggagaatggcgtgaacccgggaggcggagcttgcagtgagccgggatcgcgcccctgcactacagtctaggtgacagagtgacactccctctcaaaaaaaaaaaaaaaaaaaaaaattccctgaccttatgaaatctacattcttctctaggagtcagagagaagcaaagaatgtgaaatacaatgtcaggtagtaataaatgttatgaagaaaagtaaagaaaataaagggataaagaatgatagagtgagatggtaatttagaaagggtggctaatgaggacttgtctgaatgggtaacgtttgccagagacctgaatgagatgaaagaataaaccatacaaatatctaacagaaaaacatccgaggcgaaagaacagcaagtgccaagttcttacggaggaaatgaggttggaacgtttaagggataacaaacctgtgactaaaatatggcaagtacagtagagaacaatacaagatgtggtttgagaaatggctgggtaccagttgatagaaggtctgtatagaccaaaataaacctgaaaaaaggaaaagaaaattagaaaagaacaaaggccttgattataattacctaaaattgattcattttaacatcaatttcacacaattttaataagtagtatgttccaaagaaagaaatacgtatggtcaaacagatttagaaaatgctgggttaaaaccattaagccttttttttttttattgtaaagattttttagaacatttcatcatttgatttgtgttcaatctaatacagagattgtaatcagaatttttcaaatttattgtcctgaataactttttcttctagtagattatctcccaggattagggttccactgaattcctttaggaatcattattagttgtcaaacactgtaaaaagatctgagtggcaagaggtgtgtatttaacaccaaaactagaaatgtagtttagattttatgttatttatcacttgccaagagaacatacagagagaaaagcattgaaaaaaaaaatagattacatggagtgaagttttataaggagatacagcctttagaggaactaactttccaagttaaaaaaaaaaaggtatttagttcttaaaatattccttctgccttgttttcctttctccttttttttttttttttttttttttttgagatggagtcttactctgttgcccacgctggagtgcactggcatgctctcggctcactgctccacaggttcaagcaattcttctgcctcagtctcccgaacagctgggattacaggcccgcaccaccatgcttggctaattttgttgtatttttagtagagacaaggtttcaccatattggccaggctggccttgaattcctgacctcaggtgatccacctgcctcagcctcccaaagtgctaggattacaggcgtgagccactgtgcctggctcccttctccttctgagcttttgattatacatatgttagactgtgttgtctcacagatcatgggtactctgtttttgtttgcttgtttgtttgtttccatgttttctatttgcatttcattttgggtaatttttacagacttttcaactttactaattctttcttcagctgtttggagtctactaataatcacttcagggcaatcttcatctctattaggtttttcttttctagtatttccatccaattgttttttaaatcttcatccctctgctgaaatgacctttctggtcttgcatgctgtctgctttttccattacagcctttaacatgttaatcaaggttaataaatttccaaggtttgtgcatagctaagcctgcttggctccctgggagagtgttgttttcttcttgttattttgtgtgtgtcttaagttttgtggggaaagttgggcatcttctttaaaactgtaaacatgaagttttttttcctgcttagaaatgagcatgcctttccttcttgtaggtctttagtgtggagagttgaattattaatctaattaggagttgaactgggcttaggtttgctgtgctacggtcacctctaggtaccacaggtttaaacttcctctggagatatattgggtttagggttgtggctgctttgccaggggccaggggattttttttatgtctcttccttttgcttttggtcttccctgtgacctatgcacctatgcctcagagagggtctttttcttttcttttctttttctttctttctttttttttttttttttttttgagacagggtttcactttgtgctctgtggcccaggcttcagtgtgcagtggcatgatctcaacttctgcctcccaggttcaaatgatcttcccacctcagcatcctgagtagctgggaccataggcacatgccaccatgctcagctaatttttaattttttttttttagagatgaggtctcactatgctgccaaggctggtctcaaactcctgggctcaagtgggcttcctcccttggcttcccaaagcactggcattacaggcatgagccactgggcctggcttgtctccttcttgtaagttacatattgctagagacttgctcattggcagtgtgcatgtgtggatgggtgtaacttctgttgttctggataggcctcagtcctaggcaggcagtgaacccctgggtgtcggtggggggtagccttctcagtgccctacttttcctctagctgctgtaggcctgggttccatgtgaatcctgcaccaccactccccatttcaccacatatacacagataaaaactttggtttcacaagagacatgggggaaggatcctggtgaaattccttgcttctcctacagtggttaaagttttctttccccagtctatactacaaaacaaactttctcaagattctttaattttcatctgattcaggtagaaaaattctgcaagaggatatggacttcccctatatacgtggcccttagtgctttactctgcctcagcaaggcacactcagtccccatcaatcaaccagtcacctgtgctgagctcttcgcactggtctcaatctgcccaggtaaaacagtgctggcatttcatctccccctggaggctcctctctcctcagatttcaggaccgttggttgtcctgctcagctttctggtgggttccagaaaagttgttaactcaccgtttatttggggttttgctgttgttgtaaggctagaagtgacactcatttcttctgtcttcgtggaaaacactcaacaggtaagaaaaaaagaagcaacatcaacaagcttactgaggctatcactagtttagtcacggtagcaaaacaatagatttcttatataattatcacatctgaaagtgataatataatcactattgcaaagatcaggaataaagtcattttcttatggagtcagcagattataggaatggtggctcaagcctccattgagcttgtggactagaacgacagtgaccactctttggttgtttgcttatcgtagggagcacaacaggcttccctgtgctggctgcggacatgacgacgcgctgggaacgacagcagtgggaggtgtcatgtttgcttttacacacttcttgcctctataaaagcctgaacttaaaatttaatttttttagtaaatagctctcagtgtattacaaagtgtacattcagttatccacaactaattatttctttctgtttctaatgtgccaagaactagtgcatgctaaatataagggaagatacctgattcctcaccaaaaatcttggtacataaaattgggaagaaagtaagcagcatcaatctgtttataaaatctctttgtctcagctttttcacctgtgagatagaccatcccatattattcattaatgatatttttttgtgaccagcagacttctcagtggtcagatacatgtacctcgatccttaaaggtagcaaccatcactcatagtgaccagatttgcagaggcagcctctcccttctgtcccacagaagtctacagggtatcctggggtcctcattgcccgcctctatgaaaatcccacgtcctaaatggattgtgtgtaatttctttctcatccagacccattcttccttcctggtgccttccctgccccatcttctctttcgtccctggcccagatctctaccttgtctgacgggccgtggcccttgcttcctctactacattgtgacacttgattatatcttgtcttatatctttctccaaagatttcatggatcatgtctttccaaaattactagactccctaaggggtgaagcatgtcagtcttattttgcatcctcacgctcccttgcacactgtcagacacagagcaggcatgtgacaaatgctaggttgcaacaagtctgagtttcttaatggaagaaatttagagagagaaagcgggggtgctttggtgagagatatcaactcattgagtataatgaggaaggaaccggccaaccgccgtcaattaagaagtggagcaaatgggctaaaatcgctgtaacgtgctccacctgagctttctgccgtccagggccgctctgtttcactggggtggaggctgccactgctggcagctgaagctgagcgccagggtctcttcctctcctcctcgtcctttcggatcccgggccctgcggccgcgcttccgcttcagaccccgcatcaggacccgggacacggggacttcttccgggctgcaggcgctgggcaggcgcggcgcccccgcgtggttccttcgcaggggacagcaggtttcccgccccgccgcgtgggggcgcgcgatctgccgtctgagttcaatgcgactccggaaggacgcaagggagccgcgcaggtggccagctccttaggcgtgtccgtcccagagcaccctggctttatctggtttattgctcatggttcaatcgggaaattaggcagcgtgtccccatgacagcagacgcgggtgacggctcttgcctccctccccagtgcgcacccccgctggagcgcaggagcttcctgcaggttcgcgccagctcgggcctgacactcagggcaaagcggctccaaactgcccactgagcggtccgcacacacagtccttgccctgcaggcttttcctggacgactgctgaagttctagtcgattccacagccaaaaacatggaacaccttgagcaaaaaccattatccaacattagccgttttgtttttttttttttttttttggtcaatgaacttttgttacatgaagaacagaacaaagctggatctaccatatacctggtttgaatttactggccagaacattagcaattaggttttgaccaataatatcaagtcttttcagaatatctctggggaagaaaaaactaaaacaaaatgacagcaaacaaacttcccatagcggccagattctaagtctagtgcttttaattgaaagaggagaaatttggccaactaaaactacatcatattcgtatgcgatgaaaagaagaaaataaacatttctggtcagaaatgtagatatgattaattttaaatggaatcttaattaaaatatgacaacttgaattttcaaaaaaatgtccttggccgggcgtggtggctcacacctgtaatcccagcactttgggaggccgaggtgggcggatcacctgaggtcaggagttggagaccagccggaccaacaaggagaaagaaaccccgtctctactaaaaagacaaaattagccgggcatagtggtgcatgcctataatcccaactactcgggaggctgaggcaagagaattgcttgaacccgggaggctgccgtgagccaggatcgcaccattgcactccagggtgggcaacaagagcaaaactccgtctaaaaaaaaaaaagtccttttgttatgctattttaaataaaactttaaacacttattaaaagtatggtatacatttaaagatagcttttcctcgaagaaaatgtcagcaaggaaaatccttgaattctgtaacatatggtgtttttgagtagctatattcatcatataaaagcaatttatattttcattaaagaaattcaaattttacttatttgacactaatacctacacacaggaaatttcaaacccaagaaataataaattatcgttattctagaaaacctggtaccaccttgctctaccacagccattgctgtggttttcatctttagatgtcttgggtgctgagagctggccctgcatcccaggcacattcagattctctggcaatcaacttttgtgggagaagggaagaaaatacgatggggtagagagagaagttggacactgacgcaatcaacatcaagcctcagccaacccccaaggcagtctgaaactggacaggctcttcacagttgcccagggaggccaaacagagagagtctttataccctggcaaatgctagtcatggggagacagatgccagagggagggggcctggacttcagcaagtggctttcttcagcctgaggtaattcgccaaacgtctggggaactgcagctgacagctgcgtgtctctcccagcagtcagggagtcagtctttcaacctgcaatcggagcatgcagccatttggggactttcagtttgcagagtaaggagagctttggtctggggcggaaactttgcttttctttttgttgtttttctgcttttttttctactggggagaactgtattcttaggctctgcttcttccgtgggtcccactgtcttcaggagaggccttcttggacaagcagcctcctttccttagagagcaggtcatgggatttccaaggtcacaagtaatgtctaccagacattccgtttacatacagagaagggagacaactgtctcaaaaagtctctttattaaatcatcccctggtcatcctatgtcatagccctatatttttccttttatggatttactccagagtgggaggaaacccacatttttctctgctgtcttgggctatggcttcaccttttgtttaaaaatcaatctcatctcatctgctattttccaagaacttttcaagaatctagtctattcataacaccctttctggtttttctgtgctgtgatgactttccttcttaaacctacatttattttattccattttgctcttgagcaggaagtctgtgtattaagttctggccttgattgcaaatgccaagtcagctcagtagaatggaatgggtatgggttgtggcttcaggcagacacttcactcgggtctaccacttactatgcaacttagggtcaatcacataccttttgtgagacccagggtctttttaaagtgggaatagctggtgcggtggctcatagctgtaatcccagtactttgggaggctgaggtgggcagattacttgaggtcaggagttcaagaccagcctggccaacatgctgaaaccccatctctactaaaaatacaaaaattagccgggcatggcggcgggcacctgtaatcccagctactcgggaggctagggcaggagaatggcttgaacccgggaggtggaggttgcagtgagctgagatcacgccactgcactccagactgggcaataaggcgagactcagtctcaaaaataaataaataataaaataaagttggaataatagtatgtactgcataaattagacataaggatataaaagtgcttagcataatgtttggtatagaacctgcacacaagcaatggttgtcctctcctttctttgtatttgtatccctcataacattttttgttttttgttttttgttttgttttgttttttgaaatggagtcttgctcttgtcgccgaggctggagtgcgatagacgatctctgctcactgcaacctctgcctcctgggttcaagccattctcctgccttagcctcctcagtaggtgggattacaggctcccgccacaacgcctggctaatttttgtatttttagtagagatggggtttcaccgtgttggccaggctggtcccaaactcctgatcttgtgatccacccgtctcggcctcccaaagtgctgggattgcaggtgtgagccaccatgcccggcctgtatccctcataacattaatgtgccttgtgttctcatgaaaaagaaaaactttaatacaatccaaaatccatcagaaaacgagacaaacaaccttaaagattcagcgaggcttggtttgtttctaaagtgatcgcttaggcaatagtgcctataatatcgtcaccaccaagtactgccttgaggtgtcacagaatgtcatacgtgacagtgatagcattctacattacaccctcttgcttaacatatttgtttttaacaatttttttatttctttgtaaacttgactggttaaaataaactagtattacctagaagtaggaggtcaatcaaagactaatctacagatatatgaaattcagctggagtcatttatatgtaatagttgtatgacatctgagaaatatcacaggactaggccttctacttgccagatctgtgactttgctttgagcctgtcactttgacctttagcctcagggtcccagcagaaaaccttcttaatatgtctcctgtgttagtttcttaggactgctgtaacaaaagttccacaaacttggtggttgaaacaagagaaatgttttctttcacagttcgggcagatagatgttcagagtcaaggtgtcagcagggttggttcctcctggagactctgacggagaatctattccatgtctctctctgttccctggaaagactgtatatggaaagtggtctgcaaatgccaaagcagctgagaaaccaaagaacgaggcagacaaatccagcttgtcagtagagggtgatttattggagaatttatagacagaagcgcaatcttgggtggcagcaagacaggcagataggcagatctctgcacctgttacccccagacccagggctcatagggaaaaggtgtacatcgtctgtatgaataactaagggcagctctccagaaggggcaagaatgccaggtacatcacagcctatgatttgcgcaataatgtcaaggttgacatttacacaagggacagtacgtaaagtaggaatcaggaggcattcacaagactggggttgatcagaagtcaccgtggcagattgacatcaaggtgaggtcacttttgctccccactctcctagtttctggcaatgtccagccgtccttggcgttcccggctttcggtgcattgctcccatctccacctctgtcaccattccactgtctttcctctgggagtctctttccatgtttttacctggcattctcctatgtgtctgcgtcctaattttcctcatcttattcagacaccagacattaaattagggtccatcctaattcagtccgacctcatcataacttgattacatcatcaaagaccttattcccaaataagaccactttcacaggtcctggggattcggacttcagcatatcttttggagaataaaattcaacatgtaacatttcccaaacatagaacattttacagtggctatggtagttaagatattgtgtgtcatgaatctaaaaccaagtaaccaaagatgaaatattttgagaaggattcttgaaccgcctggaattgagttggaaattatgaacaaaaggaaactgaggacagcaacgttaaagggaattggggaagacctttcttctcattcctgctcatctatgtacctctgctccattcttctctctagctgtaaatcaatgttctctgttttccattttgtgtcacagaacatggctaccgacaacgtcccagggctgaagagaaacgtcaaccaagaagataccaatatgaaccctttttaatagagagagatggagaaggagaaacctcagagacttgccttctgactttatttttccccccaaaagagatgggcttattttctgcaagaaaagaggcttagaaggcatttttaaaaggagccaatattaaagttttgtgaaagtttttctagggaaggagagttattgatggtaggatggtgtggcatgttcggtatagatgatagaagtgagggtgtgttagggcccaggtaaaggcaggacaccatgtgtgtttagtgggctgactttctcctcgtttgcttttcatcagcaatggtcaataactcctgtgtgtcagatggttactagaggaggatgttagacagctgctaggtgagcccagcatctttacatgaacaacccaaggggacactgcaagtttattcaaccttatctgtgttagagtatcttcatggccacacggtaggttgtgagatggacatataaagttttagtaaaatcacttttcagatttccttgtagatatgtctaacccttaacttccaaggaaaagcaacattttaaaaaataagtcaggccttcttagtaaatatgtgttgaattactaattttataaattgaactcacaaagaaataacatttgatttataaatatgggtatgtgtggttatttcatccttggagaaacttcaggagcgaccctttgctctttataaatccactgactcaggcagagtcataggcaacagaaagaagcccacattcttgcctcactagttcattagtttttaagcaagatatttaaaaattacctctagcacactaaaaagtactgtcttgccaaaactttagttttttttcctttctctttttgtttgtttgcaaggggcagtctaaatagaatatcaacttaaagaaggccagggcatggtaaattaatttctttataatcttattttctatttctcctttttcttattttttctttcttcttctcagttgaaatactcttttcaatatttgttaattacctatcctgatatttttaaaccatcatctccctctctccaagctttccttattctcattccccaaataatgtaagtctaaggaagcgtctttctaaaagctttcccacaggtaggtgataaaaagctgaggagattttcttctttcttttcagtgggtgttggtgtgatcagtgacgggagaaagcagcttcccgtgcagtgcagttcttgtaaagggaggagtagaggggtggtgtctgtttgatgaatagctttcattgttttttatttattttccccaaagcagtgttctccgggcagaatacttgattgtaaaagcaggagacttgtattcaccttctcgttttacattgattttctgttctgcttgaagcctttgtgtttataaatgtaaaaagaaaaaattaggaaaatctgcctgtatttcacatggtgattttgggcctgcctcttgactggggcaccagttgcctttttcataggaaagtgtagaggtgtagacttcacatccaccgtatgcactaagcttccctagaggtcatctgcctgtgggtattaaatggggctgtaatcatggtctctgctggactttattcccctgtgctcatagttttcagagtgttggtgagtgattcaagcaagtacagccaactgtgttaccagctatcacacgatgccctatttttctaccagctatcacacgatgccccatatttccttttttctcccctttctgccatccatcgggcaccagaaccctctgtcccctgattcagctatgactctccgaagcttcagggcgttgtcatgttaggggagggtggggacggacctgcatttctctcacattcagtcacatcccattagacctctgtatagaccccatgctgtactcaggatctctatcatcccattagacctctgtatagaccccatgctgtactcaggacctctccacattttcacttgcttgaacttgctgtgactctacagttttcatgcccttcgggtgagttatgccctaggatgcctcacagtttcccaaagtgagctttgtccaactgaagtcaaaacagacacctctctaatgactgtagtctgtacaatgtagatactatattcaggaaaaataaacaaaatacaaatttgtctatatatgtgtatgtgtgtgtgtatgtgtaagccccaatatgtggtgttttatagataatgggaatattttctttgaaaatatcaatcttaaagaaagatttaaaagtaagaacaaatagaaatatcttttatgcatattcatctatttttgaagtctgcaactgcaacagtggattcacctattccttgcatttctatccatttttgcctcacatgttttgatgctctgctgttaggctcctgcctgttaagcactgttacatcttcgtggagaaatgacccatttatcgtcacttaatattcttcttctttactcctgataactttccttgttctgaagtctgctctgcctaaagttcacagagttactcctgctttcttttgattagtgctagtatagtgtatctttctccacctacttactttttttttttttgagacggagtttctctctttgttgcccaggctggagtgcagtggcgcgatcttggctcactgcaacctccacctcccgggttcaagtgattctcctgtctcagcctcccgagtagctggaattacatgcacccgccaccacggccagctaatttttctacttttagtaaagatgtggtttcaccatgttggctaggctggtcttgaactcctgaccttagatgatctgcccacttcagcctcccaaagtgctgggattataggcgtgagtcactgcacctggcccatctatttacttttaatctatatgtctttatagttaaagtgagtttcttgtagacaacatatacttgggtcttattttttgatccattctgataatctttgtcttttaatagttacatttagaccattgatgttcaaggtaataacaggtatagttggattaatatcaactgtatttgtaatactttctatttgttgaccttttttttttttttttttgggacagggtttttctttgttccccaggtgagtgcagtggcgcaatcacagctcactacagtctcgacctcctgggctcaagtgatcctcccacctcagcctcccaggtagttgggactacaggcacatgccaccatgcctggccaatttttgtatttttttagagacagggttttgccatgtcgcccaggctggtctcaaacttctgagctcaagtaatccacctgcctcagcctcccaaagtgctgggattagaggtgtgagacaccacacttggcctccctggttctttgtttctatttttgtatttcactctttttctgcctttgtgtatttaattgagcattttataggattcaatttcctctcatttcttagagtttgcaatacacgtttacaaataatataaacccattttgaaacaacacttaccacttcagaatagtatgaatagcttataataacaatcctaaatcctccctcccatttcttgtatcattgctgtcactcatttcacttacatataagcatacatacatatatatacacacataagatagatacataagcatatataataaaatacattattgctgttgttattttgaacaaattgtaatctcaggccaatcaaaaataaggaaaataaagaattttaatttaccttcactcattatttaatcaatgctcttcctttcttgctataaactccagtttctgacttaaattattcatcctctccctaaagattttcttttaacatttcttttcttttgaaaatagaatcatgctttgtcattcaggatggaatgctgtggcataatcaacactcactgcacctcaacctcctgggctcaagcaatcctcccacctcagcctcccaaggagctaggactacaggcacttgctcactacaccttcaacctcctgggctcaaacagtcctcccacctcagcctcccaaggagctaggaccacaggcagttgccactatgcctggctaatttttatttttattctttgtagagacaggtgtcttggatttttggcccaggctggtctcaaattcctggactcaagtgagcctactgccctcagcctcccaaagtgctaggattacagacatgagccatcatcaaccacgttcttttagtatttcttgcaacttacagaattttttttttatctctagcatttctttttgtttttttcttaagattttcatttctctgtttacattgctcacctgtttttgcatgctgtctgctttatgcgttagggcttttagcatattaataataattgctttaaattccctgtttgataatcccaccatttttatcatgcctggttctcatgcttgctctttctcttcaatctgtatttgttttttgttctttgccttttagtatgccttgtaatttttttttttttttttgagagccagacatgtattggataaaagtagctgctgtaattaggccttttgtaatgtagtggtgaaatgttgggagagtgtaaatgttctacagtcctataattaggtctcagtcttttggtgaacctatgcctttggactgtaaccttcacaaatgtttctgatttcccactcttaagtgggggcaggatggctagatgggctatagttgagtatttctctgctctcatgtggaagctaaagttggctgcagttgtgcattttctctttcacaggttagttagactatgttaaaaccctgtcaagttaggctctatttcattcctcttcagggtagacctcattaagcagaatgcagtgccatgcatacttcaaaatggtttcttttcccctccccttgctagaagcattgggggatttttctccaatatttagaatgtgaacctggtcaaccttgagagataagaatacaaaagcatgggggctccctataactggaacttcatggaatttttaactctcagacttgttcacactgatcctccaacaatttatcaattaaagttcagatttccttaccctggcactggttcctgcagagaattttgctccagtatggtgtgattctctgtatatgcctttttgttttcaatctggaggcagcagtttgacctaatttttcttatggctcttggcatacttgttgatttttcactttttttttcaagtttatacttgttagaataaagttgtgacttccaagttcttttcatgaggaactcaagattcatctatttttaacatttttatccatttccattttccatttggctgtcctttctctgtaaatatacccatgcatatttcataagaattgggatattctctgacagaactacattacagttaccaacttcaggaaatgagattaaatcttttaatccaatcgaccatcagtattctaattctgtcaaatgacctatcaatcttttttgttttgttttgtttttgtttttgagacagagtctcactccattgcccaggctggagtgcagtgttgcaatcctggatcgctgcaacctctgcttccctggttcgagggcttctcctgcctcagcctcccaagtagctgggattacaggtgtgcacaactgcacctggctaattttttgttgttgttgtattttcagtagagtcagggtttcaccatgttggccaggctgatctcaaactcctgacctcaaatgatccatccacccctgcctcccaaagcgctgggattacaggcatgagccaccgtgcccggccaaatgacctatcaatcttttttatagtacttttctcttcattacaggatttagtctaaaatcagatgtttagtttttatgtctctttattttcttttaatctagaatatgctagaacacttccacaggattctttgtcttttatgattttggctgcttagaatattcctttgggtttttctggtgttttctcataattagatttaatttatgaattcctgaccatatcacatctggggccacatgacatcctcatgttcctcaatggcaacattactttcgatccgtctgttaagatgtcatccaatttctccactatataattattatattttcccatgctactcataagtggtccaggagaaacactttatgaccatgcaaatatcctatttttcatcaaaatattgctctggatttaatatctttgtgatttgtgcctgaactaatctttattttgatggttataaaatgatgattttctagttctgtttccagtttcgatttctagtttctagaagccggacaggttcttctttcctgctgcacagatagaatcgatttgccaagacagctgatttccaatagagaaagatgttaataaacacagagccagcgaagcagaagaccagaatttattgctcaaaacagtctctctggaaatttggagactaaggtttttaaggataacttgctgggcgggggggtagggaaatgggtaatgctgattggttgggtctaagatgaaatcatggaggctaaagctgtcttctcactgtctttagtttctgggatcacaaaaccagttgagccagtttattggttcaggtgtgcaacagctggtccaatcacatgcagggtctgaaaaataccctgaacaccaatcttaggttttacaatcatgatgttttctataggagcaattgaagaggttacaaatcttgtggtctttggctgaatggctcctgagccacaaccctcaacttgtgccaaatttgttagttttctgaaggaggcttttggtccctgagtcaggatgagattcctttccagaagaagctgttatcatctttgttttaaagttaagctaaatttcctccacaattagcttggcctatggccaagaattaacaaggacagcttggaggttagaaacaagatggagtcagttaggctggatttctttcactgtcataatttttctatgtcatatttcttttactgtcataatttctgcaaatgtggtttcagttttagcactccctacacattttctacttggggtgtaacagtctattgtcagcaaaataaaagctaggtcttaagtcaatgtgaattattggacctgaatttgtgtgcatgccgacacatatacacaccatgcacacacatatgtatatttttaaaaagataaatgcatatatatctgcatatttaatggatgagaagacttttcttctttatatcacttgtgaagagctttgttctcatatgctgatttggaaatctcagaatattttttgatcctagtattcaataatgagtaatcaatcatgaaacctctgttgaagtttatattctaaaatcgtcatttatttttaaaaattcatttgaaaacatttagttgtggctataagttgttagtagaaaaaattagaactgaaactcacttgttaccagaactaaagaaaaaaggcaaaaaggattttatctctgctttgcatccataagggaaatgaacataactaatattcggtggaacttttatgtaaaaatacagctcttgaatttgtgaaagcaaatataagccaacactccttttttttaaaaaaaaaaattggttattacctaatttacgttgtgtctacataaaccaatttaaagtctgattttaacattcagtgtgggccaagagaaggggaagaaaagtaccattaagataaaaaaggggaggggccaagatggtggaatagaaacaggtccagtctacagctcccagtgagaccaatgcagaaggtgggtgatttctgcatttccaactgaggtacccagttcatctcactgggactggttttgggtgcagcccagggagagtgagcagaagcagggtggggcatcatttcacccaggaagtgcacggagccgggggacctccctcccccagcgaggggaagtgatgagggactgtacccaccccgggtacagctttcccagtggattttttgcaatctgcaaaccaggagattctgtcgtgagcctgcaccaccagggccctggatttcaagcacaaaactggacagctgtttgggcaagcactaagctagctgcaggagttttcttcataccccagtggtgcctggaaccccagcaagacagaaccatttactctcctggaaaggaggctgaagccagggagccaagtgttcttgctcagcaggtcccactcccatggagcccagcaagctaagaaccactggcttgaaattctcactgccagcacagcagtctggagtcgacctgggatgatggagcttggtcgggggaggggcatctgccattactgagactttaggaggcgattttcctctgacagtgctaaggagactgggaggtttggattgggcagaattcaccacagtgcagtgaagcagctgcggccagactgcttctccagatttctcctcactgggaaggcatctctgaaggaaatacagcagccccagtcagaggcttacagataaaactctcatcttcctaggacatagcacctggggagaggggcagaggtgggcacagcttcagcagacttaatcttttctgcctgccggctctgaagagagcagctgatcctgacaatggggattctccaagcatagcacaccagctctgctaagggacagactgcctcttcaagtgggttcctggtccccatgcctcctaactgggagacacctcccaaaaggggtcaacagacacctcacagaggagagctccaactggcctcaaaccggtgcccctctgggacaaagcttccagaagaaggagcaggcagcaatctttgctgttcagcagcctccattgttgacacccaggtgaacagggtctggagtagacctccagcaaactccagcagacctgcagaagaggcgactgactgttagaagtaaaaactaacaaacagaaagtaacaacaacaacaacatcaacaaaaaagaacccacacaaaaaccccatccaatggtcattagcctcaaatatcaaaggtagataaatccatgaagatgatgaaaaaccagtgcaaaaacgctgaaaattccaaaagctagaatgcctcttttcctccaaatgatcgcaactgttctccagcaagggtgcaaaactggacagacaatgagattgatgaattgttagcagtaggctttagaaggtgggtaataacaaactcctctgagctaaaggagcatgttctaatccaatgcaaggaagctaagaaccttgataaaaagttacaggaactactaactagagtaatcagttcatagaggaagataaatgacctgatggagctaaaaagcacagcacgagaacttcgtgaagcatacacaagtgtcagcagctgaatcaatcaagcagaagaaaggatattagagattgaagatgaccttgctgaaataaagtgtgcagactagattacagaaaaaagaatgaaaaggaacaaacaaagcctccaagaaatatgggactaggtgaaaagaccaagcctgtgtttgattggattacctgaaagtgatggggagaatggagccaagttgagaaacacacttcaggatattatccaggagaatgtccccagcctaacaagacaggccaacatttgatttcaggaaatacacacaacacgactaagatactctatgagaagatcaacctcaagacacataatcatcagattctccaaggttgaaatgaaggaaaaaattttaagctcagccagagagaaaggttgggtcacttatgaaagaaagcccatcagactaacagtgtatctcgctgaagaaaccctgtaagccagaagagagtgggggccaatattcaacattcttaaaggaaagaattttcaacccagaatttcatatccagccaaactaagtttcataagtgaaggaggaataaattcctttccagacaagcaaatgctgagggattttgtcaacatcaggcctgccttacaagagctcccgaaggaagcactaaatatggaaaggaaaaaccagtaccagacaccacaaaaacacaccaaaatataaagacaatgacactacaaagaaactgcatcaactaatgtgcaaaataaccagctagcatcatgattacaggcccaaattcacacataacaatattagccttaaatgtaaatgggctaaatgccccaattaagacactggcaaattagataaagcgtcaagacccatcggtgtgttgtattctggagacccatctaacgtgaaaagacacacattggctcaaaataaagggatggaggaatatttaccaagcaaatggaaagcaaaaaaaagcaggggttgcaatcctggtctctgataaaacagactttaaaccaacaaagatgaaaaaagacaaagaagggtattacataatggtaaagggatcaattaaagaagaagagctaactatcctaaatacatatgcacccaatacaggggcacccagattcataaaacaagttcttagagatctataaagatatcttcaaatcttagagatcaacaaggagagctaactatcctaaatatatatgcacccaatacaggagcactcagatttataaaacaagttcttagagatctacaaagatacctacaaatcttagagatcaacaagaagagctaactatcctaaatatatatgctcccaaaacaggagcacccagattcataacacaagttcttagagatctataaagagacttacactcccacacaataatagtgggagactttgataccccactgtcaatattagacagatcaacaagacagaaaattaacaaggatactcaggacttagactcagctctggatcaagtgggcctaatagacacctacagaactctgcatcccaaatcaacagaatatacatttttctcagtcccacatggcacttattctaaaattgaccacataattggaagaaaaacactccttggcaaacgcaaatgaatggaaatcataacgaacagcctctcagaccacagtgcaatcaaattagaactcaggattaagaaactcactcaaaaccacacaactacttggaaattgaacaacctgctcctgaatgactaccgtataaataatgaaattaagggagaaaaaataagttctttgaaaccagtgataacaaagagacaacatatcagaatctctgggacacagctaaagcagtgttaagagggaaatttatagcactaaatgcccatatcagaaagctggaaagatctcaagttaacaccctaacatcacaattaaaagaactagagaagcaagagccaacaaatgcaaaagctagcagaagacaagaaataactaagattggagcagaactgaaggagatagagacacgaaaagcccttcaaaaatcagtgaatccaggagctggtttttttggggggaaagaaaaagatagaccaccagccagactaatgaagatgaaaagggagaggaatcaaatagacacaataaaaaaatgataaagaggctatcaccactgatgccacagaaatagaaactaccattagagaatactataaacacctgtacccaaataaattagaaaatctagaagaaatggataaattcctggacacatacatcctcccaagactaaaccgggaagaagtcaaatccctgaagagaccaataatcagttctgaaattgagggagtaaataatagcctaccaaccacaaaaagcccaggacaggacagattcacagccaaattctaccagaggtacaaagaagagctggtaccattccttctgaaactattacaaacaataaaaaaagagggactcctccctaactcattttatgaggccagcatcatcctgttaccaaaatctggcagagacacaacaaggaaagaaaacttcaggccaatatccatgatgaacatcgatgaaaaatcctcaataaaatactggcaaattgaatccagaaacacatcaaaaagcttacccaccaagatcaagtcatcttcatccctgggaggcaaggctggttcaacatatgcaaatcaattaatgtaatacatcacataaacagaaacaatgacaaaaactacatgattatctgaatagatgcacaaaaggccttcaataaaattcaacatcccttcatattaaaagctctcaataaactaagcattgatggaacatatctcaaaataataagagctatttatgacaaatccacagccaatatcatactgaatgtgcaaaagctggaagcattccctttgaaaactggcacaagacaaggatgccctctctcaccactcctattcaacatagtattggaagttctggctagggcagtcagacaagagaaagaaataaaagatattcaaataggaagagaggaagtcaaattgtctctgtttgcagatgacataattgtgtatttagaaaaccccatcgtctcagcccaaaacctccttaagctgataaagaacttcagcaaagtcttaggatacaaaatcgatctgcaaaaataacaagcattcttatacgtcaatcatagacaaacagagagccaagtcatgagtgaattcccattcataattgctacaaagaaaataaaatacctaggaatataacttacaagggacatgaaggacctcttcaaggagaactacagaccactgctcaaggaaataagagaggacacagacaaatggaagaaaaattccatgctcatggaggttaaggatcaatatgatgaaaacggccatactgcccaaagtaatttatagattcaatgctattcccatcaagctaccattgactttcttcacagaattagaaaaactacttgaaatctcatatggaaccaaaaaaagagcccatatagccaagaaaatcttaagcaaaaagaacgaagctggaagcatcatgctacctgacttcaaactatactacaaggctacagtaaccaaaataacatggtactggtaccaaaacagatatatagaccaatggaacagaacaaagacctcagcaataacaccacacatctatctacaaccatctgatcttcaataaacccgacaaaaacaagcaatggggaaaggatttcctatttaataataaatggtgttgggaaaactggctagccatatgcagaaaactgaaaccagaccccttccttacaccttatacaaaaattaactcaagatagattaaagacttacatgtaaaagcataaaaaccctagaagaaaacctaggcaataccattcaggacataggcatgggcaaagtctttatgactaaaacaccaaaagcaatggcaacaaaagccaaaattgacaagtgggatctaattaaactaaagagcttctgtgcagcaaaagaaactagcatcagagtgaaaaggcaacctacagaatgggagaaaatttttgcagtctacccatctgacaaaagtctaatatccagaatctacaaagactgaaacaaatttacaagaaaaaaacaacaccatcaacaagtgggcaaaggatatgaacagacacttctcaaaagaagacacttatgcggccaacaagcatatgaaaaaaagctcaacattactgatcattagagaaatgcaaatcaaaaccacaacgagacaccatctcacaccagtcagaatggcaattattaaaaagtcctgaaacaatagatgctggtgaggctgtggagaaataggaatgcctctacactgttggtgggactgtaaattagttcaaccattatggaagatagtgtggtgattcctcaaggatctagaagcagaaataccatttgacccagcaaccccattactgggaatatacccaaaggattataaatcatcctactataaagacacatgcacacatatgtttactgcagcatcatttacaatagcaaacacttggaaccaacccaaatgcccatcaatgatagactggataaagaaaatgtggcacatatacatcacggaatactatgcagccataaaaaaggatgagctcatgtcctttgcagggacatggatgaagctggaaaccatcattctcagcacactaacacaggaacagaaaaccaaacactgcgtgttctcactcataagtgggactgaacaatgagaacacatggacacagggaggggaacatcacacaccagggcctctcagggactgggggcaaggggagggagagcattaggacaaatacctaaagcacgcggggcttaaaactagatgacgggttgacaggtgcagcaaaccaccatggcacatgcatacctatgtaacaaacctgcacattctgcacatgtatcccagaacttaaagcaaataaataaataaataaataaataaataaataaataaataaaaaatgggggaagaaaaatagaggagagagggaggttatccatctatgcatctgttttttcataacaccaagtacttccatttctatgtgctaaatatatgatatttattaaaaattgaattgccattgtaatgatattaggaggtgggacctttgggaggtgattaggccatggctccaccctcatggatgggactggtagagtctggccccctcttgccttctcttaccctctccttgcccttctactcttctgccatgtgaggaacagtgttccccccctctaaagcatgcagtgtgcaaagtgtcatcttggaatcagaattgccaaatctgctggcaccttggaccttccagcctccagaaccataaataataaatttctattctttataaattgaaaaaatataaaagaagcatttcaactccttggaaatatgctacctccattgtttttggttggtgacatgcagatttgctcttttatcttgtgctttttttctcttctttcagtcattatattaaaaaggaaggcacttagttctacttaactctgttgaatgctctgtccactaacagctgaatgtctcaacaactacacagcattaggatcttggcggctcccgtgtcaacttccagcgctctaaacagtcccctgccctgtgcaatgagcatcatcaaaaagacctaccaagagaagcaaaaacaaagcaaagccttttctctgaatacactaatttaatgtattcatgtgaaagtgcttcatatcatacaattttaaggccaaagagaaagaacgtagcaaaaagttctttaaattttttgtgtgtgtatgaatagttagctaagaatcctagttgaatctctgagagttagcacacaaatgcacagacgctcgtactctgaatatggttgtattttaacaaaagataatcacatatttcttaagtaaaaacatgagttcaatatctgaattcggcacgatggggatgggagaacagaggcaaatgaatgtggttaattatgccagttaccctgaatggatactgcagtcactttcctggcagcagtaggcagcagggaagtgttagagctgctgagtccccgcagcagctggagaagctggaaaagcgagaggtgctaaagatgtttctggactggaagagggcggattccgtactttctaactgcaccctgttttcacactggtgaagacgactctgtcctcagcactcagcagtacactgtgtggtccagaggctgccattcacagttgttgggaagacgtaaaagcatgcagtgaggcctcccaatacagtatcgtgtgttgttctcttaagcctttccacttccaggtaacctactttctctttgcagaggttgctgaagtcaaaagcagctcactcccagttcactgagcttgagttccggctgcaacttggccttgagatttttgaaacgttgatatggaagataaagaaaaacgcagattcctgtcttctaaggaacaaaggctggaagacagttctgcagattctgcctttgagggattagagggatgtgcccaggaccagatcttcagttatgcaaatataccttagagaccacagtaagaaagacatcgctctgaaatgctctggtcccaaggaaaatattgctctatataataatggaaaacgttgtctgtgtatcatgctgagctgcattttattttgtacccttgagagagcttttattttcttataaataaggattggtcttgttctgggtctgaaaactgttgtgtatttttgagatgtctatttttcttttcagttgcctgtaagagattgggagccgagggcctgagggtgaagcctcgtttgtgcaggtgactgtgggactctggtgtaagtaacgctgggcccaccctggtaatgaaggaagacccaggcccaggcaggggcggtgtcacaggcacaggggctcgcaccctgggcactgacggtggctgtcgcaccagggccgctccttgcagaaacctcactgagcctgtgcctgttgagtagcttcatgaggagcggatatcaggcagagaaagcccgggcaagagagtgacacacggggcttctgcccagaacacgtgcgcccacaatcccgggagctgtacaaatcccaagcggggaagcggaggcctcgacagttcatgatgcggacatgaatgggaatgcggccgcttgccacacctccttcttcatttggggaaatgcttgaaggtttgttttgtgaatgctaggttaaggtttggaagtttattttaaaaattgacatcatggccgggcgcggtggctcacgcctgtgatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcgggagaatggcgggaacccgggaggcggagcttgcagggagccaagatggcgccaccgcactccagcctgggcgacagcgagactccgtctcaaaaaaaaaaaaaaagaaaattgacctcaggcagggtgtagtggcgcacgcctgtaatcgcagcactttagaggctaaggagagagcccagaagctcgagaccagcctgggcaacatagtgagacccccatctctaaaaataattttttaaaaattaatcgggcatggcggtagaggcctgtagttccagctacctcagaggctgaggcgggagaatcacttgagactaggaggttgagcctgctgtgagccggatggtgctactgcactccagcctgggtggcagaatggaccctgattaaaaaacaaacaaacaaaaaagatgtatcaacattagccactcagacattgttttaaaatagtttaatcttctatttgagttacaacctgaggtaactcccaatgaaggagataaattatatagaaattaaagaatttaggggaagactctgtaaaaatgtgaaagaatggaaatcagggtgcttcggtgggggaacggtccatgtgacaaatggaatgcctggaaccgggagggcgctgggtgaggacagagctgcactaagtataaatccatttataatctgtggtctgagaccagtgagaaatttacatcctccattaggttttgagaaaggctcacagattttccctaaaaacaaatgtaataaaaagataagaagtcaccaatcccctgtaaaccttgtcatgtttcaagtgaaaacgtagcccaaagtcagaggcatggacattgtccccagagagatggcccaggcagggggcacgtgggtgctgacgcttatggcagttgaggggatctggatgggctattggaaagagattgccttgctgtagcaaatccctgccagccataatttaaagggacagaagtcattagtctgcaatgtcgctgtctttgtaccaataaaacttgtatttgcctttctttgcaagcctcattgctctgtaactcaatgtcagcagtgagtgagacctgtctcagaaacagtgacaactgcaaatttcagcagcattaatgttatacacgtgcatctggtcttctgaaggttaagtaagttgggctgttttccaagctgcacctttattctcagttctgccagggaaggaaaaaatactgctgatcttctatggtccagaaagtttgtaccatttgttttctaataaaagcaacaataaacttaactcaaaagggaaattgaagttctagcctcttgtttaactgaatcaattgtttgaaatttaatcacaaagcaattgggcaagtttttctctgatttgtttggacgtaatctagcaatctgctgctaaatccttgttctttggaaaagaggtaaattcggcttggagcaccctccttacagcctgcgtgcgtctaaagctctcgtcataatttatgtgaattaccacacatttacgttttcatggaccattttgcctgaccactttgttctttattagtagtaatatacaggatctagcaatcactttttaatatctgaatatttgcataaaatctcactctcgcctcctgtggctcatgaaaatgtttcacacaaaccttaacagggctcttcctaagatgtcctgagacgccgtctagggaaataaacaattctcaccttgttatttatagaatatgtcatattaactcagtacttaatcctctacaattctttctgtgcatgcaacggaacctaatcatcacgactatgctgtgagggaggaatggcccctttattgtacagctgaggtgaataaggtttaagccacacgcagttgaagtcactgcttacaaatgcgtatctagtggggaaattggggcttgatgccattcgtttgccctccacgttttatgctcttttttctgcatgactctgcctctcatgttattatgggtctcacccctgcagtatgtggataatttgactgtttcaagtgtgatgactctgcctctcatgttattatgggtctcacccctgcagtatgtggataatttgactgtttcaagtgtgatgactctgcctctcatgttattatgggtctcacccctgcagtatgtggataatctggctatttcaagtgtggttccttaactgtgactgtaactccatttcagctcctattaagaggtgaaaaatacttccctgtctcttaacttggatggagcttgtgatttcctgtaatcaaataatctgtaatattgcatgccttctaagccctggactcaggatgcctgtggcttccaatattattttcttggaatgtttctgacactgtgtgaagaagcctagaatgaagaccacatggagagagacacctagctgtctcagtcatttcagccttgaaacttaggctcagaaatatgagagccgcccactcagaccttcacttccagccgtgctgcctgcagcctgtcccactgcagtcagcccagggcaggtgagcagaacaaatgccctgtttacctacagagttagcagaaataaaacatggtggttttggtgcagtttgttacacagcagtaaataactgatgcagcaagcattattagaaatcactgcacgaatgcataggcatgtttaaaattcattacgttaagagcaaaaaaaagtatctcatcatgatgcaaaggaaagtaacagtaggaagggttatttcctaggtccaagtgttattatttttatttcctgaattcactatgaggcatattgtgggtcaaagttttaataagattaaaaacaatatagtaggctggatgtggtggctcacacctgtaatgccagcactttgggaagctgaggtaggcagattgcttgagcccaggagttgaagactagcctggtcaacatggagaaacaccatccctacaaaaaatacaaaaattagcctggtgtggtggtgtgcacctgtagtccagctactctggaagttgaggctggagatggcttgaacccaggaagtcgaggctgcagtcagatgagatagctccactgcactccatcctgggttacagagtgagaccctgtctccaataatgataataataatgataataataatatattagtccattattaaaaatcataagggccaggtgcagtggctcacacctgtaatcccatcactttgggaggccgaggaagtcggatcacctgaggtcaggagttcaagaccagcctggccaacatggaaaaacccatctctactaaaaatacaaaaattagccagtggtggcgggcacctgtaatcccagctactccggaggctgaggcaggagaatggcttgaacacgggaggtggaagttgcagtgagctgagatcgtgccactgcactccagcctgagcaacaagagtgaaacaccgtctcaaaaaaaaaccaaaaacaaattataaacaagtttggacagaaatagggtttcagctgcattataagaatttgctgagtcttataaaatgttttttattaatttttattagaacttataatagccattctattggattgaacagcacacattttttaaaaatatattaaaaataataaagcagttggaaagtgaagcaagttgttttccagcaagccccagctttgtgctttcagaatgagcttgaggtcagtcagacttgggttcaaatcatggctcagccgctcactggctttttgatgtttggcaaattgcttaacctctctgaggcttgattccctcaagtgtaaattccttagcatagctccaaattaatgatgagattcatttgtatttaatgtttcccttattttagaacatcccatgcctatgtttcaaaaataaaatagtgcttggccgggcgcggtggctcacgcctgtagtcccagcactttgggaggccgaggcgggcagatcacgaggtcaggagatcgagaccatcctagctgacacggtgaaactctgtctctaccaaaaatacaaaaaattagccaggcgtggtggcgggtgcctgtagtcccatctgctcgggaggctgatgcaggagaatggcgtgaacctgggagtctgagcttgcagtgagtggagatcgcgccgctgcactccagcctgggtgacagagcgcgactccgtctcaaaaaataacagtaataaataaaattaaaaaataaaatcgtgccagaacccaatttggtggctacaatgacaatacagaaaatatatcctccctggtatgcacaagtttccattaattctcttggtttttcaaagtaaacaacaatattgtcttcaaataatattaactttacttccttttttccaattgtcatcatcattattttctactctgttactgccttatgaccttgcttatatgactcaggtcttttaatatgtgttacaattatgaaaagagcttagtaccttgaatatctaggaaaaaataatctgaattttaaaaatcgaatcagggataatggcaatatttcagaagtagtgagatgagatgtgatgacggcaagaactaggaagatatcttaggatatcaaaaggcatgttttagaaaaaaagcaggcaggttccaaatggctgtctaatataccctggctatggctttgtggattcagtggtgacccagtgcagatcacaggccagggcagagaggactacctctagcccagctgagcactttgcaaaaatctcagagaatgaaggttctaaagacagatattctcattcgctagcctgggtttgggatgaaatctgtattttcaaaagtgtcccagataattctttgtatagccaagctggaaaccaatggtctaattggccatgtccaacgaacgaatagacaatctttttaatagatattaaaatgtattataccctaagtaaaaaagaaacccatttataattctccatttaaaagaaagagttccaataatatagattaaaaaaagtgtcacatggttttaaacacacacacacacacacatatatatatatatatatatatatatatatatttttgagatggagtcttgctctgtcacccaggctggagtgcagtggtgtgacctcagctcactgcaacctccacctcctgagttcaagctattatcctgacttagcctcctgagtagctggtattacaggtgcgcaccaccacgtccagctaatttttgtatttttagtaaagacagggttccaccatgttggtcaggttggtctctaactcatgaccacatgatccacccacctcggcctcccaaagtgctgggattacaggtgtcagccaccacgcctggcccgcatggttatatttttatattcttctctagtttgaaacaatgtaccttgtgcaaaatatcttctgttgattattatttgtaagctgcattttaagtttacaaagtaactctacatgcgttctttcctgcggccttcacagcagctcttagacagtgggagtagcaatgcctcacacctgcctagtcttatgcatcttgtaatgcacccttacttcctttctccatataaaacttacatgtggcattcattctctcagaactgaaatatccactgcttggagttctcaaaatatatggtgttgaattccacttttgtgctttttcgtatgtcggcccctctgctgagaatttcattcctggacttttatgcgaattttattcacataaacgaaggtctctgctctgtttgcgttcctggttggattgatcagcaggacaggcagggagccaagccctcaacactgctatggcctcccacatctctgaggtacatcgatagttcccaagtgcagagacaatcctcactgcccttccctgccctcttaggggatttgttttttgcacagaacatataacaaaggaaagaacccagcttcgactttgcatagaattccgttttcaaagctctgttgtccattttcctctgcatcagcaatcctcacacctgttttcttaacctcatcataacctcaacatacacaaaagatggccttagcacaggggcgaacctcttccgaatttcctaggtttgggcatgatcctctcgctgcttcctcagactcttccctttcctcttcctctaccctccccccaccacccaaaatgttgtaatgctagtgactgtgaattacttcatagtcattttcatacctttgcatgtctgtaattaataattaaaaaataaagtgtttgcaaattttagcactttaaatagtattagtgacaaatggctggtcacgtcattattgcgtgtcacgagtcaggaccccccagggtggaatgccagcctcctgccctctgccaccctttgctgcagatgaggcaagcctgctcactccgcaggcttccgctggggctatcggctcagtggctgtggagcatgtctgtcacgcgtgctgtacagttaggccaacgattagtgatgaaggtgacaaatagacactttttgccgtgcactgagggggtcactgttagtaccacctagacaggaatgtctaaagatgctgtcaatgcaaccagcaaatgtcgaatatatttttctcgaagacaaaacagtctaatctcatgtaagaagagtccattcattcgccttgttaacatgtcttagtcctatactagagaaagcataacctgatgtcattaattgaaggatgagactctgtggttatcgtgataataagtatatgtctggtctctgcccctggttcctggcacatggctcttaaaacccttggaatctccagagacacaacagtgtcctttgtatgctaacgagatgactggtggttaaggatccctaactaacatcaagatggggcacagtcaccagaaagaccaaggactgattagtggtcgggattttcagccccgcccccaacctccaggtgagaaagagggctgaaagttgacttggtcaccagtgggcaatgatacaatcaatcatgcctatgtaatgaagtctccataaaaccccagaggactgagttcagagagcttctgaacagctgcacgcagggaagcgtctgaagggtgctgtactcagagagaacacagaagctccacacctcctcccgagtaccttgcctatgcattttcccatcacactgttctgcagactttgtaatatcctttgcaataaactggtaaacatcagtaatgtgtttccccgaattctgtgagctgtcctagcaaattaatcgaaccaaagaggggattgtggagaccccaatttacagccactcagtcagaagcacagatcacaaccaggcgcttacaactgtcatttgaagtgggagacagtcttggggactgagccctccacctgtgggatctgaggctactttcaggtaaatagtgtcagcattgagttacattgtaggacaccctgccgatgtctgctggagaattaactgattggttgttaatggggaaaaattcatacattccttttggtgaccagacatgaagtattcagtgttgcaggttgagcgtaagtatagaaaaaatagtttggttttctcttataactctacagagactccttctgtctgtctaaatttctgggggtaattacactaattgtaaacagctttgtctgctccatctggaagaaagtgctactagccataaactattcccactagagagtgatgatgtgtatggggggcatatggattggggagtggagaggggagtctgcaccctcagccctactagcaatgcaacatttggggaaagtagcgggaagggaacattctgatgccatgacagatatcttttcacacagatttattgtactagttttcaaggtaaactgttttagtagctaaacagaatttctttaaacatgtgggtaccaatttgctcctcgcgcagtgcatgtgatagtgagataaaaaccaatcacacagcatggctggagcacagaaaaacaacattttactttcttttttgagaataaatggctttgttaacacagccaaaacaattgatctttttatttgtattttattcctggtcaatattttaagggctgactggagacttgaggccctgttgggtggaattaaagtttacaacagcccacgttttccatagattatgaaggagccaagcaaacatggtctctattagaaactcaacaacctcagcccctagattaaaagaaaaatcactcaaaagcagacacacaaaatacaggaagaaggaatactgtctagatgtgagactgatttttctaagtctctctaaatttctaagtctgtctacaaatgtgctgatttgtagcttgctcaattatatgtatcatgaaattctctactctacgttctcttcttctttatacaactgtagaacagtctttgtcattcctgttttccaaacccctcaccatccaacactcccttcaactccatgtattcagaaaaaatattcctgaagagtaaaaggcaataaaattcccaaccattccacattacttctttattcagttttgcctttcagtgaagtatgatgtgggacagcaaacaaaataaatgagcgtagatgagaaaggcagtcacttttctcaactccggcaggctctccttttgacaggcattttctggctgtttcagaagttgtcatgcctggtagttgtggcccagacattgaactgtccagagaagttctcgtgctgtccaagcaaaatgcttgcatcctaattccagaatgcacaacacaacatttgtactaaaagggagagtcttcctgttcgatgatggtttcataaaaatcaggtggcactcctattttgttggatgtaatttaaaaaggtcattccgtggctgggcaccgtagctcatgcctgtaatcccagcactttgggaggcagaggcaggtggatcaaggggtcaggagttcgaaaccagcctgggcaatatggtgaaacccaatctttcataaaaatacaaaaattagctgcgcatggtggcgtgctcctgtagttccagctacttgggaggctgaggcaggagaattgcttgaacctgggagatggaggttgcagcgagcagagatctcgccactgtactccagcctgggtgacagagccagactccgtctcaagaaaaagatcattccttcatatatatatgttcatcaagatagtagacaaattaatacagaaaaagagattcttatttcatccatgaagatgcatggatacctgttcttctcacagatacacatatcctatttgttatatctgaacaaagtcttgaatattaaaacaaaaagtggatgaataaactctcgtaacatacctgcaactttagaaacgtacacatgatttagcccttagtggctctacactttcatccagctcgcagagactcagtgtttttcagaaggatcttatgtgactagaaatttaaggtagtgaatcaaacatttgccttactgtagcttaatattttaatacctctagtacattaaaaatagcatacacattcaaatttcattatatatattaaaattaaatttactttgggaattttatgatatcttcaaatcactgaagttaaaacaatggggttcaaacttatttttctattatttataaaataattttaattcatctcatctcttaaacataagacatgataatttatgtacaaaaatgtttaatgcagtgttattcatagtgttaaaaactggaaacaatgtaaatgtgtaattacacaagtataattgtgaaaaaacattattaattttttcggtaagaaaagataaaaattacctatagtcaatgataacacttttgatggtcattcttttctatgaatctgttttttaatttgatttttgaaaaaatattcacaaaaataacttttagacgaataacatatacataatttgctccatgtacatttatcatcgtaaacagctttattctttttttccttgttcaaattcacacatccaggaaggggtagaaccagatcacatatttagagcaatcttaatctaaagctaggttctttctattgactcggggaccctggggctgcgtgactctcataagtcagatcaggtacagaaccagctctacataccacaacgccctcagagagttttcagcaagtccctcctgcaagcagctttattttaaacaaataaataaatagctcgctgaaaggcaaaactgaataaagaagaaacttggaatggttaggatttgtattctcttttactcttcaagaatatatatatatgttctttacatttactgtcttttaactttctcccttcaggcactgaatttaccaggcagccaggattaccaacttagtatgattcactacagctttctccattccagtacagctatatacaaaatagagacacccatacacatttcctgttgccgtttgccttttagaagggttcatacattttatgctgacctttcattagaagggatcatacgttttatgctgactcctcggcttttgctcttctcacttgccagtgcatcagggaggcttctttgtcagcgagtgaaattctaacattcttttttagtgactgtgtatataatatttcatgatgtgtatacatctcaactatttccccactaaagggggtttccattgtttctgattgttttaacactataaataatgctgcattaaacactattgtataaaaatctttaaaacataagacttaatttctatgtcattcatcccaagaagtgaagatgttaagtcaatgatgtatgtcctggccaggcgcggtggctcacacctgcaaccccaggactttcggaggctgaggctagtggatcacctgaggtcaggagttcgagaccagcctaacacggtgaaatcccgtctctattaaaaatacaaaaattagccgggcatagtgatgggcgcctgtaatcccagctactcaggaggctgaggcaggagaagtgcttgaacctgggaggcggaggttgcagtgagccaagatcgaacgattgtactccagctgggcaacagagctagactccatcaaaaagatgtatgttctgtaaactataatagacattgcctaattacattgcaaaatagctggtacaatgtacacgcctcagaaaaaacaatgccttttcagtaaaagtagatgatatatttctatttaatgttggctaatcaaacaagtgaggataataataatgactacatttgagtatcctttctaactttacgacaattggaattttctattttgtcaattcttattgtcatttacttatagaattctggctttgagttacattttgtaagattgccctccattttaatatgaaatattttgagaaaaatattttactcctgtatattctatatttcagaatgtaaaattgatacattcaatgaaagcattcgctaggatttaaaaattgtcatttttaaatctgaaaatcctgcattgttcttggaaactgaatttcatcagtgagcaattggaaaaccttatgaatggcaagttattagtaatgtgaatgaccttatggaaaccacaattcaagacattgtggaaatgaatttggattgtccaaaaatgagacctagaactggaataggagtacaagtttctgaatggtttgtcctcctatattcataactacaacaaggattaaatatttttttcccaaattgcaagtctggaaacatttttcatgattttttaaaaaagaaaacctaacttttttttttttcttctcccaacaagctgaagcttgttgcttgactgaattcttggagataaagaatgtgccctggtacactgaaggggaaaatcagatcacttgcagctgacattactgccaaacgtcagtgaggaggccacagtcagctgggagaattttaccctttaaacatcgtccatgtcgtacttgtggagccactggcttgtataaagatagttattgagaacatttcatagcagggatgtggggaaaccatgcatgtcagaaatcgtttttattccaagatgtgcttcagctctccttctccttctcaaagctcgattctttaaagagattaaagttcagtggtacgaggccgtataaagacatctgaataattccacgatatctagacatttctgaagaaatacactcttttttaaaaagtagcagttatttatcacaattttctaatttatgatcccggattcacgactggttagggtagtaaatatttatgggaagagatgcccctggaatccacttggggaaaagagaaagaaagtcacttcccctttgaaggcagctttactcttccagcatctcgccactgtttcagcgttcctacagctgtttctgctttggacaaatattatgtttttctgaagaaacaccttatttaatgatttaatgttgtaacagtatttagagcctagtaggttctcaataaatatttattgaacgaataaacagactgtcacatcattttattaaatgagttaaaaagggccaaccaaattcatttcttaggtattagacattaaacaccaaattgtgtatagaacaggatgctgggagatgaaagctgtgccaggccttgtagcctcaccgaaaccatttgaaaaatgactaccacttttcagcccagcattttttgctattttggattttcttagttcatagcacctgtcttcatgtcacacaactggaaatgcgtgatcctttagtctctggatttttttcttaactaatacattttagatattacatcagctatatttagcatatccttttcatttatttgtattttcctcatattataggccagtttttacagtcgaatatcccagatttcacattcttataaagttgcataattcccctaattttaaaatatttattcaattggctgggtgcggtggctcacgcctataatcccagcactttgggaggccgaggagggcggatcacgaggtcaggagattgagaccatcctggctaacacggtggaacctcgtctctactaaaaatacaaaaaaattagccgggcgtggtggtgggcgcctgtagtcccagctactcgggaggctgaggcaggagaatggtgtgaacccgggaggtggagcttgcagtcagccaagatcacgcctctgcactccagcctgggtgacagaacgagactccatctcaaaaaaaaaaaaaaaaaaaaagaaatatatatatatatatatgtattcaattaatatttttggttgcatggtatgtcttagatactgaggacgtagaaatattttcttatatgtaaagagtatttacatgattaatctcttcttaaactgccactttgtatattgtgtatttttaattttcatattgaaacacttataaaaatttttcataggatttcttattaaaagtatcatagacctcagcatatcttagtaagacccttgtaaaaacaatgagacaatttgttatcttttaaaagtaaatcagcagcagaataatactaaattaataaaataagtgttataaattttgtgatgctaatattttcaaaatcaatcatatttaagaatgcaatattcaaaacctgccatggagtgcaatttcagggatgcagcttggttattttaggtttagtttttgtatcttagccatttttggaaagctacagaagtcgttgtaaaaaaccacatctattggttgttatttctacatcttcaatttcccataggaatcttataatctagttataaaccgtaatctttcctattcatctagtccttgaagactcaaaggcagtcaatttcaagcaatttatagctaggttttattgcacgactggcagctcaggatgcctcccagaggcacgtgaaactgaccaaagaaagtctccatgagccaaggtggaaggtggtttgaattcatctacttaacttcccatttcgtaagtaagatttccgtagagcccagttcataaagagagctttgtgactgaaacaaccaaaattacatcaaatcagttatgcttggaaccctgctcacttgcagaaaggcaacacaagagctctgtgcagaaattgccatattacatgatacagtttgcactttattcattcacactaacttatagtctatgaagatttaaaatatgagggtttaaagtgatttctaagatgatataaaaacgaagtatttatgtttaataaatttcctctctaggacttttgaaaaacacatatcatgaactaatttccgaccaaacactttataataaaaaaatgaaattgccttggcaaagaagaaaaattgttttcttatgaaatgacacgtttgcttttatacggcacttcagttagatgtaatgattttaatctgagagctgcaggtacatatttttctgtctttctatctacctatctacctgattttgtttacacattttagaattatttgctcaagaaaatgttaaagagaagtgacaaactctaatttaaaatataaacacctcaagagatttgctaaaatagactcaaaatgcattatgttaggaaatatttccacagagaactaatgataagtggacaagtaaaggtaaacagcttaaacatttttgttggttttactttttggcatgatggtgttaaataaaagtctcagtatttttagaaaatgctttaagcagtacattctatttttaaactatatgtctctattttaagtcatagtacgtgatatggagagatcaggttttatgttgcaagtgtattttaaacaacacattcttagtcacacatacattttaatacacattaaatttaagctgtcttactgaattttgaaataatttagtgcggctaaggatgcgttttgttttaagcatattcacaacataaaatatgatttctgaaactcgaataagagaatatttcctacctaggcactaaaaatgtcttaaaaataactcaaaaacaattctaggttcaaatccaagaatgatattaaagacaaaatatccacataggtaataggagtagtgtttattgccatttaatgggcagcagttatgatttctaagaaacttggaaggtccttttatgggaagaggacttgacctgggtcttccatcactcttgaccttttggaaagtgagcgaaagttagccaaaatacactaagaaaagtaattcagccttgtgctgactctttccacaccaaatagcacctatgtaggaagtaaatcattaagctttgaccacgtctacaaggccaaaatgactgcagcatccgcagacaagccaggctgctcatcctcattgggacatgccacacttcaaaggtgaccgagccggtatagtggcacacacctgtattcccagcaccgaagggggaggattgcttgaggctgagagtttgacccgtctggacaatgcaagcgagatccccgttttcaaccaaaacatttaaaacttagccaggcgcggtgttgtgcacctgttgtcccatcttcttggaaggctgaggtgggaggatcccttagatggccaataatctattcagactttgccttgttcatttcttcacttccttctttcattttatttaaatagattgtatgttcacatgataaaaacaattcaagggttttacaagagaaaatgaggttttatccctaaccctccattcttcaatttttttcctccagggacaaaaagtctttccagttcttttttatcctcccatggctatcttacacctggatggagagctacatttagacatcctaatttctttacacctgaattgcagcttattttgcattagtgttctgtacttttttccccactgacaatgtatcttgggaaaaaatgccatgtttctaatgttacacaagtattgcatcacatgtattcggcaagactgattgaactactttaattctgattggtctgtaagttgctattaatctacaacaaataaaggtacattatgaggagtggtgacacaggcatagtcattttcatgtagatatattaacacaggagaaaatacatttcaagctgtggaattactgagccaaattcatgtacattccaacttttatagatattgccagattgccctctttagaggttgtactaacttatatacctatcaataaggtaacaaagtgctgttctccatttgcttgaaggcaaagtactaacaaacttttctgtatttgttaatctgacaggtgaataattgtctctcatatttttactttggttttatgctataattaatgaggttgtatagcttcttcttattccatttgcactttccaatattttatccaacatcctggaacacacctgtttctcctcaatcccccaaaaatagctgctcaacagtccaactgcatatatcttttctcctcttacctttcgttctctaaataaaataaatgcattccccattagggtttggtgcaatcgacgatctttccactttacatcactttattaatttggtttcttactcaccattttcttgtcgaggccacagatcaacccatttattaacaagtctagtaataattgtaagaagtgtagccatctctgtgaagacatcaagaacaactggaacgcggagctccagcttcattcttgtcagtttcttttgagaactttctgtatacagcagaaatatcagtacccatagttcatgaatattattagactttatggattttttttttgagacagagttttgccctgatgcccaggctggagtgcagtggctcgatctcggctcactgcaacctctgcctcccgggttcaagcaattctgtgccttagcctcctgagtagctgggattacaggtacgtgccaccatgcccagctaatttttgtacttttagtagagacagggtttcaccatgttggccagactgttattgaactcctgacctcatgatccacctgccttggccttccaaagtgctgggattacagatgtaagccactgcacctagctaggttttatggttttaaaatacactagagactgctacaaaacactggacactcttcatatactttgttatttctgaaagttattattttaccagtaaatccccatttcctataagctaattagatttatttattgtcacattcaaataattctattatagaatcagtagatactgagtttataggttaaaattgttacaatttcatgtttttaaaaactttgggaaattattattatccctttaaaaataagtatgaaagtattgaattgtttcccctttaacttttaacacaaggaactataagaattggaggctatagagtgtgtttacagttgcagctataagaaattcaggtttatcagtagttactcattagaataatcactgtatttaatctaactacagataaaatataaccttagctatatacttttgtgaggtatataattaacagcatgaaggaatgaagtataaaaataatctttctagaatctacttttaatccaagtcatgtatttggcatcacacagggtgtattgtttaaattttctaaccttggttgtaagtcaacataatttcagaggtactcggtgagggtacatttgaataaggtgagccctctcagaacaaatcatcatgttcaggtacctgaatctgggaagggcttgtgatttagaaatgtatcttttatctatagcatttcagaaaggtgaaagaattttgtactagtatgagtcatactagtagaatgaccttaaaaaattatatgtcctactcatttttttaaaaaaatgctttgttcctacaaattcccaaaaaccaacctatcagttaatgtaaatataatacataatgtatcaataataataatcaagcttcagaattggtggtttgccttgaaaaaacatatatgcacttgagaaaactggaatttttttggacaaaacattaaccttcaaacttcttttgttattgtgggggccaagggaaaacttctcttttgccttctgaagatttaatgaaaatcaattgacaaaagacaatgtaataggagaaaaggcatacaaatttattaacacacgcaggaggcatacaaaatacaagagcaccaaaaaatgtccagatagttgatgcttttataccatctggaggttacagaaagtatataagcttggatcttgggaaaacaggttatggtagtaaatcagctttagacaggacagggtatgggaggcagagaagaggaggcctggcctggcctgcaaaggtggtctcattacgtagatgaaacctcccaggcagcaggactcagggggaatagatgggaaatgtctcttttggacctttaaaggcgtcactctctgccaatcttttctagatctggagaagggagggtctcagagaaagccaggctgcgtggatgtggattttccctgcaggtgcaagtcttcccaacagaagacctttgcagggctgcccatggtcacaggccctctgaacatccatcttaaaatatatcaaagaagggtattttggggtaaaatattttggtttccattatttcagtcatcttatattctttttatcttgtatatttgaagttcctactttcttcgttctacttgtttctttcagtaaaaatagaactctagtgcttggccttgaaaactgctgctagtgaaaagaatctcacagagataaggagggaaaattttgcttgctcttgacaaccgccaataaagcgtttcttacatactagcaatttctttgagttgccctaattcttccttgataagtgctcaagcctgtggtcatccaaaacctgttattttcttttatcttttctatagctgatcctacggaataaagcattgttttggtattaagaatatgtaggtgtcagattttattgaaatacatataaacttgcaaaagtttatctccgtcttatgtgttaaataaaaacataaagattaatttaggaaaacagaaaaatattaaagttcatatgcagttttgaaaactatttctttaccattcaaattaccaatatggcattatttatgattacgagagtattctatgttaaaatgtcagttaagtaaataattttattggttttctttataaagaagtactttttgtgataaaaatttctttaggtttaaacaggagaatctatttgtgtgagactattctcgcattggtatgaagaagtacccgagactggataatttataaagaaaagaggttacattggcccatggtcctgcaggctgtgtgggaagcatagcagcttctgcttttggggaggcttcaggaagcttccaatcctggcagaaggcaaaggggaagtaagcatcttacatggtaggaacaggaacacgagagatgggggggaaggtgccacctacttttaaataaccagatcttgtgagaactcactatcactatcacgggatggtactaaaccattttttgagaaattcactccatgatccaatcacctcccactgggccccacttccaacactgggaattacaattcaatgtgcgatctgggtggggacacacatccaaaccacatcactattgttatctgtaaaaatactacattacaaatcttgtaaatataacaaagggcaaattaaagtttgatgtgctatttgaagttgtttcctattacttctgagggacgatggtgttacaaattggcccctcttaatgttaacataaataaatactagctttcaaaactaattatttgttcacagtttcaactcagatgcagcctgattttcaattttaaatagtactttagtttatagtaccgtaatagaaattagcccaaataacggagtagcttgcaagaccccaaagacacatttacattctgacagaaatgtaagtattggtttaaaatgaatctttacatttgaaaaatctaagtttatttacctaaagctattaatttgaacatacgtagaggttcagtagaagaatatgtatggggaagggtttccttcaccctctgaaagttcactaaaaatcaacaaggcagattaattggagaaacacatacaaattcatttaatgtgtctacacaggagccttcagaatgaagactcgcacaggggaaactgtcattttatgcttagatttaacagtgtatggacagccaggtagaaatatggagggacacaaagggtgtgatctactgttaatagacggagcggggtcacccagcaaggcctgtctctctagactctttctggcctctctgagcagcgtccttccttctggggtgggacaagacctccctggaatggggattttatgtgctacggtcaaaaaatttctcaattttctggccagcttttacacaaaaaggcaaagggaaagttcgagtaatacttgtaggttttatggctggatttggggaaaggggatctggttggttaaaagaaaagcctttgccaaattaaattgaacagagtttaactaagcaaagaataattctcaaattgggcagcctcacaacccagagtagcttcagaggctccggcacaaccatgtggtggaagagggcttatgggcagaagacagaaagaggaagtgcaggaacagaaatattggagacagctccatgtttgctttatgtgaacacagtttgaacagttgtgcttcttggattggccaaaactcggcgattggcacaagagtagattacagtctgattacagtctgtttatacctcctttaggttatagttcactatgtgctacaaaacctttaggccgaacttaaaatatgtaaggaggcagctttaggctgaatttcattcaacaggtttgtaaaccaaaagtatctgagacatgtctcaatcaagttagaagtttattttgttaagtttaaggacaagggcccatgacacagcctcaggaggtcctgagaacatgtgccaaggtggttgggtgacagcttggctttatatgttttagagagacataagacatcaatgagtatatgtcaggtttacattcgtttggtcctgaatggcagaacaatgcaaagctgggggtggggcttataggtctaggtggactcacggatttcctgattggcaattggttgaaagggataagctctgcctgcaaagttggagtcagcttgagttaaggtaaagggggttatgaagccaaggctcttgtcatagagaggcagcctccaggtcgcaggcttcagagagaatagatgtgaggccgggtgcggtggctcacacctgtaatcccagcactttggtaggccaaggtgggtggaggtcaggagttggagagcagcctggccaacatggtgaaaccccatctctactaaaaatacaaaaattagccgggtgtggtggcaggcacctgtagtcccagctgctcaggtggttgagacaggagaatcacttgagcctgggaggcagaggttgcagtgagccaatatcatgccactgcactccagcctgggcaacagagcaagactacgtcttaaaaaaaaagaaaagaaagaaaatagatgtgaatgtctcttactcaaggtgtcagactctctgaagagacctactaaaggaaggaatagtgtctggcatattataagcactcaataaagatgtgctgtgaatatttatgagatcgtcaaagagttctcaaatcaatagtgagaatacagcttttcaaatcagcattatgatgtattatacatcaacattttacccttcctcaaacggtgctttacgtgtgggaaagaaatagctgtatttattcaatggtggattttcttcattgcattccattcagtgtctttcaatcgccagggaaacagcaggaattctcgcacaggacaatgcgtcacgacctgtggatccagcatgcattgttgcattttcccaaatgcacccagtgaaggagaatatgataatgtgaaaaacatttcacaccttgtaaacatctgaaagtggatttgacaggaaagcctgcatgttaaatcgaagatagtcttttgattccgtaaccattccgtgaaccattcgatgcagaaaaatccatgctggagaaggctccactatgcctaatgcaggatactgatggaagaatgaattattctaccgtatgttgtttaaaaggtattaaaattgtattaggaggagtggctctgtctatagccgtgggtcagtgctgacagaacttggtggccacagccagctaagacatgccaccatggggaagtaatttacgagctatggaacaagagctgaatttatttgttttctgaacctctttaaaaaatacatacagctttattgagatacaatttacttaccataaatctacttgtgggtgcaactcaatggatttttagcatacagagtgtgcaattaccaccatgatatgatatccgaacagtttcctcaccccggaaagaaatctcatgcccatcagcagttgctctgcaaacccagctcctcccatgttcttctccttcagctcccaaattagacaatcctgaatctgctttgtgtctctatggatgtgagtaatctgggcatttcaaatagagtcacatcatatgtggcctgtggtgactggcttcttttgcccggcataacattttcaaggtctatctatgttgtagcatgtaccggtagttcctcatttttatggcaaaatattccacatttagtgtgtctgtttcttagttgacagactttgggttgttttcactgtttattataaataattttgctacaaacacccatgtatgagtttctgtgtggacacgttttcatttctgttgggtatatatccaggagcaaaatacttggatcatatgggaactttatgtttaatcattaaagaaacctctagactatattccaatgtgactgtactgttttattaggttggtgcaaaagtagttgcggtttttgccatttagaagtactgacaaaaccgcaattacctttgcaccaacctaaaacatttgcaccagcagtgaacgagggtttcaatttctcctcattctctccagcacttgtgtttgttatctttttggtgacaccattctcgtggatgtgaagtggtatctttttgttagtttggtttgtagcacatgttgaaaaaacaattattttctcattgatgtgtctttgcctctttgtcaaagatcaattaaccataaatgttaggatatacttctagagtttccattctactctgctggtttgtccatccttatgccagaatcactctgcctggattaccatagcttgtagtgacttttgaaatgggtatgtgtgagttttccaatttcttccttgtttctcaggattgtttagctattctttcatttaatttatgtaactttagttttatttctagcaaagcaatacatagccatagtttaagaaattgaatacaaataattaaatgtgttttcatatttgtgacttttagatattatctattgccatccttctaaagaaacagcatttaaatttattatccatctaatcatacacacaaatacatcattttgctttttctcatgaaatatatattatatatacacaaacatacatagacatacatacacatatagtgtgtgtatataaatgtggatatatatatttagatatacatacacatcccagttatatatgcgatacacacacacacacacacacacacatacacgcataccagctatgtatagggagtatatatatcccaatgatttcttgtctaatcagtattgaaatatttacattctttgggctatttaaaaattacttgttactgaatcattttttgtacaatgtacataattttgttcttgtgtaacattttgtacttataggtgaatattgcatttttattcttaaatttcatatgcacatatcagaaatttttcctctgatatattactctaaaatatgtataatattttaaatatggcagaatatctaattatttataagattatttacttgttctttttaaattttctttgttatagagacctaatttccgagtcctccatctgtcacttgtaacttgaacagtgtctcactaatctttctctgtcaatcttgtcacatgatttaattctttttctcctaggctgtctcccctctttcgcaggccacaaaagattttctttatattttactttttatattttgggacacagtctctctgtgtcacccaggcaacttcaacctcctgcactcaagggatcctcctgcctcagtgtacaggcatgcaccaccacactcagctaatttttacctttgtgtgtgtgtgtgtggagacaggtctcactttgttgcccagggtgatctcaaactcctaggctcaagtcatactcccaccttggcctcccaaagtgctgggattacaggtgtaagtcacctctccagccttccaaaagacatttcttaattttacctctcatgttcgtaaggtgcactctttagtagctccctgagtaagagtgcactgaaggctaatacatatagcccttgtgttctgaaaaatgtcttcattcaactcccacatttgattggcagttgattgtgtataggatgatgaatcaaaaattattttgtcagaaatatgaaggcttcacatcatgttctagcttcttttttttttttgagacggagtctcgctctgtcgcccaggctggactgcaggggcgcgatctcggctcactgcaagctccgcctcccgggttcccgccattctcccgcctcagcctcccgagtagctgggactacaggcgcccgccactacgcccggctaattttttgtatttttagtagagatgaggtttcaccgtgttagccaggatggtctcgatctcctgaccttgtgatccgcccacctcggcctcccaaagtgctgggattacaggcgtgagccaccgcgcccggccatgttctagcttcttgatatcagcttctccgcatgtggtattaggttccattctgtcattctcactcctgatttgctatgtgtaactttttttcttcctgaagatttttcccagtcttagtgattccatgctttggcgttgccattttttaatttactatgacaggccctcagtggagtttccacttggaaagtcatgtctgagtatgttctgaaattttttctttgtttcttgaatatttttgccttttcctcctcttttttgagaaaatttgttttaggaatattgatgctttagatggatcttcccatttacttacttcttcatccacttttacagtttgttttctttctcttccactccactgagattttctcaatttaaacatctaaatctcctactgatttttctgctaccattgtgtgtgtgtgcataactaattatatgatcttttgaatttttaaaaaatataacatcttgttttaatgtcatggtacaatattttctttcttccaatatttccgagtgcatcagttacttatttctaggctactttcttttctggaaatatcacagtttccactaagtactttttgtttgttaatttattggggtttggcctctgtttttcttatttgaaactctcctcaaaatccggtacgtcttgtccctcagtttatatttcagaatgagatagtgacatggagaggtggaggcagtgagccaagattgcatcactgcattccagcttggaagacagagtgagaccttgtctcaaaataaaataaaataaaatttttaaacttccgggcctaaggaagaatgatgggcttatgaataatgggcttctctatagatagcgtgggtaaaatttagactttttcttttggataatcacatctagcagcatctctctggactgtcttttatcctagttaacttaccagagaaatcctttaccttcaggatgggcctatcagtctggcttctgatactcactgaccacaggaataatttaactaaatcttccagaaatcaaaattttatctgatgtaaactgttcagaaaaatcttcaacctttggagccagtgattaactgctagttttctgggttggagggtagagatcaagaggtctgacttctttcaaaatctttggatgtgttcaacttttcccactcccaagcactctgtgtctaacgcaggcttcctccgttttctgagacctgcttggaatctgccatggacattgaccagtgtcctggtttccgtctccccttacccttctcccactggtaggatgttagcctttaactttttcccacctgcaggttgcttgctatttctaaccactgtccttttcatttttgcatcctctcttttcattttttctgtctttgtaaggctgttttttcacatctttgctataatttcagtgaggtttctttggtggctccaaagtgatatgtgagaccaatctagtacatttaccacaaattcctcattttagtaatttttgtatttttagtagagaaggggtttcaccatgttggccaggctggttgcaaacttctgacctcgtgatctgcccacctctgtctcccaaagtgctgagattacagcgtgagccaccgcacccggccaagaaccaataatttttaatgtagttcagtgaatgataagcctaaagtttattagatcatacttcaataattgaagcagttggtaggtgcaggaacacgcagacctatcaaaacaatagaatttaaaatagagccacagatacagtatccattagaatttggtttgtaaaggtgtgtgaggatttcctgaagctgctgaaactcctgttcagtggtaggagttcagaagccaaatagatgatctatttatcagatgagcatagaaacagaattccaattgggaggccaaggtgggtggatcatgaagtcaggagatcgagaccatcctggctaacacggtgaaaccccatctctactgaaaatacaaaaaattacccgggcgtggtggcgggcgcctgtagtcccagctacttgggaggctgaggcaggagaaaggccagaacccgggaggcggagcttgcagtgagccgagatcgcgccaccgcactccagcctgggcgacagagtgagactccctctcaaaaaaaaaaaaaaaaagaaaagaaagaattcctagaaaatggcttctagtctttctattgatacttcaggtgagggaccctgtataactccttagttctgccaggggttattgaaaaataaaaatattcttttaaagtctttttcactttttttaatattgaccaaataaaatcatctatgtaaaagccttttacaatttattgaataatatatggatgcaatattgtttagactggaaaaaattattttttatataaacagaggaaaactgggggttacatataaagttataattgttggtagaataaatcactgggatttagaaggtaaaagtcattaggtctttgcaggttcccacttctgtgtataaataaatgattttcaataaaatgcaagttattattatacatgattgagaagaagaaagggaagagggtcaaagtttatgttttgtccatttaaagatggagacttttttgtaacatcaaggaaaaatcaaggtaagaaactggatatgcgactgtggagctcatggataggattcagttttcaggtgcacattttgggattcataaatatagaagtcatattagaagggatgaggttggaagagatcatccaggaagtaacaatgcaggaaggaagatgtcggaggacacaaatagtacatttaggagttaggggaaaaagataaacaagcaagtaagatgagaacgctaggtagccaataaggtaagaggaaaaccacggggtcgtggattccagaaaggcaagtttgaaaatgatttaatagaagagatcaattaactgcatcagatgctgctgatatgaaagagtaatttgtaatttgagggctgagaattgatcactgattttagccacatgaaggtcactggtgcccctgccgatggtttcagtggagtggaaagcatatccagctgattgcagtgtcctcaaagagaacaggaggaaagaagctggagacagagagtatggcttgaagagggaacagccaagtggaaagtggaaagtagacaaatggagaagctggagacagagagtatggcttgaagagggaacagccaagtggaaagtggaaagtagacaaatggagacatggccaaaaaaaaaggcacaatgtttgttttcataatagaaattttcaggtattgtatgctgatgagaataatccaggaaagagggaaaatattaaatttcaggagaaggagcgattgctggagcaattgagcattgatggtctcatagataactgagaaggttgactcagtatgatagagtcatgctgaacactctgggttccaaactctagcatgcagatgttttattctaaccagtaactaaactggctcatagaaggaaggaataataagcttttggtaaattataaattattgtttctctaactttatttggtttaaattaaactgttagcaggtacacagactgctctgttatctcaatggtctacgaagtttatcagtaggcattaaaaaacagcctgtcacattttatttatctgttggaagtatctcagttgccaggcgataacgctgagaatttgattaggtgactcaatttccttttaagatgactcacctaatataggaatacagaaaattccaatttcttggcaaacagtctctgaaatctcaatttgatcaactctatgagattgataaatcttaccaattaaagtattcataagtgtaacttcacagttaatatttattcatttcacacaggatttccaagtcagaaattatttatatttgagttattaaatccataaaattgaaagaattctgcttttgagataatgctttgtaagataaatacaaagttcttttgagtataattttcagttctcaaaacattttatgaaaataaaaatgaagaattgttagagtgacatcatataaaaaattatttagatggaagaaaaccatttatcaattaatagtacttgccttctgcctccaaattgttcagtgctgcatttattattttaaaacaagaaaaaaaggcattctcccttttccagttactattgctataaaccaaattacctgcaagacttagtagcttaaggacgggcacggtggctcacgcctgtaatcctagcacttttgggaggccgaggcaggcagatcacgagatcaggagtttgagaccaacctgtccaacatagtgaaaccccgtctctactaaaaaaacaaaaatttagctgggcatggtggcaggcacctgtaatcccacctactcgggaggctgaagcaggagaatggcttgaacctgggaggtggaggttgcagtgagccaagatcgcacctttgcactccagcctgggtgacagagagagactctgtgtcacaaaaaaaaaaaaaaaaagaagaagacttaggtagcttcaagcaatatgcatgtttgtaatatcacatggattgtgtgctgcagggactggggtgagtcttctgcttatgcctcaactgggccattcagccgtacttagctggtgggtgggatgaactggaaggcccacagtcgctccactcacatgtcagacaccttggtagggatggccaagatgtttggcttcgaggggggttctccaccagaccacccaaaacttgtcaatcccagagtagctggacttgttccatgatccttgactcccctcatagtgagtgtgccaagagaactagaaggaagttacatggccctttaaacaccctcagggaacttatgtgacttctgcggcattttatttgttgaagcaagcaccagcccacttagattcaaggatggggggtggacctccagctctcaagggagagagtttcaaaaggttgtggatttttgttgttgtttaaaccaccacacgccatcctcaaagattatcagataaattagttaaatactcaatgttaaagctagctacaatttcaagcaatttttatagaaagaagggatgcaaataaatataattagtaacaaatatctaaagttagcttctacctgctggaagaaatctgagaataattttgtcaaatatggtatttctttctttgacaggaatacttggctcattcccaggacctacaaaagatatttgatagtgtttctaatgattactctgtggaaaagacatgagatcaattctaataaaattaggtaggttagtaaaaagtttcacaagacttgccgtcaattcagaaggagttctaactgcatacaaacttggaatgaattctaaagatgttgaatgatagaatccgaattcaagatatatttgattaaatagagcataattttctctgcaaatcctgtccagctggacacactgtgaatacaaatttccatgttcaatacatatagaaatatcactctcagcttttgaagagttaacaggtaaaaaatctgttacatttaaagtaaaaaatagttttacactttatatttttctgaccatgaggctaaattttggttcctcttttgtgaaattattcccttcctagagaataagcatgcaagataggctttgtaaacctgaaaactgaatggaacttaaaaagatggaatatgacatagtttggatagctgtctttacctaaatctcatgttgaactgtaatcttcgatgctggagacagggtctgatgggaggtgtttgtgccatgggtgcggattcctcatggcttcgtgctgtctttgcgatagtgcgtgagttctcatgagatcccgtcttttaaatatgtgtggcacttaccccaccactcacttgctcctttgcttctgcttttgccatgtgatgtgcctgctccctcttcaccttctgccacaattgtaagcttcccgaggcctccccagaaaccaagcaagtgccagaaccatgcttcctgtaaagcctacagagctgcaagtcaattaaacatctttttaaaaaaatacattatccagtgttgggtatttctttatagcaatgcaagaatgaccttatccagaatatcatgatcataacaacaaatttaggaaatgtatatagcttagcagaagtgaaaaaagataaacaactgaattggtagtaaattcaacacgagtaccaggtagtgaaatagctgtcaaaacacctggcatttgttgcacttcattataactataaatccattagaagacagttgagatcaatgctctacaatacattaatggaaaattcctagagtagctttgttctggtttcttcattataaaaatgatattggcaaagaggcttaagtttatagaaaatcaaatggctgatgaggacatttaatccacaccatttcagaaacttgataaatatggaaaaagatcctcagaagggacttgatttccagtgacaggaagtttttagctatcaattgaatgacagctatgtctttggccccaaaccatggacccacgtatatcagaggcatttataagatcacataaagatgctggctttacatttacagaagttggccgtactgttcctccactttatcacttttgacctgttttttaattctatgcctttttgatttcagtataaccaagcgttacctcttggctcgcttcgttttgcttaagccatattcacattatttttctcttagtttgacctttagtacatcacagaatgactttctgatttgcctttaggtcctttgcaccgctgctactgtaggaggcactcccatctccatctctttctcctagcctgctagaaacaagagctctctccacttagcattttcactggaatggggtttattgtggtttaagaatctgataggggtttgaaaaggttgttcttgaatgtctttatcattttacattaaaagtgacttcgacagattgaatgttacataggcaccactatcttctctacatcttcctcctgtgagacagatctgtcttcctaatacatcaaaggtgctgccagttgacaacgatcttgaaaccgtctatatctggctaggtgttttccaacacggaaaagtgtgatcattggcaatgaacagggaaataagacaattctaagtcatattgctacattgacagaatgattgatcactgttgctggaaagaatcatgtttcagtgaagcccaccaacagcttctggtgccaagcagatgactggatgtagatttggttatataacagcccattcaggtaagaagcaatggctatccatgatagtgaatgatatgtaatgtgcccagttccaggtggagagcaagggagagaacaaaagcatctccccagaagaggtaatttctatgattttgacaaagatacagaaaacttcagaagcctatcatagttgttgtcacagaatcaccgacgttagtaactttccagtgttatgaagacacttgcttaattgctgcatttattgtgactaaaatccccaatcagccaactgtcactgttattgatcataatttggacaaaatattgaggcccaaaagtgtgttgatttttaaaaagtgtgttggcgttggtttgtgaccttaaacgtggcaccttgatatgttcacccttactattgaggacaaaatatttaaaaccaagtctataactaggtacacccgcttgggtggacaatccaatgcttaaccatttcatcaccaagatgaaatacaatcccaaaacgacaaaactgagacaaaatgctgcttcttgactctgcatagttcacaaacatgttaaagtactctatcaacattcagaccaatattgagaaacatttcttctataaagaagtctacattttgaaggattgaaaactgatgtaaagacaagcaccccaaaccccataaagaaagctttatacctggcaagtcatagagtcaaggcagtatgtgtattcccaagttccagaaatctttgcaagattcgtgcaatagtaagtaattaaaccagagtatgagccacaatacatctgtttttgatggagcagttgaacaggaaatctagttgtcagtgcagacagttgagatcagtgctctacaatacattaatggaaaattcctagagtagcttcgttctggtttcctcattaaaaaaatgatattggcaaagaggcttatgtttatagtttttcattataagtgaaaaaatgttaggcttttctgtatctggacatcactcatgtttcccttggtattaaaatggataatgaagacataattgttgtgatcaaacataatgccccatttccaccaaggagacacagaccttacattctgacaactgtttgaatttacaaagatgaggaagcaatggtgaagggaaaatcttagttggagagtctgacatttgaggcatttctcatgagtatcatagcattcttcagattgaaatcacctctgatgctaatgcctgtggcatccgtaaggtgtctgtggtgaaccaaagcataggaaatgaagcaagaattataatcaccattgacgatggctgagtaaggaacacactgagcagttagttgaggagacagaagtacagccactaaggatgaaaggcacggagactgagatgccttccaagaccttaattgaatcttacacattcagtatgaacaccacaggagacagtcaaaaaccccaagggaagatcaatgataagaataagtgaaagatgtttgacaagtgcattaaattatcaactggctggacaaaattcagacttcagggaggatgaatttgaacattggaagaatgacccagtaaagatcctcaaatcattaattatcagcagtttccaattcaggggatacgtcaggcaggacatctagcagcttctcaggggacagagctccttctagaaacacttctctgcatccaccatggataacggccaatcttccagttagtaaaaatattttaaggaaacaattttttgcaaattcattcatgtcaattgaaccacatgtaatacattcaccatgtcttaaagctattgggcattttcaatacttcatatacatagaaaatgctagtcacattgtgctttttcagtatttatgtaaacaaacatgcagaaaatttaacagtgctggggaagtggaaattagggaaaagaaggtggatttatccctgcccttttaaagtaacagatatttctaaaagtgttggaagaataaatgttttctaacagcactcctgcaacataatttaaaaacataaattactgagattatgacctgagttaaaccaatctataaatctgtctagaaactatcatgataagtggatataaaatgtattcttttaaggtattaatacagaaacatacataatttatgtaataattactgatggccatcaggtaatgtgctatatgtgtatcacttaatttgatcttaataacagccctaagaatggcctagaagtgttactaccattttttttttttccttttttttttttttttttgagacgaagtcttgctctgtcgcccaggctggagtgcagtggtgcgatctcggctcactgcaacctccacctcctgagttcaagagattctcctgcctcagcctctcgagtagctgggattacaggcacctgccaccacatctggctaattgtttcagatttttagtagagacggggtttcaccgtgttagccaggatggtcttgatctcttgactcgtgatccacccgcctcaccctcccagaggctgggattacaggcgtgagccaccgtgcccggcctaatttttgtatttttagtagaggcgggatttcaccatgttggccaggctggtcttgaactcctgacatcagagttaccaccatgttatagatgaacatactgaggcccagagaggacagggttcttgatgaaagttacccactcgagaagtgctaacctagaatagaaaatcagccaacttgattctagagttcaagtcttttgtgggttttttttttgataggagcggaggttccagtgaaaactgggaaacttgctagacaaattttaagagagctgtagcactctaaagttcgtgttcctaaccgatttttccatttctctttatatcataatgtatgtgaacagttttctgtcttcatctgttattgaataatagttgttacctattgagcattgtatttacataacatcgttttccattgctattaaaattacttaccaatctttagacgattcatctacagtaatactactgactacaattcaattgaactgtcaaaaaatcataatttcccccaaattactgaaaatacaatgttgtattttacactaaaattcttttgaaaaagtgaatgatgttaagttcatatgttcactaatatgacacagtctctttaattttccaagataggcttgaggaacaaacaaggtggaaattccctttcttttctttccttttttttttttggtgtggcacagtatcacaaggtcaggaaagccaccaacctaaatcgcatgtttagaaacgctgaaatggaagctctgagttccctggaggggtcactagccaccagaaaggctgtcttttgagtgaaatttgtgactgagatctggacaatctatgtccattaaagaccccccccacaacccacacagcttctgatcaatgttgtcgccagtgttgtcacatatttaaatggtactgtaagccctgcaatgaggattgtatcatttatctcacattaaggttaagaagctaaattaaaaatctgccaagaaatgtgacattcatgcccaatgctttactttcagttgtctttccttcctatattacttgatgtgaagttaaagtgggaagatatttgcaataaacggtgcataatattctcaaaaagtcaaagtgttatttcataaattgggactatttaatggtaaagtgtgagaaactaaaaattctcagataaaattattcactccaaatatcagtcactaacaagatggaaatactctattaaagatgatagttgtcgctggaactgtaggaaatcaaatgtatatgcaatttaaatgtaaatagggcacatactttggtcctgtccatgaatacagaccttataaaaaaaacttgtcactcagtttaaagaaaacatgctagatttggcaatgctgaaaacatccaacaactggactttgggctttctacagtccattaattttgaatgcccgcagcacaggaaactgagtagtaacatcagtgttaaagctatagagagttttaacagtgacaaaattcactgcttcaagtttaaaggcttgcttttgtgggtgtggcaattaatttatttgaaattataacagaatttatgatatgtcctctcaggaataagaaattgggaataatcataataatattctggggcagaggacctctgttgagtatcgaagaatgtgactgccattttgaagaatggtctgctttaaggggttattctgtttactcctaacaatttggtaatcacatatatattgtaatatcatctgaatttggaaaaaaatcttatttatcatgtcttgtttctttctatattgcttctcctttttacatttttattaactcatttttttccagatgatttgaattttactgagaattaagaaatgtgcatttaaaaatcacctgggcagttacaattatggtgatatataaaataatttcaatcacaataggtgtcataattgtattatcattagttctccaagaaaaaacttgttcctcccttgaatataaaccattgatattaggattatgtgtttttaatggaaaataaagtcttgtaagcttagcctttctttttcttaaaggctaatttatgttccaccacaaatgttctgatcaatcatactgcacttgtgggcaatgaaagaatgtagatgagaacggctcttggtaaagtgaaatcattcttttactttttactcataataatttgtttcataagtttgtaagacagcattttgggtcccagtcacctgccatgaaacttaaaatgttggtcaaaattacaatgaggaccaaattgtgagtatggagaattttaaatggaattaaaaatataataataccactacttgaaggggatgtattgatgcattgtgctatctttcatattttaaaatcacagagaaatatatataataatatgtgctattcttgaataatgttaatattacaatttaagtaaaaaatcaatgggatgtgttcagtatgacatttatatttatgagatatatttataatagtttaataataatgtatgatttttatatttacaataatattaacaaaaagcctttgcttaaaaggaatttgttctgatacccttgaaaataccacttttgacaaaaaaaagtaaaatccaatagcaatacaataaaatggcatattgatatttaatggtgttattttaatttgtaagattatgctaaaatgaacaaatatgaataaataaaaatgaacattctatttccaaattttgctactgttttagtattaccaattcatatccattttagaaaagaggtaatataaaatttataatttaaaaaattgtttcttattgaggtaaaatttacatatctcatctgcacagatctagagtgttgattttggtacattttgataaatatataaactcatgtaattagcatctcaatcaagatctagggtgttttcaaggtcctagaaagcgtcttcgtgcctctgctggtcagctcccatggcccaaaggcaaccgcagcttatttctatcatgatgcatttgtttcgcttattcttaccttctttccattagcatcaccaacttaagacaatgctttgaaagtcattcctgttggtgcatttatcaggattcctgcgtagtgttccactgtctgaaatgctattatttctagatactgtcctatttagatattttgggtcaacccaattttttaaaaagtttataaatatagctgttatgaacagtctcaaacaagtcttttggtggtactgttagtaaagacagagtttcaccgtgtcggccaggctggtctcaatctcctgacctcatgatgcacctgtctcagcctcccaaagtgctgggattacaggtgtgagccaccgcacctggccttgttttatttttgttttgttttcttttgtttttgttgttgttttttaagattagtacctagaaatggaatttcaaggtcataaggtcaatatatgtttaactttagaagcaactgccagttttctacagtcattatgctaaactgcaattccaccagcaggggcagagagttccttttgctctgtattcacaaaacctttttggattttagacttttttcatccatactagtgagtgtgaaatagtgtgtctacaggttacttttttgattggaaattattagagcagctttctgagttaacatggcttaacataatggccagctggtagcatgttatcaacctgtattatatcccatttgtttataaatttatacatgtacttcagaatatgtaataaatgctttataaatatttcaaatgcaaaacaatttaaaaatatacgtgaagaataaatttcaagaagacatttcagaacacacacacaaaaggtaataaaataaaaatgaaatagaaacaatcataacctgattttaaggatgtttcaatgaagtgtccttgatagccctgaattgtagaataattctgaattaaggccaagcacggtggctcacgcctataaccccagcactttgggaggccaaggtaggcagatcacttgaggtcgggagttcaagatcaacctggccaatatggtgaaactctgaatctactaaaaatacaaaaattagccgggtgtggtgacatgtacctgtagtccaggcaggagaattgcttgaacccaggaggcagaggttgcagtgagcagagattgtgccaccgcactccagtctgagcaacagagcatgattccgtctcaataaataaataaataaataaataaataaatattctgaattaaacacaattttccacctgaaatagagaattcaaaatcagcctatatctgacaattctgcattcatagcaggacatccttagtcctgcagaattaacctggacaaatcctggtggacaccaaaaatgaagcatagacagatgtagtgctctaaacttgaggttgtgataggaggtactatgtctagcaggacttatgtgaaccatgtgtgcagcacaggacacaggctaatgccaattctgagtaactcactccttttccaggaatgagtgcagaggaaaataaacggacttgtcagactttgccatctattatggaaaaacaagagtagtattgttaccgaaacacgagggattcagtctagggcctgctgcttgcttcacagaaagccagtgactgaggtaatgagtactggcaaggaagaaggctttaatcgggcgctgcagccgagaaggtgggagctcagcctcaaatccatctccaagaccaagtaaaactgcaggcttatatagcagggaagatgtgtaagaaatgtataagaaaacagcaactggggaggggcaaggaagccattatgaggaatgagaggcctggcatctcatcgtctggatgtagtgatctggtgagtttcagttctttgatattttttgagaagcctgaagctggttgcctgaggaaggaactcagataaaacaaatataagtttcgagctttaagaccagagggtcaatttctatgtttatccagaagaacttatctatgggactactgagttggtttcagtattatctttaagatttagaaaaatgactatatctagaatatatttactaggagaagaagtaaaagaagaagaggaagtgggggtaaaggaggacaaggaaagaatgagaaggggagaacaggaagagggggaagggagaagggagaaggagggggaggggaggggaaggaagaaggagaaaggttcagaaattacctgctgtgaattccacaagctataaaaagaaacatcaagagaaacataagaacatctgagatataacagtgattgtttgacttgccagttaaaaatagaaggcaccacaggggagaaaaaaaaaggaaagttaaaaataataaaagaactattgcacatagcgaaataacagaactgattatgaaaacatttagtggcttaccaattcactcagggtaaatgtcaagatatgtgctatgccttttttttcagagtatttgtactattttattttatttattttatttttttattatacttaagttctagggtacatgcgcacaacatgcaagtttgacacataggtatacatgtgccatattggtttgctgtacccatcaactcatcatttacattagttatttctcctaatgctctccctcccctagccctccaccctctaacaggccccagtgtgtgatgttcctctccctgtgtccatgtgttttcattgttcagttcccacctatgagtgagaacatgcagtgtttggttttctgtctttgtgatagtttgctgagaatgatggtttccagcttcatccatgtccctgcaaaggacatgagctcatccttttttatggctgcatagtattccatgctgtatatgtgccacattttctttatccagtctatcattgatggacatttgggttagttccaagtctttgctattgtgaatagtgctgcaataaatatacgtgtatatgcactatgtctttaatgaagattttctcccttattacctctctgatctcataatctattttttacagtttgctaagtagctcttgcctcagggcctttgcacatgcccttcactctgcctcaactgctgtttttgccaaaatatctggctgctgctttccttgcactttccaatctttactcagaagcttttcttaatgaagtgcttctttgtcatcttttctaaaagtaacaggcatcctgtactcacaccagcactttaaatccccttcttatatttttctttcagtggttgctaatatacattaccttttatatatatttatattttttattgtctgactcacctactgggccacaatctcgatgacagtgatctttatcttcagtctctggaggaatacctggcacacataggtcctcattaaataattattaatgaataagtcaatgataatataaggtacctcaacataaataccaagaactagggtcaattaattcactcagtgtagggtttctaaattcaaattttccctttaaccaacattcctttttgttgaaacacatcttattttttaaaggattactgagctatgtttcttatccaagatagtgccatccagctggcatccagctgctcttgttagaagtggtttggtagtaattctaagcaacaaaattcctgggctctgattaccttcccctcacttttaaaacagttccagaatcattgagagatctgtgcacactcaaaaagctttgaggatccaaattcaaaccaggttctatgtctaccattaaaagccctaagaatatgtcctaattttctaatgacattttatattttaagacatcaaaagcttggatttatgggccgtatactaacaatgtttagtagccaactataaagcagttaactacatttggaatgcatcttttcttctcttttttattttcctccctcaaaacaactctgtcagcttcctttataaaacagtgtcataatgcataaaaatctagtgtttggcctagagttgcatgtccacattccaggggaaagaaagtcaaagaaaaagactgcctatcagccacgattactatttataaaaaccattgttctctttcagataacagaaatgtataagtaggtaaaaaatttcttaaaccaaagtgtttacaaaataataaaaataggtattatagttcaaaaatttcatttaaatatccagttatctaattatatgaatttttcacaagtcactttaagagcatcatttgagtaactagcctccactgttttattccttagaataaggttaattgcttctcagagaacataatcttataataataaattgcaactcaccatagtgtttcttctttctcgctcaccctctcacacacacagactcacaaatgcaagaatgagacactagaataagttctatagtgttttcttagtgtaagcctcaaaacttactgttaagcaaacataaaactatggtatgtgtccttctgtattatatctcctaggaattatctagtgcaaaattgttgctcctggtatctaagtatcaattagaacagaatcattttcaagtaccataaagacctcacataacatagcttaaacaatacagagaatgtgttgcctcaggaaacaagacaacactagaggtagcaggcagctttgtgtatggatcaacttggtctccagcagctgagtttctctgctattttcttgtctgatgcactttgttccaacggcgtcttttcaggatgctttccctagtggtgataaaaggctgcaggggtttcaagccttatcccctatattagtccatttttacactgctataaaagtactccctgaggctgagtaatttataaacaaaaaggtttaattaactcacagttctgcacggctggggaggcctcagggaagttacagtcatcatggaaggtgaaggcgaaggggaagcaaggcatgtcttcacaaggcagcaggggagagagagagaaagacagagcgaggggggagctgacaaacacttttaaaccatcagatctcatgacaactcactcactatcatgagaacaacatggggaaactgcccccatgatccaatcacctcccaccaggtctctacctccacatgtggggattttaacttgagatgggatttggttgaggacacagagccaaaccataccacccttgcacaccgcagagtttagaacagaaagtttcctttcccttaaccatcaaagaaaaatcctctgtcttactctgattggaccatctggttcacatgcccattctggaatcagttattgatcaacagatcaggctattaggggcccaaatgactgttactaaaagggaaggggtgcaagaaatgcgagtttcttaatgactgtcagtcataaataaagcagatggagggtaactcaaagaaatatagcacaagtccctatctccaaaagacctaaaatctcgtgtggtttcaactgcaaatgaaaatacaaaaattagagcaggtaaaattgtaaacatttgggcattgtcataatgtaatgagagttcaaaggagagagagttcagggtggacttaggtcatagtatgcttttcatttatttatttgtttgttttgagacagggtctcactcacttgcgcagccatggagtgcggtggcacagccatggctcactgcagccttgaactcctcacctcaagagatcatcttgcctcagcctcctgagtagccaggaccacgggcacatcccaccccacctggttaattgtaaaataagtttttgtggagaaggaattgcctatgttgcccaagcaggtctcaaattcctggcttcaagtgattatcctgcctctgccttctaaagcactggaatcactggcatggtcacactttttaagaaataaacatgattcatatgaaagtagggagttttcagcagatggaagcaccattcttgacaacaacatagagatgggaattaggaaaggaatggatgagaaaaggtgaaggcgagaaccactaggatagcagatcaaggtggatgagcaacagggaggagcctgggcagattaaacaggtccagataattgagcatattgaaagacccgcaaagatgtatacttggtgtaagaaatagtatcattgccaaattgtcaatcaaataatgctatctctgttgctcttactttatggaagaataataatttgggaatatgcatattttgaacaattgattttttaaacagtgtgtgtgtgagtgtgtgtgtgtgtatatatatatgtatatacacacacttgtattcattccaaaacactgagaaagcagtatattaaattcattttacacaacttaagagcgtttattgatccagatagaaaatttctaagctacatgctgagcatgatgactaagtatctaagccaaattgtgaattactttttccatgaaaatcaaatacatatatttatatgctgtgttttcttctaaaatgcttataaaacagctgctataatcatagaacatagagtctttgccacgacacattataataaaagagttgtatttcaatttagcaagctacctaaaaaacagtattttccaagagtgaccaaggcccattccagaccctctatcatatatgctgaaattgggttataaaaatggcttacacagacttcaagaaaatgtttgttttttcaaaacaaaacctgtctagagtattggagttcatagaatcaacagtttaaaacagaacttataaaatatatagttctacacccttattaagattaaaaaattgagttgcagaacagatgtgcttgttaaaaatagatcagttaaatactcagaacttattctcaagttttaaactcagaaactctttgctgtttccatgctaccattctgtgcattggataacaaatgttgatttaagtgaatttcagtgacataataattcacaccatctactccaacttttattgacaagaaagttgtttttgacttaaacattttgtacataattccataaagctacagaacatatgaattgtgtctagaagttaaaacacttagcaagagggctgaaattcagcatccaagactggaatagctcattaggagaccacacaccgtgaggatcattgatgtttcttcctcaaacaccaggacacaagcctgtggtatttctaaaagttgctagggaaaatactacatccaaattcagctatccttggcacaggtagttccacaaatagtgacagtcatttattaacaataaacaaagcagtgaaaagacaaaatgtctttccacaagcaccagattttaatctgaaaaaacaccccagaatcaatagttaaattgctatacaagagaaatgacctataaaggctttaatttctttttatttttgtattactttagaaatatgctatgcacatgggataagaactgcttttgacatagacagggaatcagacacaaagtcttttcagaaacactctctactagaatacagattggagaaaaatacatatgcacccatgcagagagatgaatttgagcataatataattcatttttataatggcttatttgtaattaattggtttatgttccagtttattataacaatcctgaaagataaactaagaatatacaattgttcattgcagagatggaagaatctgagtcttaaagtgactaattcatgacactattgctagaaaataaagaacacaggaatagaatacaactcttttagcttaagacttatttccacaatagtgcattccttctaacaacagccagtgctcacttagataattttgaagctacagttagagaaaaatattggagttctctgtatgatgttttaatttcactggctactgcatttgtgtaattatacatttaagagaaattaaaaattgaaaaacaaatgtaaaagtaagaaacaaattgaatgatatgagttaacaaataatatgtgtaaaattaatgcttaagaaccattttccaagtgatggtttatgttttgccttctaaaatctgttctaagttcattccaacttattttccattttggttcacaatttttcagagagaactattaaaagaaaacgctactataaaagacaaggccattttttcctctcattaataatttcaaatgttcctcatgtgaaattttttgtctggtctaaaaaagaaaagataaaaaaatcttgcctagtcaagaacagaaagtgtaaaaaaaactctaaatatattgtacttctgtatatataaccaatttaacttgaggtattttaaaataggaatttatttaattttagtgacctaaaccacattatttagagtgttgtgtaaatattaaggcatttctgaaatgagtacatttaagtctggatttttgctttatattgtttctaagacatcaaagtttaggtatgtggatagtggtggttagacatactttgtatttacagctagtcttaacagagtacaaatagattaaatagtttaagatacaaaaacatgtctagaatcagttcaacagaatctccctataaacctataaatcataaaaagttctaaatgttattacgtatgtgtaaatgtatatagaattcttccctaatattgattctagttaactgaatcttctttttaaaggtataaactatataactagcttggaaagccattaaaaacaaagtatttaatagagattttacttaatataaatattagtgaaattttatgtatcaaaaagaaatattggccagaactctggcttaattccattttcacgttatatacttaaataaaagaatatcggcaaaaagtaattagaagaaacacaatagttgtgttttaaaattttaacactatttattttcacctaaatatatgaagtgcttttgtaagttgaactgctatagataactcattaactagtgaccatttaaaattaactcagataaaaataaaactcacattttcatttagaaggtctgaaaatcaaatctgaaaaatctggagtccagtgactcagcaaatattttggttgaaagcacatttatcttcaagacaaaattacacatagtaaatttggatctgttaaagtaattcccctttacttgcaagtaagacaaacatttgtaagtaaaaaatacgtctggcttaacaaggttaagaaattaaaatgtcttattgcaaagattccattgaaggggaactgattggtttcctgatactactattggtgagcaagaattaaaatgtttaagtggcttttctgttctttaaaaccctctaggtttcctttagaacaggaaacatagggaatctgagagtatgacagtatcttgaaggtcaatgagtataacttcctccataaaatgggaagtcctacagtctactagacaatgatcagttttcttttgttatatttgacaatggtataattttctccctgagctgctcattctgcatatccctgtcctcatttttttcagaggtttggagatcttagttaccatttgtccaggtaatctctacctaattacccataatgtttccaaaacacaaggagctcaatctaggtcctgttgctcgccgcacagaaagacaatgactgagatgatgagcattgccaaggaagaagctttaatcctgtgctgcagccgagaagatgggagctcaggtctcaaatccatctccctgattcactaaaactaggagtttacatagcagggaagaaatgtaacaatgtataaggaaacaggaaataggaaggggcaaggaagccatcatgatgaaagaggggtccagcatctcattgtctggatgtggtgatctgttgagtttcagttctttgaaacctttttgaggggactgaaagccatttcctgaggaaggaactcagataaaagaagtataaggttcaagctttgagataaggagggtcaatttctatgtttatctaaaaaactgtccatgagactatgagttggatttaataacagcacagaaaactgaattcagtatttccaatgtgttcgcattgtgtgcaggacagtattaccaccctaaatataatttcgtttttttgtggcatagaatcataattgtgtttttaaaatagatatgcttttggcatcacaatgagcttatcttttattaacctcccccatcctatacctgcctagttaaatttaaataaaaatacagggttatcaacttattctaattaaagttcttcttgtttgtatatcaaatacaaattttataactatgctgtctttttctcatccaagttataacagtcaagaccgaaaagggtacaaacctgaaggttctgctccagattgacatttatcccacattcagtgtgtatctttgatcattctttaattcattccataaatatttattttggatgtactctctgtgaaaaactttcatagttgttttttgcatcaatgtgaaaaacagactaataacttgagaagtttatggtctagcaacgttagcacataaatgcctcctcaacttcaacgtacattatttctagagaatgcactgtatttgtcaatacaatagatacaatctcttgtattccagattgctaatgccgctaaaggaggaggaggctggttcaatacgatacattcccactcatggtcaggtcatgctcatttccgtcttcactttctcaagttctccgcttgataacattttctaatatttttaaataaaaagcaatataaatgttatgttgacatgttcttggtttgagtattggggcatgtcttgtaacctcccacatatatcgaccaccatcattctttctttgtgagactgctaactgaaagttactaattgtgcagctggatgctgccgtatcagcgtaactcagcctgcgacttccgttgagaactccaatgcgtgctagttggttcatgcattctctacagttgtggtttcagaagttctcttttcacttttaacctcacatacccaacacctttgtctctcccagctctttcatggggatagtggaagccataaactattaagttttttttatttattttattttattattattattttttttttgagatggagttttgctcttgttgtctagattggagtgcaatggtgcgatcttggctcactgtaacctccacctcccgggttcaagctattcttctgcctcagcctcccaagtagctgggattacaggcagccgccaccacacctggctaattttgtatttttagtagagacagagtttctccatgttggtcaggctcatctcgaactgccgacctcaggtgatccacctgcctcagcctcccaaagtgctgggattacaggcatgagccacggggcctggccaaactaagaaatatttataaccaactctataaaccttcttaaatccacgctcattgcatcttccgttctctcctgttacaatggaagaggggtgctctcctctattttaggcccatttcctaaaccagttcctgattctttctttcctccctggtgacattgtactgctgtactctcttgtcagtcctatattttccatctttctctgcacatgaattcttttcttaaacaagctcgagttgctctgtgtaaatttttcttttgtgaaatagcttctatcctacctgtcccctcattctcacaccgaactgtcttttactctctcttctgcaatcctaggcagtctgacttccgtccacgacttcacaaagctgctgtactatggcccttagtgccctccttgacattaaaaacagtaaacaagtcccattttcttttttactaataactctaatttcttcatctaacaatctcacctttcttaaacatactttactttgtcatccaagccacagtgcagttttggtttttctcctaataatgtgtccccttttcccagcctgcttggtgggggccccttcctgaaccaaactgtcgttaatggtgcccttaagcttcacttcccactctgcgttctctgtgcaccatctttaagatctatatttcttgacagaacatttacgtcatgagttcatctgtctccccaacacctttaggtgtcatagctgactgctggtggatatctccatctggacgtcacatgggaacttcaaactcaatatattcaacactgaactcattagctcaactctgctgctgcctctgtctgtcacatgccccacacaattgctctccctcttgtattctatttcagtgaaaatagagtccatttgaaaaattggaacattggtgactcctgtgcgattccccaaacaagcattacgttgtcagttttaccttataaatactttttgaattatatttatcaattccagatcatcaaatcttacctatattttgcaacaatcttttaattagcccttgtgcttccaatctttgtcttttttctttctctacaatgacgccaagggtttcataaaatgtgaaccggattttaccaattttctgcctaagttttccatgagtttccattatgagtgggataacattcaaatttcttgatgtgactttataaagccaaaaatgaaataagaaatattagaattagttttgacaaggagttaatgaacttaggggattccaaactttaaagaacatttacctttacttgtcctctgaccccattatcaaaacattcccacaaaataatcttgtattagttaattatactctggaaggaatttacagcttctcaaagatgattgctttttacgccatctctactctcactggcacgaggctgttttcttttacatgaagtctcccattgttcacataatcatattactttctcgcagcttggctttagaaatagaacatagctaaactttggacccttaagtgattgcctggaggcattaggtctataatttcaatactaaaaagctcttcaaatcataaatatcctaatagatttgtgacaaattatggcagcaaaacctattctgatctgacgttaagttacacctgctttttatttatcacacctagtttgaatattcatacatttcactgtatcaatattaatgtatttgaatgtggggtgctgatccagacataatacatgatatatgcacaccattaccttcctaaaatatgaaaacctccaaaatctaaaaggttttggcctcaaggcccttggattaggaattctgagtttatactaaatttagtatggcaaatcaaagcctatcaaacttcagatttgtgggatttatttatccaagaagaaaataggtctctctctttttttaattagacagagtcttgctctgtcacccagggtggagcgcagtggtgtgatctaagctcactgcaacttccacctcgcgggttcaagtgattctcctgcctctgcttccccagtagcgcctccatgcccagctaatttttgtatttttagttgagacagggtttcaccatgttggccaggatggtcttgaactcctgacctcaggtgatctgcccaccttagcctcccaaagttcagggattacaggcgtgagtcagcgtgtctggacagaaagtagatctcttgatttcctatgagattcactgaaagaatgtgtttaaaagggatcttacatttagagaataagttgatgcacacattttcagaatttctattttatccatttgggctgagtttggtgccttacaggatctaactctctcccacttcgtcttagcttggcaatggtgactcagacaacttcatgccatgttcactggcttagtcaacaaaaaccttagaaatcctaatacagtttaagactggcactggattatccaggtgattctgaacattgatctctccaagtttctgaattaccaaagagcatttatttgcagcctggaaatctcaggctcggcgggggaaatggatacaggtagggcagacgccgtgttcttgccgtgcagctggaataacaaagcctctgaaaagttcaccacctctccacgtgtgtggtattttatgcatcaacacagtcgccttcacctgtgctgcatttcactcattacagataaagttgtatattggcccaactttacccagcacacacttattctgcgctgatgtttacacagcagttagaaattcctgggataataccttctatctcacgctgccatattaccaccttcaaccccattttacattggctctcattcaggggcctttgaaacacagtcatcaggatgctcagggagattaacggtgtggtctggtttagataaaataatccttaggaacctatgaccatcaagtgaatcacgaatattgataaaaacccacgtacacgttcctcacaaaatgttgtttcagttaagttttcttccttccgtgtccggaattggtgggttcttggtctcgctgacttcaagaatgaagcctcggacccttgcagtgagtgttacagttcctaaagacggtgtgtccagagttttttcctccagatgttcaaatgtgcctggagtttcttccttctggtgggttcgtggtctcgctgacttcaggagtaaagctgcagaccttcgccgtgagtgttacagctcataaaggccgtgtgtctggaattgttcattccttctggtgggttcatggtcttgctggcttcaggagtgtagaggcagaccttctcaatgagcgttacaggtcttaaaggtggcgcgtctggagttgtccatccctcccggtgggttcacggtctcgctggcctcaggaatgaagctgcagaccttcatggtgagcgttatagctgcgcagacccaaacaataagcaccaacaacatttagtgccaagagcaaaagaacaaagcttccacaccatggaagggaaccagggagggctactgctgctgctgctggctcgggtggcctgcttttattcccttatctgaccccactcacatcctgctgattggtccattttagagagagctgattggcccattttacagagagctgattggcccattttacagagacctgattggtccgttttgacagggtgctaattggtgcgtttataaaccttgagctagacacaagagtactgattggtgcatttacaatcctttagctagacacaaaagttcaagtccccactagattagctagacacagagcactgattggtgctttcacaaacctggagctagacacagagtgctcattggtgcatttacaaacctctagctagacacagagtactgattggtgcatttacaatcctttagctagacacaaaagttctccaagtccccactagattagctagacacagagcactgattggtgctcttacaaacctggagttagacacagagtgcctattggtgcacttacaaaccttgagctagacacaaagtgcagattggtgcatttacaaacctctagctagacacagagtgctgattgtttctttttcaatcctttacctagacagaaaagttctccaagtccccacccaacccagaagcccagctggcttcacctctcaatggcacttgctgtgggactttgtggtatctagcctgggcactctggcagcccagagggagctcgccccctgatcaagcccagcaggcaatggctggccacgacgagcgtggggcctgctgagcccttgcccacccgcaacctgcacaggcccgggagcgcctcccacccacgcctctccctccacacctccctgtgagcagagggagctggcttggctccagcctcggccagccccagagaggggcccccacagtgcagtggcaggctgaagggctcctcaagcatggccggagtggacaccgaggccgaggaggtgcggagagtaagcgagggctgctagcacgttgtcacctccctctctctctctcttcccctccctccctctccctccctccctccctccctcccttccttccttccttctttccttccttccttccttttctttcttcttcaggtggaactcgaactccagggctcaagagagcctcctacctcagcctcccaaatagccagaggctacaggattgcaccaccacaacggtattcctgaaaagcttctaaaatcttccaataaaagtggttttaggctttcatgtcttaggaggtcttctttaaatatgaaaaaaaagataaaaattagaagttaaaacatgcatagttatgtttaatgtttatgctataaaagagaaattcttatactacatatattcagtgaatttcctctaaacataaactaatattcccctgaaaacaaataaagaaattgaatgatacaactgtcttattccttaaactacaaaaataaaatgcaaagccttggtaaaaaaccaaccaaacaaacaaaaacaatcacacaccaaaaagttggactttcacatatggagtctgaagttggcttttatgacacccaagggcttattcattgtaattatttgtaatatttgtgatatatattatatatataattatttgtgaaacatagcaatgaatgttgtcattattgaagtaatattaattgctgttttaggttttattttgcatttgtttggtttataaaagcattcaaatcctaaagaaaactatactgcttaagtaattgccagctttatgcttcatgaaatcgtttttatggcattaataaatatgaaataaatatctaaaacttaaaatcttcaaatggcatagaatttctaattagtgaaatgatttctgttgttactgaatgtcttcgttggaactattctttttctgttacccaaaatttttcccttaaaagttttaagagacctaaacttaaataaactttaaaataaaacctagatagttttgcctttaagccgggcatggtggtgcactcctgtagtctcagctacttgagaagccgaggtcagaggatcacttgagcccaagagtttgagaccagtcttgttgatacagaaagatcttccttgcctcttacaaaaaaaaaaatccaaattagaaggacttatacaactttcttgtagaattcactttacgtgaacatgcagtagacattcagtacacttgtggactactcagagacaatgttgaatcagttgtgttgagattcatttattttcagatttggaaccagtccttagcccacactagaatatttaaaataatttaaaaataaataagtaattgtgaaaataaatattaaactgtcttctcagcttgaaacagatataaaatgcaaaattaatcatataaagcaatcctataaatattgctagcttgggcaatcatacaaattaagatcagttatgcattcatgatagctcactgatataataaaaatgatgtagggcatgtggttgggtgtcgttgaaatcagatttcacttgtcagtgatactgatttgaaaaaaacataaattgaagaaaccctaatcaatgggactaaataatacaatcaaattaacataaaatcttcatagaatgttttcattatcagtgaacatagtactccaggctttcaggagccatattatagagatggtagaatgtttggaaaaatattttaaagatattcaaatcacttaattataatttaagtaaattttggttcaccaagtaagaaaaactcacatttgtatttcttccccttagccacacagagctgggtagaagacggcttctcttcaaagtatcgttccttcatctagcatagttgctatggccataataagtcaaagacataggttgtggtcatcctaaaaaatgaagcctatattttgattactgtaaacagcattggaaaaaaaagtctgtgtaaggcttgaaagaatatactctttattgtttatgcatgaggcgtcctaggagaagctacatatgtagctgcttacatatgtatactttattacaaatgaagtggagtggaaaaaaacaataacagagaagactgttgtagaaaaatcctcagttatgaggctcagatgtaaatgtaaaacctaggggcttagatctttaaagcttctggctttaagaatgctagtttatgatatgtagttttaggaggagcccttgagagaaactatatttactgcaaagatttgcaaagaaaaaaaaaaaatacatgtgaagtaaaagtactatccattaaacactgaaagccaatttcaatgagaaataatttttaaagttaagttatggggcctccacagagaaataaagcataagaaggaagtgttcttgttagatttcccagggttgcttttctgggtgacaatggcctcatctgtaaaatgtaaatagccgtgaagatatttaactgaatagagattttccaagcagatatcttgaggtccctttcaatgggaaagtatgtaaaataacagggttgcagaagctagagtgaaaggagagtttggtaagaagcggatgactgagtgttatttctgattaaaaaagaaaaaggcaattaagattagaaagaaattaagaagggagcatcttcaattagctacatgaaaggagagtttatgtctatcagcctatcagaagggcttgcatccgagatacaaatgaggtttatcaaaatcaatgctactgaggaccccatcatgggtgactattaaagtgaatcacaaactcagaatggaacccaaaaaaatttcaataatgtacttctgacccattaaagtaaattcaattacagtttttaatgttgttattactgaaaagagttaagtgcacacgtatgtcagttcatatgatacaaaatagcaataatccaagtgctcagcgggggcgctgcccggtggctctggccccgccgggccgttggcccagcccgccggcccctgagctccggtagcccgccgctggagaagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaaggtttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaagtaggtggccttagacatgcatctgccagcattgggggttcagaagcctataggcacatgaaatttgaaggaggtgttcacagagtacaaagagtgccaaagacagaaaagcaaggctgcgtccatactagcaccatgactgtagcaatattaccccagcctactgagattaatctggtgattaatccgaaagatttgagaattgacactaagcgagccagtggagctggggagcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatgtagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccaattatgaatctttagtagaaattatttcccaaaaagtttaagttgatttgttatttatagactttcgtagcttagaaaaattctacagtacatccacatagggtgaaagtacccttactctcttgaaaaacgtgagttaacacagttggaggtaatatgcatattctgaagtcatagataatttacacagatctctctcaatgcattagcaaaaatcatacaatatacagatggtcctcgatttacattgtggttaattcccaataaacccgtcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactctcaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctctaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgaaggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatcagatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacaaaaaaaaaaaaaaaaaaagtgctcagcaacaaggcacccagtcatcccatatgtattcaccgggatctaggtgggtgctggtcagtcattgacctgggtaccagggttcttggcctcagggaacctacaggctagtcagagagacagataccttctttgatcagtcaaggaaatatatacttacaaactctgataattacctgatgttcagaaagacaacaaaagaatatcacttagcctaagcttcattaaagaagtaccacttgcactgaaatatagactaaacgattaggtgtaaggttcatttcatgatcaaggaccatcccatgagagaggagcaggagagcatgatctttgaagaatctgaaagaccagtgtgctgaaatacagagtgaggacagagtgctactagaccttaagaaaattatagagaaattatactgaaaatagtattaaaaatataacatagccttaaattaaaattgtatatattttattcatagtttaagttatgcatttatgtacatgaagactggaagaacatatagcaaaacaaagagttgtatgagtattgtgaaattatcaattccaccccctctcttttaaaagtatatatcttagtgaatgtgctttgttggcttttgtcctaaaactggaaagacacagaaacattgttccagtgtttaacaagattaacatgcacaagactgacatacacatttttgaagtgtttcatattttggattgatattattagaaaattaccacttgccagtcatcataatgcaaactgattccagcaaaaatcatcaaaagatgctgaaaaatcatcaaaaggtgacttagctggtgaaagtttgaggactaacaggatatttacatcatctcagagtgtctcctcataatgtgcttactagtaagaaagaactaactggtgactttgcaatgagcagacctggcaggggtccaccatcttcatgaagtgatctaagttaacatcacgagtaatgagatgaatcaatacttagtgtctcttgataagatgcactgagaagaacataatatcatagtgaataattctgagaaaataaggtatcgtctaaattctgggtcatatattgtgaagagatatcagacaaacccaaattgagagacattctacaaaatacctggtctgtactcttcaaaatgacattgtcgtgaagcacacagtaaggccgaagaatcgttccaaattataggagactatagaggaatgatggcacatgggaataaaggttctcggtagccacagctgtactggcattgtggaagtgctccatgagagattgcctaagtgtgactatcattctctggccctcacacaattctatggcagagacaatgtatctttaaaatataccattctctcatcctagacacagaagacaagatttgccagcctctattgtagttgggtagtgggcaaattctagcaaaatttaggtggaattgatatagaccagactcaggcctggaacttcagagcactgggcatggtgctcttgccccctcttggggaagcttagaggccacatactccagatggcatagctacaggtatagggtagtcacttggccctgttaaatcaatgtgagcaaaaactaactggttattgcttttagatttgggaggatggtctgttgtagcagcagctagcattgcttaccctaactaaaacatttgaatatcctttatttaatactcctctgcttgaaggaaatataacagatagtaacagctgaacttttatcctgactgatagtttcaattattcaatagatattttagtaaaattgttaggttattactggtaatagctaacaatttttgtgtcatctatgtgccaggcactatggcaaacattttacatatataacgctttttctatatttagaaaaattctgtgaagtaacattataatcctgatgctcagaaaggttgaataacttggttacggcaagccagttgtgaattcaggtctatctggtccccacattcatgccttttgtcattatacaatgaatatcttacttgtcttccaatgtatgaattatgtataacaagctcgtttgtgtgtatcccacattctacagctagtaattgcctctcaccctcccaccatcattgcccttttagcaagagctttgtgtacctcccaactaattttgagaagagctcagcctccaggagaggctgacttgaggagctcagtttttcaggcacaagcacaggtgactttcctattgcttgttctgactttggtggtttctcagcaacctggtcacacatttacacaaccaccctcccccttagttttctgataactaatttcctcagaaataagattctgtgctctaattttcacaaatttcaggtttcttttttgaatttagtaatcccgcactcttgtcctgtttgtcatgccatggagtatatctctcattgtgcctactgtgcctgccttgggggcatgtcacttcctctcctgaaccccagtcttctgcaatatgacaaaaatacctgtcgtacctgctgacaaacctccaggatctgaatcactcacctggacactgtggccaactgctgagcttgcggatatccactaattagatggtgtatgacatgatttggagcccctaataatgtttgccattaatgtgttcgtctccccaactaacacaactttataggttcatccatacatgccatgtctttaattgcaccccagtaatcactcaatctgaagttcttcttagaatacaattttgtgttttcaagtcgaatccattttgctaatgaatatttctcagaaaagatgacatttaacattttgaatattattttccattattctaaatttaaattgcagttagtcctgcccatcaaaattttgaaacaaaaaataaaaatgaagtgcctagtaacatcaagtcctatagatgtattgattgggacattaaaacttagttaatgatcaatttgaatcactaaaaaaaaccgtataataacaaattcatttcagcttacatatctacattacaaaatctccatgggctaaaataataaataatgctttcaaaatgaaaatagtatttaagaggccttacctaagtttgttttacccactatgtgggatacacttgttgaggcttagttacacctccaccctctaagctctcctttgctatccaacagtgaagctttggagcaaaaagtttctcaacagtgctgagccaacagtggttccagtggaatacagcaatgtgagttaggataaggatatgaagacagaagaggtcaccggtacctgtctgtccatgcctgacatcctatggcagatacggggttttgtctatgaccatcaagcagcctcatggaattacccatttcatgctgtagtcctagcaatttggaattttctaaaacagtctttgcatgttttcccttttccagcctttgcaagcttttctcccatgtatatattcaacagaaatgcatacagatatgcctcaaagacaagtacaaaaatgttagttacagagttatttataatagttcaaaataataatcaaaatcattaagtgtataatggataaacggtgacatactcatgcaatgaaatattataaaacagtaaaaagaatgagctgcatatccaacagttgtgtacattcctattactgtgtattaaacatttttaattcaaaatacataaaatggcttctttgatgaaatttggctatttattagcacgttgtcttgagtaaactattgtataattggactagcaattttaagtatgctcccaaagagtgggtctgttaagttctgtgtggggaggaatatttgaaagtggcaggagggagtttcacagcggccacagcataatcacaccagacagacagaagacagagcatgagagaggagtatgtagggcttacaacgggtggaagagacgctgaagtcaatgcttatgtagaaactctagagaaaaagaccccacatacacatggtgatgtgattaatgaaaagggaccagaccagtataatgcagagaggacaaataatctttcaaaacagtagcaatggatcactggatattccgatagggagaaaacgaatgtcaactcttacttcataccgtacacagatatcagttccagatggattgtagaccatctggacctattttaaagttaaaataataaaacttctagaagataacatagaataataattgtatgaccttgagatagcaaaattgtataaacatctcactaactgtgcaaacacaaaagattgaaacattgatttttgttaaagctaggaacatctttttaccataagataccttaagaggatggaaagcaatccacagagtgggaaagaagtttgtagtccatatttctaacaaagaactcatatgcgccatctataaagaactcaggcattgacttcaaaaggagataatccgttagaagaatgacaacaagacttaaatgggtgcttcacaaaagaatattctccccagtactttgggaggctgaggcgggtggatcacgaagtcaggagtttgagaccagcctggccaatatggtgaaaccccatctctactaaaaaaaaaaaaaaaaaaaaaaaacaaaaattagctgggagtggtggcacgtgtctgtagtcccagctacttgggaggctgacgcagaagagtcccatgaacccaggaggcagaccttgcagtgagccgagcttgcaccactgcactccagccttggtgacagagcgagactctgtctcagaaaaaattaaaaaaaagaatattatctaaagccagtaaaaacatgaaaagctacacaacaatatcagtaatcaaggatatgcaaattaaattcaaaatggagacatgaccagccgcaatcaaaatgcaagaagaatcagccttgtaatactaacaagtattggcaagtatttggaccaatagggagtcatccatcactggtagtggcttaagttgataaaatcagtgtgacacatgggaaaactgtcagtgtgtaccaaaactaaacatgtataccaaaactaaacatatgtaccaaaacaaacataaaggctttgatccaaaggattttctcccatgtgtatatgtaacagaaatgcatacagatatgcatcaaagacacgtataagaaagttagttgcagcattatttataatagttcaaaatcataagtaaatcaaatatcattaaatgtgtactggataaacagtgatatattcatataacaaaatattatacagcaataaaataaatgaattaggttggttcctcactgttttttccttttataaatattcattaagaattctagtatattttggtttctagattttcctatcttgtttacgctacctaaatctttgccacagtttttctagttaataacaactccaaatttgaaatatatgatgggaaaactagtgttgggaatgaaaacaactagcattaaagattaatgtaaataaatatagtttattattttgcagattttatttaaatgtatttagggggtacacgtgcaggttccttacatacacatattgcttagcagtgaagtctgggcttttagtgtgcccatcacccaaattattaacattgtacccaataggtaatttctcaacctttgccctcctccctccctcccatcttttgtgtgtccagtgtctattattccagtctctatatccatgtgcatgcattgtttacctcctgtttataagtgagaatatgcagcatttgactgtctgtttttgagttgtttcactgaagagaatggcctccagttccatccatgttgctgcatattttgaaaaatttaataactcatttggatatgctggttaatgctcacaatcattgcttatataatgaaatctataactcaacaatgtcattttaattaaaatgtactctttgttcattgatgacagtagttatcctgccagtgtatctcacaagagacccatctattcatttgttttccatatatccacaaataattatttcatgcctgcactttcagtactgggaatacagtgaaaaacaaaagagagcaccttgctcatggaatttataaattagctaagtggtctgacaataaacagtagaacaatgatactatttgagctggaactaaatgatggtcctctgtgtacatggcttggaggaagtagaaagaatagtggacagtccaaggaggagaaaaatggtgagcacattgaggaaagaaaaaaagaaacaactcagtgtaactgcaagggagaaagctaggatagcatggtgtgagatgatactaggtgggtggcgggggaatgcccataccagacctttcaagtcatggtgaaagttcggcctttattttgaatgcagtggaaaatcatttgaaagttatgttcaaagaaatgacaatatctctttttatgctttttattttgtattttaaaaaattttttattttaggtttgggggtacatacgaaggtttgttacatagataaacgtgtcatgggggtttgttgtacgtattattacatcacccaggtattaagcctagtacccaatagctatcttttctgctcttctccctcctcccaccttcccccctcaagtagacccgtgtctgttgtttccttctttgtgttcataagttcttatcacttagctcccacttttaagtgagaacatgcagtatttggtttcctgttcttgtgttagtttgctaaggatgatagcctccagctccatccgttctcacaaaagacgtgatctcgctcttttttatggttccataatattccatggtgtatatgtatcacattttctttatctagtctatctttgatgggcatttttttgattccatgtctttgctattgtgaaaagtgctgcaataaacatttgagtgcacatgtctttgtggtagaatgacttatattcctctgggtatatatccagaaatgagattgctaggttgaacagtagttatacttttagatctttgaggaatcgccatactgctttccacaatggttgaactgatttacactcccacaaacaatgtataagggttcccttttctccacaactttgccagcatctgttattttttgatgttttaataatagccattctggcttgtgtgagatggtatctcattgtggttttgatttgcatttctctaatgatcagtaatattgaattttttatatgcttagtgactacacgtatgttttcttttgagaagtgtctgttcatgccctttgcccactttttaatggggttatttgttttttcttgtaaatttgtttaagttccttatagatgctggatattagacttttatcagatgcatagttgcaataattttctccaattctgtacgttgtctgcccactctgttgatagtttcttttgctgtgcagaggctgttaagtttaattgtcaatttttgcttttggtgtgattgcctttgttacctttgtcatgaaatctttgcccattcctaagtccaggatggtattgccttccagggtttttatagtttttggttttatatttaagtctttaatccatcttaagttaatttttgtatacggtgtaaggaaggggtctagcttcagtcttcttcatatggttagccagttatcccagcaccatgtatttattagggagtcttttccctactgctcgtttttgtcagcttttttaaagatcacatggtaatagatgtgtggccttatttctggcctctctactctgttccactggactatgtgcctgtttttgtagcagtatcatgctgtgttggtcactgtagccttgtagtatagtttgaagttgggaaatgtgacttcttatgctgtgttctttttgtttagaattgccttggctacttgggctcttttttcatttcatatacattttaaaataattttttctagttctgtgaagaatgtcatttatagtttgataggaatagcattaaatcttcaaatttatttgggcagtatagccattttaataatattgattcttcctatccatgagtatgggatgtttttctattcttttgtgtcttctgtgatttctttattcttttttctttttcttttctttttttttttttgtgacagagtcttgctctgtcgccagataggagtgcagtggcatgatcttagctcgctacaacctccacctcccaggttcaagcggttctcctgcctcagcctcccaagtagctgggagtacaggcacatgccaccatgtccagctaatttttttatttttagtagagacttggtttcaccacgttggccaggatgatctcaatctcctgacctcgtgatctgcccacttcaacctctcaaagtgctgggattataggggtgaaccaccacgcttagcccttctgtgatttctttgagcagtgttttgtaatcctcattgtaggggtctttcaccttcctggatgctgtatttctaggtattttattttttgtggcaattgtgaatgggattgcctttctaatttggctctcagtttgcttgttgttggtgtataagaatgctagtcatttttgtacactgattttgtatcctgcaactttgctgaagttgtttatcagctgaaggagcttttgggcaaagactatggggttttctatatgtagaattatgtcatctgcatacagagatagtttgagttcctctattactatttggattggctttatttctttcttttgcctgactgctctgggtaggacttccaatactatgatgagcaggagtgttgagagaaggcatccttgtcttatgttggttttcaaggggaattcttccagcttttgtccattcagtataatactggctgtgggtttgtcacagattgctgttattattttgtggtatgttccttcaatacctagtttattgagagtttttaacaagaagggatgttgaattttatcaaaagcctttttctgcatcttttaagatagtcatgtggttttggtctttagttctgtttatgcaatgaatcacatttattgatttttgtacatcgaaccaaccttgcatcctggggaaaaagcttacttgatcatggttgataatccttttgatgtgctgctggatttggtttgccagtattttgttgacgatttttgcaccaatgttcatcaaagatatcggcctgaagttttctttttttgttgtgcctctgccaggttttggtatcaagatgttgctggcctcatagtatgagttggggagaaggtcctcctccttaatttttaggaatagtttcagtagaaattggtaccagctcctctttgtacatctggtagaattaggctgtgaatccatctggtctgacaatatcttatttatattttacaaaggctactctggatgttgtatgaaaaagtagactgtaggatgcaacatttgaagcaggaagatccacccgctacaatttctctgctccatgtatttctggcatctgctcaatttagatttttctcttctgccacccactgaaactgcttggtcacagtcatctgtgacttccagtttgcaaaattcaatgaccatttatcatcccaacccagctggactcttgacaacagcaatcaacttagttaatgactttctctttctagagaccaattcttcaattgattctagattatttttttctacgtatacactaatttcttaatgatctcaaaatttcagttttaaataaccatctgcatggtagttactctggatttacacctctatcctatgtttctctcattccttcaaactccaggcttaaacttccaagatccaaccaaatatctcctcttgcattttagcaggccttataggcattcaaaacttgacatgcacttgacatctacttccttccgaaatttccttctcccacagacttatgcacttcaggtgatgaactctccagttcctccatctaaaatcttaaatagctgttctttctctctcatctaccatccaatacatcaacaaatcaattatctgacaacatctttacttttgaattagtaccaccataaccaaaggcaccaccatctcacttgaattatggggacaacttccctgaaaaggcttcctacttctatcctttatccatattagtttatacttggaacaaccagaaaggttttgttaaaaggtaatttgaatcgcatcacgtctctgaaactcatctaagttgtttcatcttacttagagtacgagtcaaagtcattacattgtctttcatggccctcctcattctggcctcaccacatttctgtagccgactatcctctctctaactgatcttgctccagtccaatcagaattctttttaaacccagacagcaagtcttggtacctgttgtttcttctacttggtatgtgctttcccctcatcttttaggtctttgcacaaataatacctggtaagcgaaggactttctttgatcacactatttaaattttcccacttctgacatgtactatgcgtattctctgctatagttttctctcatgtgcattgtcactcaacagaagacatataattctgtttgtaagtttgctgtaatttatccttgttatttgcctctctcaacaagaatgggagttttaacatggagaaggaatttttctatattgtagtctctattgtatttccagcacttcgaagaatatctggaaaacaggaagttatcaaaacatatttgttgaataaatcatgggaaaatacaatttatacagcaaagaaactaatgataggatgcttggtgacaaccatggtcatgcggtcttatagaagacaaaggggttgaaacagcagtggagcaactggtttctgatattagtaatctttggttaagtaaaaggaaaggcagatctgatgccaaacgtaggtatatctgttgtttcgtgtataaagatgagaaactattattcagattgctcccatttctcagggaagcacacggcaaggttatcaactgagggaaattatttataaaaccttaaaaatcataggcatattggctgggcgcagtggctcatgcctggaatcccagcacttagggaggctgaggtgggaagatcgtgagttcaggagatcgagatcatcctggctaacacggtgaaaccccgtctcttctaaaaatacaaagaaaaaaattagcagggcgtggtggtgggtgcctgtagtcccagttactcgggaggctgaggcaggagaatggtgtgaacctgggaggcggagcttgcagtgagccgagatcgtgccactgaactccagcctgggtgacagagcaagactctgtctcaaaaaaaaaaaaaaaaaaaaaaaagaatattctctaaagccagtaaagacatggaaagctacacaacagtatcagtaatcaaagatatgcaaattaaactcaaaatggagatgtgaccagccacaatcagaatgcaagaacagtcagcctggtaatactaagttttggcaagtatttggaccaatagggagtcatacatcactggtaggggcttaagttgacaaaaccaatctcaaaaaaaaaatcatagttatataataagaaatgggaaaaatttaaatcagtggggaaaatatcttttcaaatgacaaggtaaaattatgcatgaagtagaggaaagtatttcagattgtagtgaggcaaatgtataatgcagagacattgcagagaaatttgccttgggctacctacacagaagttacagaaaagaaggaaggaaatgaaaaatttctggaacgatgtcatttaggaataatattaatttacaattacttttagtgaatggtacatgtcttagtcttcgtgggcttacatgacagaataccattgactaggtgtctaaaacaacagaattttgtttctcccagttctgggggctgggaagtcgaagatcaaggttccggctgctttggttcccagtgagggctctctttcttgcttgcagatgctgtcttcttgctgcatcctggcctttcctctgtgctttcacagaatgacagcaagagagctctataatgtcccttcttataagggcactcatcttatctcaccaggctcccactctcataatctcaactgataattacctcccaaagccctatcttcaaatatcatcccactggaagttagtgagaggtgacaatgtgctagcagccctcactcactctcagcacctcctcagccttgtcgccccctctggccgcgcttgaggagcgcttcaaccggccgctgcactgtgggagcccctttctgggctggccgacgctggagccctctccttctgcttctggggaggtgtggaagggagaggcgctggcgggaaccagggctgcacatggcgctcatgggccagcgtgagttctgggtggctgtgggctcagtaggccccacacttggagtggccggctggtgctgccagcactgggcagtgacgggcttagcaccccagccagcagctgcagagggggtgccaggtccccagcactgtcagcctgcccacgccatgtttgaattctcaccaggcctcagccgcctccccacagggcagagctcaggacctgcagcccgccatgcctgagcccccccacaatgggctcccgtgtggcccaagcctccccaatgtgtgccaccccctcctccatggcaccgggtcccatcaaccgcccaagggctgaggagtgcaggcatgtggcacgggactggcggacagctccacccacagccctggcatgggatccactaggcaaagccagctgggctcctgagtcaggtgggtacttggagaacttttatgtctagccagaggattgtatatgcaccaatcagcactctgtgtctatctagctccgggttcatggatgcaccaatcagcactctgtatctagctaatctggtggggacttggagaacttttatgtctagctaaagaattgtaaatacaccaatcagcactctgtatctagctcaaggtttgtaaacgcaccaatcagcaccctgtgtctagctcaaggtttgtaaatgcaccaatcagcaccctgtgtctagctcaaggtttgtaaatgcaccaatcagtgctccgtgtctagctaatctagcggggacttggagaacttttatgtctagctagaggattgtaaatacaccaatcagcactctgtgtctagctcagggattataaattcaccagtcagcaccctgtcaaaacggaccagtcagctctctgtaaaacagaccaatcaggtatctgtaaaatggaccaatcagctgtctgtaaaatgggccaatcagcacgatgtgggtggggtcagataagggaataaaagcaggctgcctcagccagtagctaccatcttgtggggtacttttgcacactgtggaggatttgttcttttgttctttgcaataactcttgttgttgctcactctttgggtctgcactgcctttatgagctgtaacaatcatcgtgaaggtctgcagtttcatttttgaggccagtaagaccacgaacctaccgggagaaatgaacaactccagaggggaggaacgaacaactccacccgcacccctttaagagctgtaacactcaccgccaaggtctgcagcttcactcctgaagccagtgagaccatgaatcccccagaatgaagaaactttgaagatgtccaaacactgggaggcacaaacttaggacgcaccatctgtaagaattgtaacagctgccgcgagggtccctggcttcattcttgaagtcagtgagaccgagaacccaccaattccgaacacatgaggacttcaacatatgaacctggtggcagggtggggggagggggagatggcagcgggtgcgggagaggtgaccataatggcatactatatattttcctttttttttttttgagtcttgctctgtggcctaggctggagtgcactggtgtgatcttggttcactgcaagctctgcctcctggtttcatgccattctcttgtgttagcctccctagtagctgggactacaggcatctgccaccacgcctggctaattttttgtatatgtagtagagacagggtttcaccgtgttagccaggatggtcttgatttcctctccttgtgatctgtccacctcggcctcccaaagtgctgggattacaggcgtgagctactgtgcctggcatatgttttcttaaaaatgtggggacaacttatacgcatggatatactgtaaagaggataatcaggaaataaaaagaggaaaggagaagagaaattactgttaccagaaaccctgcattgggttatttcaggtgctgaagttagcactgttttcctagaacctacaacacaagggaagacaagttgagatagaaggaggagcacaagaaggatgagaatgaggagtaagagaaggaagaagaggaggaatctatcaatttttacaaacaaaattttgatactgccattgaatttaaagaggaaagttttgaaaagcaaggacttatatttgaggtattgggaaaaataaataattttaacaagttatagactaaaaataaatggttaaaatcaacatttctcatagcaactctcactaatacttgtgtggtattactttaaatcttaattcagagtagcctctttttgttttcagcatctaagattatgtggtatattttgttttgcgatgacaatacaagatcagacctcagagagtctaaagacaatcttaaatgaattgtttatttgacagattctcacacatcattgatttcaaatggtctttagcataatttatcatcatgttgtgaaaatttaagacctaaaattgtggaatttcctggatcagtctatttatttctagaattggctacaaagcagatcaaaattaagccttcaaagaaaatataaaaacattgtcagctgggcacggtggcttacgcctgtaatcccaacactttgggaggctgaggctggcagataacttgaggtcaggagtttgagaccagcctggccaacatgatgaaaccttgtctctactaaaaatacaaaaaaattagccaggcatagtggcaggtgcctgtaattccagctactcgggaggctgaggcaggagaattgcttgaacctgggaggcagaggtttcagtgagccaagattgcaccactgcactccagcctgggcaacagagtaagactccgtctcaaacaaaaaaaccaaaaaacaaaattgtcaagcaattgagggaaatttttgcttgaaatctatgagaaaattgccctttagcctaaaattgacatatttagtcaaatttttaaaaatttagtcaaaaaagaaatgcatgacctctgtcaattttttaatggattttccattaagtgtcagctgcgaattgaataaaaatagcgactatttactgaagatctcccacttagaaaattctttctatatgtcatctcattctgtcatcacaatcacttaagaccaacatgcctttactgctaacactttacagacgaggaaaccgaggcttataatgggaagtagcttgatgagaggtacatagttaatggcaagctagatttgcagcgcagatataattttcacactataatgtagcatcgatttgtggaacataaaaaatttctaatagaattacttagtgttatacatataactgagggggtgcgttttcaaaatacaatgattttattttaatgtaattgagtatactttgtatctttgacagtaatcaatcacgtgtttcagagatttcttcattctcttcttctttatgaacaataaaacaccattaatgacatcaacaaagataattttttctggtttggtatatcgatatattgatacctctgctatattgatatactgtcatatttgtatatctgatatatttggttaatctgatacactgattaatagctgtcctaacttgttttatataggttttttttttgaaaagaggagccaaaaaacttttattttaggtgtaatatatcatttaaaagaagatctgttagaactttggtcaacttggattttcataggagcattataacacaggtttggagtattaataggaactgtacctacaatctaaatttctatatttaaataattgaaaatggaaagtaaatgctgtgaaaaatttattttgatcttatgagagtatttttctttaaaaaatatatcacattttaacttctcaaagaaactctttttagggaatattgagtcaattagctaagaaatctccccacctcgcaaagattacacatatattttataactgagtgtaaagtatgataatccccaatgagatatagaaattcagttacaagagatcagatagcctcgaagtagtgaaatcattaaatcttatggaaatgacccagaatcctaataggtcagaggagtctttttagagcttcattcttgagtgaaatattttctttagttttcaagggaatatcagttgtagtaggatattttgaaagtaaaattctggcaaaaagtaaaatctttgatagataccagttccccagtgaggtttattgtaatcataatcacagttgtgctttgttttatgaactcattctgtattactttattaagtctttagctgactgtaagagtttccttggaggtgttttctcaactattttgctaggaatttggcttcaaggtaatatttatccaacccagtcatagactgtcaagtcttctacaaggaatacaggctgctttcatattgtctaaagtctgttgataggaagttaaagtaaattttttttctacaaaagaaagtgaatagtgttgtacattctttagtcctcaggggttgatactgaaattggccaattattttatccatgtggagaaatattttaatataacccaaagattataattaagatactgtgcataaaatactttgaaataataatgttgagggtcagaatgaaatttgtattgttagtaagatttttaaatgaaatattttaaatagaaaagtggagaaaaatatgaaacatatatcacaaaatttaacaaatgtgagagccttgacatgtaagcttcagctatttttttcataaacaactcagacacagttcaaatcttttaaaaattcctctcattatatttcttctctttcacacatttgtgaaactatttttttccaattgttttaataatacattttcttatgtagctccttaggaggtttttaagttgttaaatttcattttaaattatttaatttttttgacattgacaaaattgcatatatttatgtatacaacatgatggtttgatatatgtatacattgtaaagtggctaaaaataaagataattaatatatgcattacctcacatacttttttttgtgctgcgaatacataaaatttgctgtaagcaattttaaagtatacagtacattgttatgaactatagtcattgggatgtgcagtaagtgacttcagtatattactgttatctaactgaattttgtgttctttgacaaacatctccccagtatcccctttccccagcctctggtgaccaccattctctctgcttctgtaagttcaacgtttttattccacatataagtgagatcacacagcatttgtctttatgtgcctggcgtatttcacttaatgtaatgtcttccaggttgatccatggtgttgtcaataatagggttcctcatctttttaaggctgaatagtattccattgtacccataccacattttctctttctttctttttctgatttcaatggtttgcttatttatttatttatttattttctttaacttttattttagtttcaagggtacatgtgcagatttgttacatgggtaagttgcatgtcacagaggtttggggtacctgtcactcaggtaatcaacatagtacccaataggtagcttttcaatcctcaccttcctccccacttccagccctcaatgatgccctggtgtttattgctcctttttctgtgtccatgtgtactcagtgtttagctcccacttataaatgaaaacatgcagtgtttgtttttctgctcctgtattagtttgcttaggataatggcctccagttccatccatgttgccataaaggacacagtcctgttcttttttatggctctagagtattccatggtgtatatataccacattctccttttccagtgcaatgttgatggctgtccaggttgagtctttgctactgtgaacgctgctgcagggaatgtagggatgcatgtgtctttatagtagaacaatttatattcctttgggtacatacccagtaatgggattgctgggtcaaatggtagttgttttcagttatttgagaaatctcccaatgctttcctcagtgtctgaactaatttatactcccatcagcagtgtgtatgttttctcgttactccacaaccttgccagcatctgttattttttgactttttgataatagccattctgactggtgtgagatggtatctcattgtggttttgatgtgcatttccctaatgattagtaatatttagcattttttcatatgcttgttggctgtatgtatgtcctcttttgagaattgtctgtccatgtcctttgcccactttctaacaggtttttttttttttttgcttgttgatttaagttccttatagattctggatataagacctttgtcatatgcatagtttgcgaatattttcttccattctgtagtttgtctatttactctattgatagtttcttttgctgtgcagaagctctttaattagatctcacgtgtccattttttgtcattggaattgcttttggagtcttcattatgaagtctgccaggaccattgtacagaatagtatttcttaggttttcttttagggtttttatagtattagattttacatttaagtctttaaaacaccttgagttgagttttgtatatggtgaaaagtacggacccagtttcaatcttctacatatgactgatcagttatccttgcaccatttgtttaataaggagtcctttccccattgcttgtttttgttgactttgtcaaagatcagatgatagtaagtgtgtgactttatttctgggttctctaacctgttcaattggtctatgtgacagcttttgtaccagtactatgctattttagttactatatccttgtagtatattcaggctttttggttacaaatgaattttagaatagttttttttttaattctgtgaaaaaaatgtcattggtagtttgataggaataaacaacaatgaatctgtaaattgctttgggatgtatggccgttttaacgatattgaatttttgtattcatcagcatggaatgatttttcattttttaatgtcatctctgagttccttcagcagtgttttgtaatactcaatgtagagatctttcaccttcaaggcagcctgctggaagaagcacagtttactggagccctggtgcttcctctctggccccatcactgcatttgcacaaagcccagacacttccccagcagttcccagtcagcaactgaaatagccaagggtgctactatgcaccagtctggagctgctttccagtgggccacttttgtttgggaaaccccagttgacctgggtaagactgttttagagatactctgactaagcctcttcctcactaatcattccctcccactgtcctttcacaggtgccagccctccttcttggctgtgaggttctctctgcctactcctgctccttccctctttgtctttcacaatcttctccccataaacttctcaccagtctcactctgcttggtatttgcttttcagaagaatgaacaaatatatcagctttttgcttctctataacatgatttgaaagtaaggaaaacaaacaaacatagttttcattgagatatctaatggacaaactgttattaatactataatagccaattctaatatttaagtatcttagcataattaataaagattttagaaacacgttgcttagtaaattgtaaggcgtcctagatatctgagaagtcaatatctttattttcatgaaaatgtggttatttgtaaaaacaaaaataattaggtatgcataactgaaaagtttactcttctgttgttttctattttacttatttacttatttttattggcaagttacaattgtatacatttatggggtacaatgcgaaacatatatacacatatatatgatatatacacacacacacaagcaatgtggcatgattaaattgagctaattatcattcataacttcactaacctatcatggggagacatttgaaattttatgatgagacatttgaaattttcctttagttattttgaaatatttaatacattattatttactatagtaaccttgctgtgcaataaatctcaaaatctgttactcttgtctacctataactttgtaccttttgataagcaacactccatctcctctctttccatggctggcatctagtaaccatcattctagtccctggttctatgagttcaactttattagagtccacatataagtaagatcatctagtatttgtctttctgtgcctagcttatttcatttagtacaatgttgttcaaattcatcaattttgttgcaaacaatgggacgttccgcaattttcaaggctgaataatattgctttgtgtacatataccacattttctatatccattcatccattgatggacacttaggtagtttctgtatttttttatactttaagttctggggtacatgtgtagaacgttcaggtttgttacataggtatacacgtgccatggtggtttgctgcacccatcagtctgtcatctacattaggtattgctcctaatgctatccctccccagcccctcaccccttgacaggccctggtgtgtggtgttccccttcctgtgtccatgtgttcttattgttcaattcccaattatgagtgagaatatgtggtgtttggttttctgttcttgtgttagtttgctgagaatgatggtttccagcttcatccatgtctctgcaaaggacatgaactcatccttttttatggctgcatagtattccatggtgtatatgtgccacattttctttatccagtctatcattgatggtcatttgggttggttccaagtctttgttattgtgaacagtgccacaataaacataagtgtgcatgagtctttagagtagaatgatttacaatcctttgggtatatacccagcaatgggatcgctgggtcaagtggtatttctggttctagatccttgaggaattttcacactgtcttccataatggttgaactaatttaccctccaaccgtgtaaaagtgttcctatttctcctgttgtgaatagcactgtaaagaacaagagagtgcagatagcccttggatatattaatttggggaaaaggttaacaaagcatacctcttacaaggggttaaagggtgctgtgccaggtgcctttagtctcagttacttgggatactgaggcaggaggatcctgggagcccagcttggacaacatggcaaggcatcatctctttttaaaaaagtgtgtgtgtgtctatatatatatatagacacacacacacgtgtatacacacacatatgtatacacacatacatacacatgtgtacacgtatatatacacatgtatacacacgtgtatatatacacatatgtatacacacacgtatatatacatatgtacacacacatatatacacatatatgtatacacacgtatatacacatatgtatacacacgcatatatacatatatgtacacacacatatacacatgcacacacacatatatacacatgtatacacacgtatatacacatatgtatacacacatatacacatatgtatacacacatgtatacacatatatactcatatgtatacacacatatacacatatgtatacacacatacacatatgtatacacacatatatacatgtatatgcacacatatatacatatgtatacacatatatacacatgtatatgcacacatacatacacatatgtatacacacatacacatatgtatatgcacgcacatacacatatataaacacatatttatacacacacacatatgtatatatatatatacacacaactcaatagcaagaaaaaaataaacagattaaaaaaggggccacggaccgaaacagacacttctcaaaagaagacacacaaatggccaaaaggtacatgaaaaaatgcttagtacactactcagtagggaaatgcaaattaaaaccacagtgagatatcacttcacacctgttaaagtagcttttatgaaaaagatgaaatacaacagtgatgaagaggaagctgaaaaaatagaactcttttacaccattggtgagaatgtaaattagtatgtctattacggaaaatagtctggaagttcctcaaaaactaaaaacagaacgactgtatgacccagtaatcattcctgagaatatacccaggatttaaccccttaatgtaaattacttcttctaaaaacagtttgtctctcggtaacttgaggaaatatgaagatcaaatgaaatgatgcgaagctgagatcagctgtgtggagtcaggagagtggtgtcttggcaatgacgttcctctgggctttgaaaacatgccaaatcgtccgtcaaattaaagactcagtgagggtggcaattcagaagccgccttcatggccttagaatcaccggacttcagacatcaatgtgtagtgtccaagtgctaaacttgcgcatccttacaccatgcgagtattctggcctatctgtgtgagggagacgtagaatacacagtaacaaatgagattcagataagatgttacaaaaataaaaagagaatcacctaacttagttccaggaatgcagaaaataaatgttgctatttcaggaactgttcctttttttaagaatataaatttattttataaaatggaggatggtttatttgttatacatcatgtcacactgccgttacttgttcatcctcattccttggaagtaatattatttgctccccctatacatctaaattactactacttagtagtagtcaaatattatttgctgcccttatacaactaaaatattatttgcttcccttatgcaactaaaatattatttgctcccactatacgtctaaattactactacttagacactaagcaggattggattgatggtctttgaaatggcaacctcgtgcagaattcatttggtcaagtttattgagtagggctgcaattcaggatggaaaagaaaagccatgagaaacatgtcccgcaactgacaatgctctgtcagcttctccaaatattatagcaactgaatgaaaaaatattttataaaaatagcaagttacggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtgtcgggcgcctgtagtcccagctactcgggagaccgaggcaggagaatggcgtgaaccccagagggcggagcctgcagtgagctgagatcgcgcccctgcactccagcctgggcgacagcgagactccgtctcaaaaaaaaaaaaaaaaaaaaatagcaagttactcattcatcatctaaattagatgtacagcaaaggagttcatgcaactttctgagtttatttggtaagtataaagtaattttgtatgacagacatctatttgccttgatacatcactataattatgaagttacattttaaagtatatggcagtgaattttgaaaaacacataaccattatagaacgagacttagtgaggagaagtcataggggacatttattttactgtcattgagactaatgtaaaaatggcagtaacatacagaaagaaattctgcttactctttcattactataatggataaaattttaattgcctgtttttccttgaaatgtaaatatttatgaaatgtgaaatactctgtaaagaaattttagcttaacaaatattaaaaatgaattatttatgcaagtaattttgtccttaaatatagccgaagcatttgcatagctgaaaaataagattcaaatctctatgaacagatgattttatatgtacatatgtaattaatagaaactcagaaattataacaagaccatagttcaaaaagtaaagtcatctattatgatgactgaagaataataattttggaaaacattattttatagcaaaacattattaataagattaacctaaaaaatctttctgctttcccttaggctctacattctttttaaataccattaacgtaaattcctgaaattgtaaggaacaaaatgaattttacaaaataccatttatctctctctagagtaatggtaaaagtccaaataaatgagctaataggattgtatacaatttccttctaaaaacacaaatgtagttttaaagaacttttaactatgtgttcaaactacataattcttctttattcatctacccaaagtataattatagcaagtaaacatagtgacttcaattaattatgcccaattttgaggaagaaaaaaatgtgtcttttatgaattttaaattaaactcaaatacacaaatcaatgttattttaactaaataaaaaatgaaaataaattgtaccccaaattctggtttgttaagttcaaaaaaagtaatatactgacaaaagtcataagcttaatatacactgggtgcatttaactagagtaatatttttaacaaagagagaataggttgtccataatgtttattttactgaatggtccgctaggatgatggcattataaatatgtatgtgtgtgtgtgtgacagagaaagaaagataatttttaggcaaaattcagttcaaaaattgcttgcattgaaatataaacactttacttattaaacagctcatttttctttcatttggatcgtattattttaaaattatttcaaacatagtaaaatgttcacatttaaaagcccatttcagaagaaaaacagcaggacaaatagataaatgatagatagatgatagatagatagatagatagatagatagatagatagatagacatagatcatgtcttagtttgtttgtgcattgtcatagaatagcacagacttggtaattacaaagaatagaaatgtatttatcatggttctggaggctgaaaagtccaagatccaggcaccagcatctggtgaggactttcttgctgaattcttacatgacgaaaggcaaatggacaacaaggggatgaatgctgtgtccccacatggcagaggagcagaatagttctttttttagtggaatgagtcaattcatgagggcagtgtctcatgactgaatcacctcccattaaactccatctcccaacactgttgcatggaaaacgaaatttccaacacatgaattttggggtacacattcagaccataacagatatatatatatttccatttatatatggagagagacacagagatagagagggcgggagagagagagagagactgacaaaacaaaaaatgacagtgacctgattagcaggtcagaaaaattttaaaaaggcagtcacaagatctgaaaagtcacaaatgtttggaaaaatcatagatgtttagaaaaatcaatgtttggattcacttagtatgaattcctcaatatcactaataattcagcattgtataaaaatgatgttaatataatggctctgaataacaatgtacattttgtgtaataagtttggacaatttagaaagctttcctctatcctaaatatcatattcttaactatcccaaagatgaagaatttttgaaaagtgaaggcctctcactgagtgagaaattagattgactttgagaatgctaatcaagattaaggaagatgtgcgaaggtcatggaaatgacgggctgtcacacttggccagacttgggtgcttggtgcagtggtgactttgacatgtgctgtcactgagctacccttgtatccagctctgcaactgtgttcctttctctcattaattccaggggatggggtcccctcagcattgaatacaactatttattaacatcttaaacagcgtcatggtcattccagtaatttaaactactactcaagaatttgtggctatttctgttcttttttcacctcatttgagtctcctcagtgtcacaatcagaactctttatctcttcaataactaactagttacaacaagccacaacggtccaatctaaatcatctttttttgccaaaataagcggggacatctattagctcctttgtttctttttgattttgctttttcctattgttttgttttttcttttaagatcttagcttcatcccttaagtatgtaccaccattctaaaagtcctttttataaattcttctcaaagattttggggccctcatgcagaattctttgtgccttattctccagcaatggaacttcggcatctagagatttcaaggtgagcgtattgattccctttagcacactttctataatatatgtagatttctcatgtggtgtaaagcatttaaattattttactagctacttaccattctttcctttcctcaggccttttttttttttttttaaaaaaaagaatgaattctgaggtgataggtgcagatgactttggagtagcaaaataaggctggatttatccatctaaaaaaaaaaaaagaaaaacattaggcctaacagtaaaaatttgaagttgagtaagaggataatgggattagagtgacagtcgcagaagctaaaacgtgtttacgtggaagacagaatcgagagatttaaagtcattctaaaagggtgaggatatctgtaatgaggagaaaaggccagggatgtaaccagggatgttttggtttaatgtttgatgtgcctcctgagtttcttctcaccatgaaatccttgggaaataaatgtatattcttatcaatgctgtagaagttggatttatatttcttcttttgtgaaatattctcacaattacactgtcatccctaaaaacaaggtcctagttttataatacatatctaatgcaaataaaatctcctttctttctgaggagctccatcaactactttatgggtactagattcgtttccatagagtgggtgctctgtttcacctacagattatgttatttaatggctctattggttatttctcttctaatacttcagtccaccgtctcctctacctctctattacaaaacctaggtcctgtgagtttcttttattaaacatctcttgcacaacctttcagaatccaaaacaactatcttcatttttttatcctttatatgagactgcatatagtttttcagttgccaacagtgtccattgaattacatgcacattcaacactctttctttcaataatttttcctcttttagttttcttatttcagtaggtttttggggaacaggtggtgtttggttacatgagtaagttctttagtggtgatttctgagattgtggtgtatccatcactcgaaaaatgcacactgtacccactgtgtagtcttttatccatcaccaccctctcaccttttgccccagtccccaaagttcattgtgtcattcttatgcctttgcatcctcatagcttagctcccacttatgagtgagaacataggatgttcagttttctattcctgagttactccacttagaataaaggtctccaattccatccaggttgctgtgaatatcattacttctttcctttttatggctgtctagtattccatggaatgtgtgtgtgtatgtatgtatatatacacatacacacatatgtgtgtgtatacattttctttatctactcattgatggatatttttgcaattgtgaattgtactgctataaacatgcgtgtgcaaatatctttttcatatgatttctttcctttgggtagataaccaggagtgggattgctggatcaaatggtagatctactttcagttctttaaggaatcttgacactgattttcatagtggttgtagtagtttacattccctccagcaatgtaaaaattcccttttcaccacatccacaccaacatttattatttttttatgtttaaattatggcctgtattagtctgttttcacactgctgataaagacatacccaagactaggcaatttacaaaagaaagaggttttatgggcttacagctccacgtggctagggaggcctgacaatcatggtggaaggtgaaaggcacatctcacatggtggcagacaagagaagagagcttgtgcagggaaattcctgtttttaaaaccgtcagatcttgtgaggcttcttcaatatcaggagaacagcaggggaaagatcctcccccatgattcaattacctcccactgggttcttcccatgaaatgtgggaattgtgggagttacaattcaagataagatttgggtggggacatggccaaaccaaatcatggccattcttgcaggagtgaggaggtatcacattgtagttttgatttgcatttccctgataattagtgatgtcaagcattttttcatatgtttgttggctatttgtatatctttttttgagaattgtctattcatgtccatagcttgctttttgataggattgttttttcatgctgttttgagtttcttgtatattctggatattagtcctttgtcagatgtttagattgcaatgatttcctcccactctgtgggttgtctgtttcttctgttgattatttcttttgccatgcagaagctttttagtttaattaagtcatgaaattaattagtttaattaagtcatgaaatgatcatattgccaaaagcaatatttaagacatgaaatttcatggttatgaaatttttgcctaagccaatgtctagaagggttttttctgatgttatctcctagaatttctatggttttgggtactagacttaagtctcccaccttgagttgatttttgtgtagggtgagagacgaggatctagcttcattctccatgtggctgccaattatcctggcaccatttgttaaatagggtgtcttttccccactttatgtttttgtttgctttgtcaaagtcagttgactgtaagtatttgactttacttctggcttctctattctgttcctttggtctatatgcctatttttataccagtaccatgctgttttggtgactatggccttatagtatagtttgatgtcaggtaacataatgactccaaatttgttctttttgcttagtcttgctgtgactatgcaggctcttttttggttctatatgaattttaggattttttctagttctatgaagaatgatggtggtattttgatggaaattgtattgaatttgtagattgcttttggcaatatgatcattttcacaaaattgattctactcacccatgaacatgggatgtgtttccatttgtttgtgtcatctacaatttctttcagcagtggtttgtagtttttcttgtagtggtccttcactttgtttaagtatattcctaagttttttgttgctcttgtttgtttgcttttttgcagctattgtaacaggggctgagttcctgatttgattctcagcttgttcactgttgttgtatagcagggctactgatgtgtgtacattaattttgtatcctgaaacattgttgaattcatttaccagttctaggaattttttgagtcttcagggatttctgggtatacaatcatgtcatcagcaaacagtagcagtttgacttcctctttactgatttggatgccctttatttctttctcttgtctgattgttctggttaggacttccagtactatgttgaatagaagtggtgaaagtgggcatccttgtcttgtgccagtatatcttgttcccattcagtataatgttggctgatggcttttattaacttaaggtatgtgccttctctgctcattttgctaagcattttaatcataaagggatgctggattttgtcatatgtttttttctgcatctattgagataatcatgtcatttttaacactatacatatgatgtgtcacatttattgacttgtgaatgttaaaccatccctgcatccctggactgaaatacacttgatcatgaattatgtttttgatatgctgttgaattctgttagctaggattttgttgaggatttttgcatctatgttcatcagggatattggtctgtagttttctttttttgttatgtcctttcctggttttggtattagggcgatattgccttcatagaatgatttaaggaggattccttctttctctctcttttggaatagtgtcaatatcattggtatcagttcttctttgaatgtctgatagaattcagctgtgaatccatctggtcctggacttcttttggtggcaatttttaaattaccatttcaatctcactgcttgttattggtctgtttaaagtctctatttcttcctggttgaatctaggatggttgcatatttccaagaatttatctctatcctctaggttttctagtatatgcatgtaaatgtgttcatagtagccctgaatgatcttttgtttttctgtggtattgattgtaatatttcccattctgtttctaattgagcttatttggatcctctctcttctcttcttggttaatctctctaatggattatcagttttatttatcatttcaaagaaccagttttttgtttcatttatcttttgtattttttttgtttcaaattaatttagttctgctctgatcttggttgtttctgttcttatgctgtgtttgggtttggtttgttcttgtttctctagttccttgaattgtgaccttagattgtctatatgtgctctttcagaaatttttttttttttttttttttttgagatggagtcttgctcagtcgccggtgcgatctcggcttactgcaagctcctcctcctgggttcaagtcattctcctgcctcagcctccagagtagctgggactacaggtacccgccaccacgcctggctcatttttttgtatttttagtagagacggggtttcactgtgttagtcaggctggtctccatctcccgacctcgtgatctgcccgtcttggcctcccaaagtgctgggattacaggcgtgagccaccatgcccagccagactttttgatataggcatttaatgctataaattttccttttaacatcgcttttgctgtatcccagaggttttgataggttatgtcactattatctttcagttcaaatacttttttaatttccatcttcatttcattgttgactcagtgattacccagcagcaggttatttaatttctatgtgcgtggttttggggattccttttggagtcgatttccaattttattccactgtggtctgagagagtacttgctataatttcgattttcttaaatgtgttgagactttttttgtggcctatcatatggtctaccttggagaatgttccacgtgctgatgaagagaatgtatactctgcagttattgggtagaatgttctgtaaatatttggtaagtacatttgttgtagggtatagtttaagtccattctttctttgttaactttctgtcttgatgagctgtctattgctgtcagtggagtactgaagtcccccactattccattgctctctatctcattttttaggtctagtagtaattattttacaaatttggtagctccagtgttaggtgcatatatatttagaattgtgatattttcctgtttgacaagtccttttataattgtataatgtccctctttgtcttttaaactgctgttgctttaaagtctgttttgtttgatataagaatagtactcctgctggcttttggtgtccatttgcatggaatatctttttccacctttttatcttaagtttatgtgagtccttatgtgtcaggttattctcttgaagacagccgatacttggtgagttctgccattctgtatcttttaagtggagcatttagaccatttacattcaaaattcatattgagatatgaggtattattctattcatcatgctatttgttgcctgaatactttttttatttcattgtgttatgttttacaggtcctgtgagatttatgctttaaggagattccactttggtgtattttgagggtttgtttcaagatgtagaactcctttcagcagttcttgtagtgctggcttggtagtggcgaattctctcagcatttgtttgtctgaaaaagactgcatctttccttcatttatgaagcttagtttcactggatacgcaattcttggctgataattgttttgtttaaggaggccaaagataggactccaatcccttctggcttggagggtttctactgagaaaactgctcttaatctgataggcttttctgtataggttacctgatgcttttgcctcacagctcttaaaattctttcctttgtctttaagtaacttgatgactgtgtagttaggtgttgatctttttgtgatgaattttccaggtgttctttgagcttcttgtatttgaatgtctaaatctctagcaaggccagggaacttttcctcaattatttccttgaatatgtctgtcaaactttcagatttctctttttcctcaggaacaccaattattcttaggtttggacatttaccataatcccaaactttttggcggctttattccttttttaaaattcttttttctctgtcagattggattaatttgaaagccttgtcttcaagctctgaaattctttcttctacttgtttgattctgttgctgagactttccagtgcattttgcattcctctaagtgtatcctcgattttcagaagttgtgactgttttttatttacgttattttattggagatttttccattcatatcctgtatcttttttttttttaatttctttaagttggacttcacctttctctggtgccttcttgatgggcttaataatcaaccttttgaattctttttctggtaattcagaggctttgtcttggtttggatccattgctggtgagctagtgtgatctaacagaggtgctaaagaaccttgtcttgtcatattaccagaattttttctggttccttctcatttgggtagactatgtcagagggaagatctggcactcaaaggctgctgttcagattcttttgtcccatggaggtgctcccttggtgtggtgctctcctttttcctctagggtggggattcctgagagccaaactgcagtgattcttatttcttttctggatctagcttcccagtggagctaccaggctctgggttggtagtgggtactgggggggtgtctgcaaagagttctgtgatgtgatccatcttcatgtctctcagccgtggatatcagcacctgctctggtggaggtagcagggcagtgaattggaatctgtgagggtccttagttgtagttttgtttattgtaccagttttgtgttggttggcctccagccagggggtagcactttttgttctttttttttgagacagagtctaactctgttacccaggctggagtgcagtggcgtgatctcggctcactgcaagctccgcctctcaggttcacgccagtctactgcctcagcctccagagtagctgggactacaggcgcctgccaccatgcccggctaattttttgtatttttttttttaatagcgatggcgtttcaccgccaggatggtctcgatctcctgacctcgtgatctgcctgcctcagcctcccaaagtgctgggattacaggcgtgagcccagcgccagagagtagcactttcaagagagcatcagctgctggaggatggggaggatcaggcggtgggcagggccatggagctcccaagagattatgtcctttgtcttcagctaccagggctggtaggaaaagatgatcaggtggggcagggttcagcgtgtgtctgtgctaagactgtccttaagcagggcttgctgctgctgttctgggggatggggtgtggttcccaggccaatggagttatgttcccagggagagtatggctgtttctgttgcatcacacatgtcgccagggaagtgggggaaagccggcagccccaggcctcacccagctcccacgcatccggtagcctgaagggccagtctcacttccaccatgtccccgcaacagcacggagtgtattttcaggcagccggtgagtagggctacaagcctccagctgagaaagcaaagccaactcacagttccttggctgtcccgcggagcctgcggtggcaaaccacctccttcagaagggtctgtggattctcctggcttttctggtatgttcctgtggtagttcttggagcagaagttcatgatgccagtcttcataggcggctctgtctgtctgagtgggagctgcaggttagtctgggctcctttccaccatttttttctcaataatttttcttgatccactactgtgccaggcattttgtagtgttggacgttggaagacacataatatagacatggttcctgtcgtattgcagtttatattctaccaacaagcgataaactaacaggaaaatatatgagtataaatgctacctacactacaaaggaaaagaacgatggatgtgtgagattgagagaattaaatcttagtttgggtggccagcaaaggccatcatgggaagatcacacttccttaagctcttttttcatcttttaaaatattcatactaacaatcacaatttgaaattgtacatttatttgtttatatatttattttaagaaatgtaggaaagtgcaaaaactgcaaaaatctctaaactacaatacatgttttgcaagctcagttgattacttcttaaatagtcatatcctgaattttgattatacaatttgcttctattccttttgagttcttcagaaaatatttaaagtttcctttactaaactttttgaatgaatttacatttttttttcctattaatggtagcatagcatgttttaaagttctatttttgctgggggcagagtcttacttagcttgagggttacttgagcatttttattagcagcagctttattatctatgattagatttcacctgggccaattcattactctcaccttccacacttcagagtaggtagataaacttaaaaatagtcaaaggaacaatttagggcatagtttacaaaataaatctagcctctaagtaataaccagcagaaaatgaaaaacaattttttttttattttggtgcattaaatgaaaaatacaagaaaatatgtatatattttggatagaatttgcaggttgtaaacttagcagaggccgggtgcggcggctcatgcttgtaatcccagcactttgggaggcttaggcgggcagatcacttgaggtcaggagtttgagaacagcctggccaacatggtgaaaccctgtctctactaaaaatacaaaacttagctggccatggtagcaggcacctgtaataccagctactcagaaggctaaggcaggagaatcacttgaacgcaggaggcggagcttgtggtgagctgagattgtgccattgcactccagcctgggcaacagagtgagactccatctgaaaaaaaaattaaattaaattaaataaataaacttaacagaaagttaagcaaacacaggcttcccatatgaagtaattagcattttgcaaagagggaacatggcattaataaaggatcctagacttaggatctccactactccatttaaaattggatctttttgaattcacggcaggttttccttaagaaacaatgtcatacatgatggcttagtgtactggtcaatccagggaaactgatttaatccataatatgacatttgggataatattggactagaccaacatatattgggaccatcatatatatacaatgcttattaaaaagatgtctatttaaggtaagttcctgaaaaatgaaaaataatagtatgctgagcaaacaatatgctacaacagaagttcaaaagaaaccgaacaaccgaaaccaaactgaacaaacaggtgtgaagaattcgatgggaaagaacagtgagaaatggtgcggttggtttctgactttaagtcacattgatttttttccacaagcaccatgtaagtattggaatgcctcttaaaactaagttgtgctaacttggctgggctgctttataaactctttacaaaatttgattcatgttttatttaagattacatttgggaggcaagtccctaggacttgagacaagctgcagcattcacctgcaagtgtggcttgcaaatcagcagactttggagccattggaaaaggctacttccagctacaaagtgaaaagatataagcagcgtgtgctgtagactgaggtagtatcttcgagttctgtcattggcacctatcagtggctgagatatcctgggttgaagtctgcaaggtccagcataatgtattatgcatgaaaagacatctcctgttacttcatttttgtaaaagattacctcaatactccttaagggctggatgacagtgtgtgaagtggctgaaacttacatcaaatgctttaataacaggtcagcaaaaaggccaatgggcttaacttttacattccaactggcacagctacaggagtgggctatttgccaaagacatcgaaccaagcctcggagaagtagaaacagctcaaccaggttcattcagcagagaatcgtggttaaaatatattaagcctggattcctcaaattctgttggtaaagttaatcgggatagggtaacacttggcatccttatgctatgactggatctctcatgggaatgagatcttagctttaatttttagaatttaattaaagcttcacaagtataaatataaaagtacttgttattgttgtcacctctgttctttagcgatgacaagtaacatcttatttgtgctaacatgaggaatccatatgatatagatttaaaatatatcattgtgtaagatcttattttttcaccttaacgttggcacctatgtaatttagctgaaacacttttagaattcaagtgagctatgcacacctctggggaaatcttgctggccagttttccagcgttcccatacagggatattcactctttggctgagcctttgcttaattgtattattttagatgatgggttgccttgtgagtaaatgatgaaaagatggaagctaaaatatacagtagcacacaccagccctgtggaaaataaatagctgactttaaaagaatgttgttccgaaagtcaagggcaattttaaagaagcagtgagtaggccaactcagtaacgagtcacagtggtgtactcattgctcctcagaggctcacatacgttctgggtgtgtgtgtggggcccagcctggagactgagagacaacattcttcacctagtgaggatggtctaaaaacaaatacattttaagaaactaaaacctaataatatcttggccaagttatgtattataaaaacaaagctaagaaaggtgagctaatgaatgaaaattagaaatacaagttctgcaatacccgtggcattcatgggagtgctgggttaatttatttaaaattgcacccgctggcagatgcaaaaaaaaaaaaaaaaaaaaaaaaaaacagaacattatctgtacgttatcctgtacttcttgccctcatgggtaacatttttactcatttagagatcaacccagcacttttcactgctgaccacaaattgttttacaaactttcatgttgattttaactggattgccagatttgcctcacagcttgaagcaaatcacatcccatagtatctgataagagcttgtaaaatagtggtacatgtttcatttaagggaaagaatagttgcctcagaaaccgtctggtctgttaactaggtgactggatggaattgcgagaaacacactatggacggacccttacacacagaaccgaacactggccccaatgtgttttgggaaaataatccttcaggaatgagcgtattagctccagatatcaaactttaatagtagagaaattgcatgtattattaaacaccaactttacatttgaggtctatgggatgcatatttttctttcaaaagttctacttttttcaggatggggatgaaactgtatcaccacccaaatctaggatacttttacttctacagtagtgaaaaaaaattccatatagtttttttttgcaagttgtaaaagcatacatgttcacatacacctgccccttcttctaaaatttttaaagaaaatgtttctgtcttatttacagctccctgaaaagtaatgttattaaaaataaacgtgtttatttgactggacacccgggtttaactacccatgagagaccgcagtgctgtggttcagtatcagatgtgactacccacaagaggacacagtgctgtgactcagtgtggtcaaggacaatgcctgctacgtgccttacggaattagaaaagggggcttttacttgtatttattggtctttaaaattttgttgtttatattcagtaaagcaatactgaaaaaatgtttttgccataaattaatatcattataacatcagaagagaaaaatctccaagatattttaaggagaattaaaaatagtaatatcaagtaaatcagccagtatttatacgttcacatcacactatgagaacgaaaactcactgtttcttgtgcatattcaaataaataacaatatgagtgtaaaatctttcaattcttcagtctgttgaaaagcctgtggaaaaactagaatctatattccaggtactccagagtatagtaatgaaaatacttatattaaaaacaggacggcgggcggtgtgcagtggctcacacctgtaatatcagcactttgggaggccgaggcgggcggatcacgaggtcaggatatcaagaccatcctggctaacatggtgaaaccccatctcaactaaaaatacaaaaaattagctgggcgtggtggcgggcacctttagtcccagctacttgggagtctgaggcaggagatttgcttgaacccaggaggtggagcttgcagtgagccgagatcacaccactgcactccagcctgggcgacagagtgagactctgtcaaaaaaaaaataataaaataaaaaaccagagaggatatgacattttttttttgaaaagtgagcagttagaagttacaaatttgatatgtaattatatacaaaatgcaatttatagatatattttctaggagccagttgcaccatcagtgcattagccctaagcctgtgtttcagacttgtgaattagaagcttctgactctcaagaggaggcctcaaggctgagagtgaagaggctgccagtccacgcatgacagccaggggtcagctctcagctcgaaggaaaggatcagcacaggaaatattttacagccacgaagaaccttgaccttttccactcttctctttttcctatttccccttctccagccccctcctctagctcatcccaataatagagtaaaatcaaagcatcctgaatatttactaagtgctacataccttgtgaactatttcacttgcagtatccctaatacagtttcaataaaccatgaccagtaaagtaataagcattgtttgaaagaaaaaaatagcctaatacacttcttgtcagacacacaaaaagcttttcttttgtacatgtctatggtaaattgctttgcatgacagcacataatctaaccaaagtggatgttctctgtttgatctgattgtctgaacaaaaaaaaagcaggtattctaaatttctttctttaatgaagtatactccatgagagacaatttcttattaaggcatatttggacttttatcaaacctattattgatctcttcatctttttccccctgctagtccaggaaatgggagctactgaaaccacaggatctgctcacggcttccaaacactctctgcagacaatatgaccacgtccatgtcctcctctggctcctgtgaggcccttttcatggaccccaggccctttcctgtttctcccagaggaggaagtccaaggcagggtctgcatctccctcgtctttgcaagccccacaacagctctcctggacagtgtctaaactaaaacttcttggctgtttagtctggttatacgtgttacaaattccccatttcctgtggggttcacagagagctacaaaattatagtaatacttcaatagaaatttctgactccatttttcaaatattatcaaatcttctaaggttctaagaccctttgctgtgaagataggtagagaaccactctaatacaaaacagcgtttgtttttctctctcaaagggaattgggactgtttggaaagtcatggaaatttgctatatactttaaaaatctagaatgccttcccaactggcacactcaggatatgaggaagcaatgtcactgcaaatcactcctgaactacatttaaactgagttacttggtttagcttgagttttctctccaggcccacagcatcctcagaactcttgtcatcaaggcttaggtagaaacctctcctcttcaaatcgtgccttcctttcagatctagttaattctagtcaggattctaggaaggcctccctctgaagacaatgcaaaaataaaaagagcgacagaccttcctttagttgacagctttccatcattttccgaatcaactgtgattcaaactttaaaaaaacccaagttagtgcctgatgactccctagactctgggacatctggtgctgccaaattgagattcccctgacaatttccgaggacaaagatcttcgaggagggcagctctagggagagtttagtcacctctgaagttgtgtctcacagacgcagcatccactgacccctgactttcagttcatattttagaactgttcccaggggatggagataaggcagtcatcaatcaggaaagtcaaacacatgcagatgactgagaacagctctccttgaatcccagtcatgggagttgaggaatgaccattcctctacatagttctattaaaaaaagtgaaataaaatttgttctattttgttagagttgcagaaataagacaacaaacacaacctcaattgggttaaaaaccacacagctctggcagcaatgttaacatcatttacatcaagttccttggctaaatgagcaatttccatatgtctagtttacatgagctcaattgtaagtgtggtagaattggcatcaaataaatggcatgggttcagatctggttttgattaccaagatttctagagtatgtttttgtgtttaactcttttttgtaactttgcccgtgaatgtttgtctaacttctgcctcatgagcactcagtttcaattccctacatatgtctatgctttgcaatttgtatcttgtagtccttgccggagtcccactgctcccgaacacatgccctgaggcagcgtgcctgcacaaccagcttccatctgaacgcttcagacatgcgctgcattcaggcaagagccctttggatcttcccaattagagcaaaatcgctagcatttaacttctaattttacaagtaacagtgatttgcaattagtaacagacatcaagatgacttgtgaccagcattatacatgttattaatttgcactcatctataattaattttacaatggcatttagctcaatgcttattataggaaaatctgtcgttgagaaccaggattattacctctacaaatacattattttctctgtaaaagaactctgactactttcaccagaagtacatttttaaagttagtattttgtactcgtagaactagattaaataatatctcgttgagtgaacgatattttaagattacaagctgaattgcttattatggctttctaaattcatacctgttctgcagcagaatatttaaaaatttaagtattgaaaatagtctaagcaaagaaaattgctacttgttaactttggaagacttgaagacataaaatttcaccaaatgacagatttataaaaatttctttttgggggaatgttcaagtattgtgaaactgttactgaaaacaaaacattaaagcattagcacgtgttttaaaaagcaataagacaatcacctctgtaagaaacacacagctaattattatgtgttctagagaatgctgtcacaatcagtcaacttacagaagcatgattttctttttattgaagttgtccctttgcaaagggtccctttagatattatttctgtgaataaataattcactgtcttcttcatactcaaagatatgcttttgagatatatgtatatatgactctttagtatgagcttaatttttttctccagcaatggctgtaagaatgcacagactacaagagacaatagtgagaaagctgagaaagctggtgatccacaccctttccattggaagcctacagggagctttcccctagggccccacgtggtcagccttagagcgactaacacttcctaattcaagaaaccaacccttggcccctgcacagcgagaaccaagatgaattgattaatgcacagtgaaaactataattctcacaaagacaaaatcttgtcagcaagtatgtctgtcccccatagcctggtgtttagcaaatgaaatatttgaaattcagtgaccacaacatctgctcctcaggccagtatctggatgcttattgtccatgttcaggtacatccatctcaaaggatgtagagccacacaccttctttcatcttacatcatttattttgttatttcctatacagggcagggacttttcttggacagagaagctgagaagtatcagataaagatgacctgcatgtactggaaaataatctgtggtttatatgtaggcggatggaagcaaaccagggtaatatacatttagaggcagagggctctcacaatatcctcttcaaaaaacattaggatgaaaacagttgcagaacatttctagtaaaatatatcattaaaacttaggctaacttaactctttccacctacacactttagtaatttacaaatagcgtttaagcatatatttcatttaaaatagagtccacatgattgaaatagttatgaaactctgagagactctcaatagaactcttagctgcttattactatctcctaagaaaacaatttaactaccctcttctcattaaaaagtaaataaaaatagtcttcatgatattgtaaagatctaataatgcttcctttgacttgtaggaacaaaagaagaatttgtagttcacagccacatgagatagtcaagtgttaaaagggaaaaagagctatcgaaggcaggaagcaaaatgccttcagagataaaaggttattcgtggctgagtgaaaaaaatggacaatgagcagaaaataatttatactacaaagtctttagacgtcatttacttggtaagacattatagaaatatttttggccgttttgtttgctttaaaatccacttaactacaaagtgacttcacagtttaaaaatgacataacataatctatatggtactacactgataatatcatctaatctttcattatgctgtgaccaagtcttctgttaaaagtctaattttaacctggcacagtggctcacgcctgtaatcccagcactttgggaggccaaggcgggtggatcacaaggtcaggagttcgagaccatcctggctaacatggtgaaacaccgtctctactaaaaatacaaaaattagccaggcgtgggggctggagcctgtagtccaagctattcgggaggctgaggcaggagaatggcgtgaacccaggaggcggagcttgcagtgagctgagatcgcgccactgcactccagcctgggcaacagagccagactctgtctcaaaaaaaaaaaaaaaaaaagtctaattttcttgttgtatcaacatttgatgtccaatatgatctttaagcagctataaaattatcaaaaattaatgctagaagaaatcttaacttatatctttcttgagataacagctctctacatttcagtcttttttaactgtggttttagaatttctacctctagaataagaaaatagaaaaaaattctttttttgagacggagtctcattctgtcacccaggctggagtgcagtggtgccatctcggctcactgcaagctccgcctcccaggttcacgccattcttctgcctcagcctcccgagtagctgggactacaggcgcccgccaccacgcccagctaattttttgtatttttagtagagacagggtttcaccatgttagccaggatggtctcgatctcctgacctcgtgatctcactgccttggcctcccaaagtgctgggattacaggcgtgagccactgcgctgggccagaaaaaaattcttatgccatttttaactgaatatgtccataaaatgaagtggttctaactaattagcactttttcaaacattggcaaatattatattatttattctctgaaaatacctacaagttatctccatacacctatgcatccttcttattctacagatggacggaaattttaaaattgtaaaagcacctctgcattgctatattagttccctattgctgccgtaacaaattactgtaaatgcagtttattaaaacaacacagacacattattttaccatctggaggacagaaatccaaaatgggtcttcagggctgcattccctctggaggctctaagagagagtctattgcctttccatctccagcttctagaggctcctgccttccacggctagtgaccttccatcactacagcctctgcttccgtcatcgcatctcctcctgcctccttcttttccttataggacccctgattatcttgggcccaccttgtaatgtaaagtaaactcccatcttaatatccttgacggggcgcgatgggccaggcctgcaataccagcactttgggaggctgaggcgggcggatcacaaggtcaggagatcgagagcatcctggctaacatgctgaaaccccatctctacttaaacaaaaaaaagatcctttatcactgcaaaggcttttttgctatgtaacctaacatgttcaaggatcccaggtactaggatgtggacatctttgcaggatcattattctgcctggtacagctgcctagtgttcagtgtccactaaaacactttatttctctgctaatattttgttgaggattttgtgtctttgctcaggaggaatctatattgctttgtaattttctttccttctgacatctttttctggttttgccatgaggcctaagttggtctcaaaaacaaagacagtaaatgttcttttctgtcttctgctagtgtctatataaaattgagatgatgtcttcctttaaagtttgatagaattcacacttacgtttgaagtgcttgaggaaatgtttttagttataaattcaatttccttaatttctctttttggtaatttgtgcccttgagaaacttcacgtcctctaagattcaaatttattgaaatgtagttattcgtgttgttttttaaaaattatctattggatgcatagtaatgtcccttcctccaagctaatttttgatgtctctacttagtagattatcaatttttgtcaaagaacaagcttttttgtttatattcatgtttccctgttgcttttgtccatttagtatttcattgttttcggcactataattacctacttactcttcattagttttaattttctctttttcttctaatttcttaaggtgaaatcttatatcactgattttgtgcctttcttatgtatgaatatatgcatccaaagttctaaatttccctctaacactgttttctcggcatccctcaacctttagcatgttgattcattcactgtcattgaatttaaaatattttctaattttatttgtaacttttttcatgagctcatgggttatttggaagtatatagtaaggatgttataggaaaatcagcttgagtatttctcacaaatatgaagttggtttaatattaaaaaatcagtgtaatataccattatcagtaaaataataaagcatgttaatctctacaaatgaaaagtattcacaaaattcaacatccattcatgatgaaaaattatcagaacatgaggaatagaaaggaatttgtgtaactttataaaggacctcttccaagaaactgaatctatcctcctaatggtagaagaatattttctcccctaagatgagaacaaggcaggaatgtccactattacttctttcctgtattgtactggaggtcctgccagagttagatgcactgggcaatgaagaaatacaaaaataaaggtataaatttgaaaggaagaagaaacattgttaggtgacagttatgtacatggaaaagcctgagaatctaccaaaatgctaccagaactcatatttctatgtattaccaatgaacaattggaaattacaatttaaaaataaatgccagatattttaaattttattttaagttcaagggtacatgtgcagtatgtgcaggtttgttacataggcaaatgtgtatcatggggatttgctgtgcagattatttcatcacccaggtatgaagcctggtacccgttagttatttttcctgatcctctcccacctcctaccttccaccctccaataggccccattgtgtgttgttcccctctatgtgtctgtgtgttctcgtcatttagctcccgcataagtgagaacatgctgtatggttttctgttcctgcattactttgctaaggataatggcctccagcttcatccatgtccctgcaaaggacatgatctcattcttttttatggctgcattgtattccatgctgtatatataccatattttctttatccagtctatcattgatgggcatttaggctgattccatgtctttgacattgtgaatagtgctgcagtgaacaaacatgtgcctgtgtctttataataaaatgatttctattcctttgggcacatacccaataatggggttgctgggtcaatggcataaataccattttcaattttattttattttttatgtttatattttttgagacagaatctcactctgtcacccaggctggagtgcagcagcgcactctcggctcactgcaagctccgcctcccgggttcatgccattctcctgcctcagcctcccgagcagctgggactacaggcacccgccaccacacccggctaattttttgtatttttagtagagacggggttttaccgtgtcagccaggatggtctcgatctcctgacctcgtgatccacccgccttggcctcccaaagtgatgggattacaggcgtgagccactgtgccaggccaaataccattttcaattttataaaaaaataaatatttagggatatgtctggaataaatgtgcaagatgtagcatagagatagagatgcagatcaatggtacagaatagagaatacagagggaaacctaaaaaatatggtcaattgagtttctgttgctctacatcctcgccagcatttggtgctgtcagtgttttggttgtaaccatttagatatgcaatgctattttgttttaatttgcacgcagtatccagttgcttcagcatcctttgttaaaaaggctatcattattttccctttgcattatccaggtgcctttgttgaaaatcaagtagccatgattatagtggtttatttttacactctgtattgttttcattgatctatatgtctatccttatgcaaatatcagactgctttaattaccatagctttatagtaagctttggaatcaggcagcataattcttctaattatgctttttcttgaaattgttttttgacagttctaggggatttttgtttgttcgtttgttcatttttgcttttccataaaaattttaggattggattgtcaacttctttaaaagcttggtagaattttgataggaattgcactgaatctatagattaattgctgtcttaacactattgaatcttctgggcatagatatttctgcatttgtttagaatgtaagcatgtatgtattttttctcagctctttaagtttccagtgttcagatttttacacttgttttattaaatttatttctaagtattttattattcttaaatgggattttcttaattttattatcagatgttttgttactaaaataaagaaataaattgagtttttataatcttgtaatctgtgacattgctaaaattatgcattagttctataattttataattccctaagattttctatatacaataatgttttctatgaataatgactttcatttattacttaacattatttcaaagaaacaactataatatttttaaatttctttttaaaaagtgtattcagaaatcttttacgaatagcattttacattcgccacatataaactgcatatttcctttcaacatcttaattaatatggttccattaactgaaacctggcccttaacaggttatccatagggacacgggagtacttactgtgccatccagaggttacttcctgcaggattatagaagctgttcagtttctgttaattcctgaaattcactagcctgtgtgagtctcccaagctgtcaatagtgatcatatggatgactagcaaaaccttgaacatactgtaggcaacagtagctactcaagtattagttgaatgagtttatttctgactcctcctcatcctcacatcagtttgtcttcctaaagggacattaaagaagaggcataaagttcaaacttgaaagtacaaacttgattaaggctcaagctcaaacttgattaaggctttcatctctctgcagttgggataggtagatataaaaccttttactacatcttagactcatctactgtgaattaggttcatttacatacaaacacatacacacacacacaagaaaaaactcaatgtaaacataaatgaaaattcttttaagcaccatttccaggggaaaataatgggaacaaaaaattattttcctgtaaatcctttaatcctttctttagaaaaagtcacattccttttttttctacttctgtcctaatttctgaagttcctctgagaatggattgtataatctgaaagcgttttagacacatgcattatgtctctctttttgaatgcctaagatactggaggaatttaataattaccttttatcttaaagataaaatatggcttcatttcctaaaagtcaaaggactgtcttgtggtgtccaattctgagctcagatcagtcatctcagtcagcttgagctattattactcttagtctaaaaattatttttgttcccctatatatagcccccctcacttcttccttaagagactgagaatttttcaagcccactcatatcaatgtgatatcgtagattcgattaaatgtgatgttcactgttttttgtattgaaaaggcatgactcctcatgtacaagatgattctacatttttgaattccaaaataaatttgtttcaatgttgtataagattgaagatgtccaccctgatgtttttccaaacaaactataaatggtcttaatatgactgcctattaaattatatttttaaaaagtagatcctattgttttttcatattttaaaagtcaatgttcactgattttctgataagctatacttcatatatgttcttttatataaccactgtatattcaaattggatgcttgctattagcatgaagggcctctttattaactgattttgtacattatctagtataaggaggaagccacaaagaatacatcatattttccaaatgcaggtagaatctcatatgagttttcactagaaaggaaaattaaattttctttttacagtttttggcatggtccaaatacaggatactttgtgagacaaggatctgggaagaaagaaaggaatgatgtgtttatattatgcttgtgagtaagtctaggactacagctttatcactgaactgaggtcttgttgttcaccaatcaatgtaatagaaatggcagttaagaaacagatattcatgccaaaactagaggttgcattcaagcctgcattcagagaagttaaaagttctaaaaacaaaacaaaatagaaactagagctaaattaaccttggagaattaaaagtagactaaagacagaaagaaatgaaggcagattctagaaggcatattttcggcctcaagattggcctaatatggatgaaagcctgaatgtgctttctccaaaaatagagaggaaaattcctttgtgtgtgagacctcaagtctttaaggaggtgtaggatggagttttatagactaaaattatcaagttcaaatgagcaagtgttacattttcaagaaagaaagagctggatcatgtcaagggctgaggttgggaaacacatatgaaacctggaggtcacattagttccagaggtgctgatgtgagagacaaaacatgttagtgaatgcaaatgaccagtttggattcatttattcaacttaagcagagagcagaatttcctctgggtcatagtctgctcttgaaaagtgtagaataggctcattaatctgatagtctatcctccagcaaacattactgtcaaaagggacaatattagtaaataaaggaaagcaatatctcctgtttccaaccaatgaatgatctaggtaatttcctcttatacaataaatgaaggatattaaatgtgtatatacatgtgtgtatatgtgtgtatacatgtatatatatatatgtttgaccttctccatacatttaaaaaattaaattgtagtatttattgacgctttcctgatctttgctagaaataattgctctttattatacttttgggagaatatatccatgtaacccttttttgagaattgacaatgtagaattctcacagaacaaaggatctcaccaaaaacatgttttatttcacttttagtctctgggttctggtataatatacgtgctgagttttagcacatttttagtaaatttgctttgcttaaagctattaattagaattacatatagacaattagtcatgctttacgttttacctgtagagagaactgaacactattttaaaataagaataactggagttgcaagaaacggaaacaacccacagagcactgtcatagccagttggcgcttcattacatctttccacaattacttagaattcgctggatgaaacatttgctacaaatcattgctaatgcagcatcttaaataacctcaaaatgagccggtacatttctattaaactgccttaatgaacaatttaagaagtaaaatactccactatgttataatgcatttttttctccctcttcacatgttatttatgttgttgattttttttgtagtactaattttcacaactaggagaattgctgataatagaaaaatttctccagagaattctggtcatcccaagatcccactggccagtgcaagatttttgtgggtgctttatacagtaaacttttctctccatttcaaatgtcttcagcatttttttaggaggactgctgattgtctgctcaattatagtagagatgtttaattctatttgcaatgctcagtaatttaaagaaaggtggaaaaggagtcatatgaagagccacagagctcaatgatattttaggttttgctgatgtttttacgttttctcttaaaattatgtttccaatgtaatgatctttctagttacataaaatagaagaacaaagcactctggaggaagaatggtgctaccagcatgcctccttggggttggcagcctggctaggtagttttgcagggttcttgggtagaggtaagccagttgacataaagaatccagcaaacttccaggagagccccaggcctcttgcttgcctgaagcagaaatatgacacccatactgagaaataatgggagatggccatgctccatcactgtagaatataaaggtaaagaagaccctcaaataaacctgcaatgaatgggaagagccaaggccagtaggggcttggccaaccacaagatgggtcattgtgctggtgtggaagggggtccactgtccgggagggctggttgtggtttggggacagggaagaagtgagtgtctcaggatcagggcagttgctcatgccacaactattgtggcctagctttaagatgaagaactgtgctcagctgaaagagcactttcagcagataaaaggaccaaggaccttgaattccttccccatttggtgtggtggtgtctcatttggatgaattcgtcttaccttcagccattccccgttcggtgtggtgttgtctcatttggatgaatccgtcttaccttcagtcattccccgtttggtgtggtgttgtctcatttggatgaatctgtcttaccttcagtcattccccatttggtgtggtgttgtctcatttggatgaatctatcttactttcagtcattcccttgatgctgcaattgtctgtgcataatcctctagcaggaacatcactgcagatggcttttataaaatgtcaaatagtgtctctaacttctaattttagagctcccagagagggctaagccccaaagtagctcagtctatgtctggagtcccactagggtcttgtgaaaaaagttcttacctagtatattcttacctagtatagtttgtatatgttttgcctccaaatcgcacattgaactgtgatcccctgtgttggtggtagggcctggtgggaggtgtttgggtcatggggcagattcctcagaaagggcttggtgccgtccttgtgacaatgagtgacttcttgctctatcagttttcctgacattgattgctgaaagcatcctggtgcctccctcttctctctctccctgtgtcttgcatcccctcttgctatgtgatgcctactcttcttcaccttccgtcatgattggaaacttcctgaacccctcaccagaagcacatttaacactgatgactagtaccatgcttctcaaacatttttatagtgatattttcttgacacttcttgcatcactgggcttctcaagcctttctttaaatatgagtgttggccacagctctatctttagactcctaatgttttcacttggccacaatggccaattaattgttgaagattccaaaatctatacctctagcttagtatattttgctgaaataaagactctcacacccacatgtccccgggtcatatttatgtgcacatgccacaggttgctcagatttaggacttctggcccatttttgattccgtctcttcatagtcacatccacatgtcccatcaatataaccaacttccaaaaagttctctctctccacactccccttaccttcaccactctttaaaacaatggctaaatcccactaaccaattttattacatctggtgtgacacctccccttcaccttcccagctgctgacagactgacttttctaaaacacaaatctgtatcagtcaattttcttcacaggaaactcctgccttcttgaagtcagcctaaatttgcccagacctctccactgttatctcctttcactccctccatatgtatgctttctccagctgaatggagtttcctgccactctgcaagttttggcatgatttccgcctctgtgtgttcacacagaccggtcttggtgaacacttgttcctgttctcaggtcccttcatctaacaagttctcaacttccttcaaattcagctctagtgtcaagaccacctaaagacttctctgcacgtatccacctctgtttttgcctcctgttacggtgcaccctgtaaacggcgctatcattacactatttcctccggagagtgaggctgtagtttcatgatactagttaacacatagtacttcacttacgcctcacaagtaacctaataagaagagacacttacgattatgctccttttacagatcaataacatgagagacagaaaattgaaaacaaaaaattaactaaggccacacactaaatggcctttgcacctcacagaccctgcgcccatcacagacgccgcgcccctcacagacgccgcgccgcacctcacagacgccgcgccacacctcagaccctgcgccgcacctcacagaccctgcgccctacatcacagacgccgcgccacacctcacagacgccgtgccacacctcacagaccctgcgccccacctcacagacgccgcgccacacctcacagaccccgcgccccacctcacagaccccgcgccccacctcacagacgccgcgccacacctcacagacgccgcgccacacctcacagacgccgcgccacacctcacagacgccgtgccacacctcacagaccctgcgccgcacctcacagaccctgcgccctacgtcacagacgccgcgccacacctcacagacgccgcgccacacctcacagacgccgcgccacacctcacagacgccgtgccacacctcacagaccctgcgccgcacctcacagacgccgcgccgcacctcacagacgccgcgccacacctcacagacgccgcgccacacctcacagaccctgcgccgcacctcacagaccctgcgccctacgtcacagacgccgcgtagcacctcacacaccctgcgccgcatctcacagacgccgcgccccacctcacagattcacagacgctgcaccgcactgcacagacactgcattttcatagatactgcatcgcacttcacagatgctgcattttttctacacagtgaaggtttatggcaattgtgtgtttagcaagtctattggcacagttgttttttttaaaacatgtgctcactttgtttctgtgtcgtattttggtaattctctcaatacttaaaactttttttgttatgattacatctgttatggtgatctgtgatcagcgatttttgctgtggcttttctacttgttttggggcactacgaaccatgcacatatgaaatggcaaacttcattggtaaatgctgtgtgtgttctgtgtgctccagtgaccggcattcctcggcctccctccctctccacaggcccttttattctctgacacacaatcatattaaaattaggccgattaataacctcacaatggccgctaaatgtttaaataaaaggaagagttgcacatctgattttaaaatcaaaagctagaaatgatgaagcttagtgaggaaggcatgttgaaagctgaaacagaccaaaagctgggcctcttgtaccaaattgttagccaagttgtgaatggtaaggaaaagttctttaaggaaattaaaagtgctactccaatgaactcatgaatgataagaaagcaaaacatcctggctgggcacagtggctcacgcctgtaatcccggcactttgggagactgaggcaggtggatcacctggggtcaggagttcaagaccaaccagcctggccaacatggtgaaaccccatctctactgaaaatacaaaaaatagctgggcatggtggcagacacctgtagttccaaccactggggaggctgaggcaggaaaatcccttgaaccagggaggcagaggttgcagtgagctgagatcacaccactgcattagaatctgggcaacagagtgagattccatctcaaaaaaaaaataataacagaaagcgaaacatcctattgctgatatggagaaagtctgagtgatctcagtagcagattaagccagtcacagtattgccataagacaaagcctaatccagagcaaggctctaattctcttcaattctatgacgactgagagaggtgaggaatctgcagaggcaaagttccaatgtagcagaggttggttcatggggttttaggaaataagcaaccttcacaacagaaaatgcaagttgaactggcaggtgatgatgtagaagacgcagcaagttacccagaagatttggctaagattatggtggaggatggccacactaaacaaggttttcagtgtagataactcaaacagccttctaaaacagccctctaaaacagccttctattggaagaagataccatctaggattctcagaggtagggaggaaaactcaatgcctgactcaaagctgcaaagggcaggctgactttcttgttaggagttaatacagctggcaactttaaattgaagccattgctaatttactctttcaaaaatcctaaggccctcatgaattgtgctaaattctctatggatggtccctaaatgaagcagcaaagcccaaatgacagcactcctgtttacagcatggtttattgaatattttaagtccactcttgagacctacttctcagaaaaaacatatttttcagaaaacattactactcgttgacaatgcaccaagccacccaacagccctgatggcccaatggagatgtattaggagattaatgttgttctcatgcctgctaacacaacatatattctgcagcccatggatcaaggagtaatttcaaatttcaagtcttattatttaagaaacgtatttcataaggctatagctgtcatagatagtgatttctttgatggatctgggcaaagtaaattgaaaaccttacagaaagaattcaccattctagatgccattaagaacatttgtgattcatggaatcatggaaggaggtcaaaatttcggcattaaaaggagtttagaagaagttaatttcaaccctcatggatgattttgaggggttaagacttctgtggaggaaataatacacttgtggtagaaatagcaagagaattagatttctaagtggagcctaaagatgtgactgaaatttgcaatctcatgagaaaatttgaacagataaggagttgcttcttataaatgaataaagaaagtggtttcttgagatggaatctccccctggtgaagatgctgtgaacactgttgaaatgacaacaaaagatttagaatattccacacactgatttgataaagcagtgacaaggtttgagaagattgcttcaattttgaaggaaattctacaatggggaaaatgctttcaaatagcatcgcatgctacagagaaatcattcaggaaagaagagtcacccagtatggcaaattgtattgttatcttattttaaggaattgctacagccacccccaccttcagcaaccatcaacttcatcagtcagcagccgtcaataatgaggaaagagtctccctctgccagcaaaaagattatgactctctgaaggcttaggtgatgattagcactttctagcaagaaagcatttttaaattgacatatgtactttttttagacacaatgttttgcacacttcatagactacagtataatatagatatgatatttatatgcattgaaaaaccaaaaacattgtgtgacttgctttattgtgatatttgtttactgcagtggtctggaacaagacacaatatctctgagggatgcatgtattcttccatggaaaaactccttcaggatttttggtttctggttagaaggcacataacatgtattagatgactttttctctcttttgaataggctaacagggccataatgctgtcacaataacctactcttgcagaaaatgagaattgttctaagaaagtcacttcttattttcgtgtcttaactatttcaattgagaaatgaatgaagaaagatttaggagagaaacatttttctaacattttagaagagctttggggatagtggataatgaaagaaagatttctagaacactagcagatttgaagataaaagttgctgggagatgcaaagatgataagaattttacgcaaacagcccatttaatagccatttacacgagtggtctaattctaagaagtgcatgaagaagtgcttcgatttagctcttaacgtccaagtgattatttcaggcctttaaaaaatacaaacttgggtagaaaacaacaaaacaactcataaatatgtcacctttgctaaaaatcaaattctgtttcctaaatttaaaatgtagtatgattggttactctgtaaggaagcaaacaaaaagtgccaaagaaagcagaaatcagcatgtttcctaacaacagaaatggagttatagaatcaaaaaaataagatcctgcagctcattccattttccaaatattcaatatagcttttagctaccagataaaataggagtaggagatatatgtttatatattaagtattgtcaaagaaaatatagtaattataaacatatgtaaaaatatcctttgtttatcattttagtaaaatattacattgacccaaatgtaatattgcgtgtatgcacggaagtgaattgcattttaaaaatcaacatagatttttcctactattctttaggaacttaatgacttagcttgaatgaagctctgtttacagactataatattttactcaaattaaaagacagctttttacttaaattctcttcaattaagacctattatcaagtaaatgatctttagttttattttctttccaatgcattttggttacctacatccatactcaggaaaaggcaagctttcttattttcaaaatacaaccttttgttttaaaataatttaagacctaaaataagccacacaaataatacagagttcctatgtgtcttgtacacaaattcctctggttacaatttctctcatatcaaacaaaatgacagttaatgccaggaaattaacactggtgtgtacatacaatatatgtatacacattcataagctagatgtaatatattgaagtcagacaaatatgcaatacataatggaagtcatttctggtaataaagaaaaatgtacaatctatgcatcagtgctgtaaaatacaaaaccaaatagcttgtgtagcaagagggcaagcaagaattagtctttgggcagaggcctctgagccaggttctctgggatatgtgtgtgtgtgtgtgtgtgtgtgtgtgtgtgtgtgtgtgtatatatatcttctctaaaaatacaaatatatgattatatatatatgcacacacagtgtacacacatacaagtgtatatatacacaattgtgtacacacgtgtctatatatacactatatatgtatacatatatataattgtgtgtgtatgtatatatattttatttatttatttatttatttatttatttagatggagtcttgctctgttgcacaggatggagagcaatctcagctcactgcaacctccgcctctcgggttcaagcaattctcctgcctcagcctcctgagtagctgggactacaggcgcccgccagcacgcccagctaatttttttttttttttttgagatggggtctcactctgtcaggctggagtgcagtgacgtgatcaaggctcactgcaagctccgcctcccggggtcaagtgattctcctgcctgagcctcctgagtagctgggactacaggcgccgccaccacgcccagctaatttttgtatttttagtagatacggggtttcaccatgttggccaggctggtctctgcctcagcctcccaaagtgctgggattataggtatgagccactgcgcccggccttatacattttttttcagatgtgattgtttttcccttgagataaaagttaaatggaagaataggtaacaaattacttcaattcacacgaaaataagagaaatttgatctttcttttaccatataagccccttaaccttctgctatgcaatttatttcacttacccactgcagaaacattattcttatcactattaatcacgttatttttggccataacccggacacttccttccctttcaacttcttgctgcgtgtccacaccctcttctctgtcacacttagccagcattctgtcagtacctggctcaggggcctctgccccaagactaattcctgcctgtcctcttgctactgaaactattcatttggttttgtgttttacagcactgatgcataagttgtacatttttctttattactagaaataacttctattattttttgcatgtttgtctgatttcttgcaatagattatacattgcaaaaatgtaggaaccatttcttctatctctcttgaattctcctaagtgcacaatcaattatgcatatggtgaagcctaaaagtgcttgttgaatataggctgacttttggcattggatgtaaatagggcagttatagaaagacatatttgttttgaagccatttcaagaaacatatttaatagaagtttctggaataatccacattcatttagaaaatattactctttggcatagacttgagaataaataaaaagagatcgaaagtcgagggaaaatagaattaaaatgacctggaaaattgaatctacagcttttgaccaagatgctaaagaaaattaaagtccaaaatacacgtatcttaaaaatagaagggaaagtataataatctgttggtaaaatgcaaaaacaagaataaaaaccccaaacccaaactcttggaatattcttcctgggactcctgaagactgacatgtaagaagtccaactacaagaatgccctttgatggggtcccatgtcagcgtttgggtggattgtcccacctgagccctgcctttcagccctcttgctaagtcctctgacaagcaaacagtactgtggtggaccctcccaaggaggccacacctgctgaagatcccagggcaatcctgatccacaccatgggacaaggattgctttgtcaggccttgtgcaaaatcctgctcacaatattgtgaaaataaaatgcttgtagttttaagccactaaactatgagaaatagtggatatcaatttagcataaggtagcaatggagtccttatattaataacaaaccatattaaaaagaattttatgattgttgctgcattacagtaaagactaggatatgaatatgtgtgcatatatatatgcatcatacatatgcatttttattttgcagaaaatatttaaaatagtgcataaaatcagaaacccttagttgagtgatttgctgttcactgtattaaaatcaggcagtgacagtaatagtgaaatagctgcaaacagataaaatcagtggattgaacctagaaaagaaaatcaggaaaatgttcatcaatgttgacaaataggcactgtgtgaaggggctttagactgattccctaaacgtccaccaatattgagcataatggaccatggatttttatatccatgccaaactcacacacacatttatgcttattttatgtatttatgtatttatttttgagacagggtctcactcagtcatccaggctggaatgcagtggtgcaatctcagctcactgcaactttcacctcccaggctcaaggaatcctcccatctcagcctccctagtagctgggactgcagatacacaccaacatgcccggctaatttttgtatattttgtagagatggggtttccctatgttgcccaggatggtcttgaacttctgggctcaagcaatctgcccatgtcgacctctcaaagtgttgggattacaggtgtgagccactgcacccagcctatacttattttaataggcatttttgacctttaattacacacctctcacacagagaactagaaatccactggtcctggctgttttcagtgtgttctgaaaatcttttaagaactaaggttgtcaactacatctttggtttccctggggcattagctttatctaatatatattaactttgtccaaattcaatgcttcttgtcattaccttgggaatcttatatctttattctgacggactcaccactccatgtggtcatttcttcttacttgacaaagtctttgcattcatttctcatttggcttgcaagataacaactctatttttgttagttcaaaacaataaatatcactactactatcagcattaatatttagtcatttttattttatatcatattatcaattagatacttgaatttgaatgtgacagcatggaagcgacagcaaagaccatatgttcatatagatggcaagcaaagaaccagaaagatcatgtgacttgtcatgtcaaagatcaaacaattatcatactggaaagcatattctaatgtttaatttaatttttaaaatttaaattataaagtgctttctacatttataatagtacagaaaagaatataaacaaatcaattgctgaggtatttaataggagataattgtcaatttgtttcagatctctacctttaaggaggaaaaaaagaaagagaaagaatactcatttttcggctcaatattgttttcataacacactgctgactgtctcacagcttggaattattgctgatgtttactcttgtaaaaggttaatagtaagtttacttcttaaagggctttcatctgttagcacatttgattatccccatatacttgggagacagggcatctattacaatctgtgttttataaaccaatgaggcataaaaatgttaacagatttgccaaagatgtcaaagtgattcaaagagaaccagccaacctctgactgccaacctgcatgagccctgctgcgcctggctgcgtaattcatagagtcatagcttaatatctgaatatgagaacactatcaggagaaacacgttttgaatcacagttacaactccaatttttaaagaatttaaatcaatcaataattctccatcacgataattgcaaactcatctagaaaattgtaacattctcagagtgcgaaaaactattaaatgtttatcttaaacataagtttatccctttctaaatccattcacatagtatctttatataatcattccaataatcctacaaagcaggaatttgtgagtgattcttttaccaacgagaaagtggaatagctgaaaattcacgttgatagtggcttaagtcagttgtccctggtcttggctgcacactagaattatctagggagtgtctaaaattcttaggctctgctcacattgtataccaaaaatatcagaatgtctgggagtcagttccaggcatcactgttttaaagagcctcaggtaattccggatttccagtttgagaagcattaacttaagcagctgctacactgcagttacttggtcctcctcgtctagtgtttcttcctctacagaatgaaagtgcatcacagatgatcctttatctttcctgcagatatcagctataagcaattaagaaactattttacatttaagaaactctttgcccctaatttggattattccgttcatgtgcggttagaaagagatccttatggaatgcaatcactatgacatttttgactctatgtcaaattgcaggtgagatgccaaggtagccacctaaggtgctggtctttaataacttcagttctggaaatagctcaccttgttcatggcttatgaatttatttttgttatgacaaagaacagaaacttctctctttttaacttggattttaaatcaaatgaagaaacttgggactccctctgtacttaaaagacggaaataggaaacttgtgaaccaaaataataaaccttgctttatctacaagccacacatgccaatggagtctcagatgaatcccggagatcacaatactttcagttgctgtgctatgatgtgtcctcggaggtacatcattatcacctggggcccagctggggattgcttattaacactttcctgagaaacctcagctcatgtggctgtctcattcacagatcatgaggagtgattgggaaccatgtaacctggacattgtgttcaagaaactgtatcatcatcactatcatacaaatattcacacactaggaattgcacagcccactttcagaaacagggacacaccatgctcccttaatctggaacaagaaatagcaagatctctgctctaggccttcacctcctcagagaatatgggtttagaaatgagaagctgctgaatttgaatacctttattttctactattattcagggtctctggtagtaaacaaagaagttttgaatctatactatgcataacccaatctctcaagaagcttcctagattgcagtggcttgataaggaaggtaatatgtcgtaccaacacaaataaatcatttttctctaagcaattccagaataatttgcccaattttgccacttgacatcttttggctattatatattagcaggcttcccttttctcatattgcaaatatcattaaaatcatcacgcacgtcattgaccttcttatttctacattggagaagtcatttagatataactagcactgaattaatttgctactcagactaacagtaaagttattgaaaagtgctttaaatgatttaacagtgcaaagaaatggatcccctaattttgataccacaaatcttatgtattttaatcaatctaatgttttcatgagtcaaatattcttcaataggagaaaattttaactggcattcataaataattgtatgatataatgaaactgcttccaatgtcttccctgatacaagctcacttctcaaataccagtgtgtagacaaatgttgtacataaataataattaagtttaaaataaaatcaaggttttctgcacggtatttaatgttcatatccttttctatgcaactcactttgccacctggtcctcaaatgccccatattaagtgggcacacatataatgttcagagagctttgatttttctctgttttcatagtgtttagtaaaagacaaaatatatctgatttcaaaatgctattttaggctcatgcttgtaatcccagcactttgggaggccagggtgggtggatcagttgagatcaagagtttgagatcagcctggccaacatggtgagacccctctctactaaaaattcaaaaattagccaggcatggtagtgggcacctgtattcccagctactcagaaggctgaggcaggagaattgcttgaaccaggaggcagaggttgcagtgagccaagatcgggccactgcactccagcctgggcgacagagcgagactctgtctcaaaataaataaataaataaataaataaataaaatattacattacaaggctactatactaatctgtgatatcaacattactatcctaataagctggtttataaactaattaataatttggattaagataggatcacacatctccttgcctcacattccacaatatgacaaaaaagataagtttgaatatggcaaatccagtgcagaatgggaaaacgataaatagtgtcattaaggcacagacattttatagggtctttgaaaggtagaaaatgcacagggatcaaatctaggtagaaataaaatcagaagaaatatgtatctaaaacaagtgctgaggaaagctatttttaaagctactgctggtgtgtggagaagcttaaggtctagaatcgatggctgaaagaagtgggaaggaccatgggaaatgtatcttgattaagtgggagctaaattgagaggagctaggtcatctgacttacatggaaaattattcaagtgagcactggtaaaagcattcacgctaagcagcaaatagtggtgcaattaccctctggttataacggaaatgcaggaactggagcagagatcaagacaattccccaggtaattgctggtcacagaaagggcaggatctctccggcacaggacccaagtctcatcttccagttaccagtttagacttaagtaaacataatagaaggatgtaaagaaactgtgaaacatgaatatgagtagacaaccccaaatacacaacattggaagaaaatcaacaccactggaggcgatggatactccatataccctgatgtgattattataccttatcaaaatatatcatgtacaccataaatatatatacctactatgtacccacaaaaataaaaattaaaaacaaaacaacaaaaaagcaaaccaatatcacaaaaagttgccaatctcaaggactaagaaggactaagattcagtgaaacacgtaaagtcaatagggacttgagaagaagtgtcagtaagtggtgtgtgtcttcagggatatacaacaggatacgttcctcataatgaagaagccatcacgtgatttggaaattaaaatctttattttttaaagctcaacagatgcagtaaataccagaatggacaatctggaaaagaagattagtcagccaaaatgattacatttaagaattttattaggtaaaaggtgaaagaaaagaggcacgtaagtgataaaggacataaaagctatatccagaaagctaacaatctctctaattgaactttgggaaaggaacattgaaagaatatgggggatgtgcaggaaaaataagagaaagaaatacagaatccaagtcctttgcttttttccttttagttcattctgaaaattatcttctctatattaacatcttcagcatagtttgaaaacttcaaataatatttatttatactcctgattgttctagttttataaaacagtataatgaacacagtggtaaagctgatatttagttaaatttcagcagttttatctgccttcagttgacactgttatcttggtctcaaagggctgaatgtagaataataggctgtctttagccaacacagagattttcataaatttctccaaatataatcacaaacttaagattccaggcagataaaattatgatggaaggaaaagaataactgggagtccatcaatcaaacataaccaatgtgctgagtagagaaatttacatgctacaaggagtgaagacattcatatcttaacaaacacttctctttctgcatcacgtagtctcatattttcataaaattaacaaattagcttttgcccaaggtaggcaagctttctttaagactcttgaacctgttgtaaatatttgtaaataataggtctcaatttgtttgtcctgtgtcaatgataagtaacttgttatgctttcttcttattactgaaatcatgcttaatatttgatagactctatctatggcaaatactccatatggcagcaaagatccattccttcatttgtgttgttaagactggaaatgccatttcaagtgtacgcactaaggtttatagcacaataaagatttattaaaaccactccacagagccacgttgtacagaatttatgaactgtaaaactgctataaaggtcacttgagatgcaaaagtttaatttggaatatcatgttatggtacagaattgctgcattcaatgcttgttaatataaatggtttaaagatatttgtctcagtctgtgaagtttatgaacttcaacaaaaataatttcatattttataatattttacatagatttgatttctttaaagtttttctacaaatccataactcatctcatctgtaaaatagtgaggaaaatagatacaaattggatcttactttcaaaattcactgttgtttcatagagcatattccttatcattacttaaccaacttctgacatttaccatttcataccattattcattcattgcttttctgataccaagagcctaaggaatggatagcttttcaagagatatcacaaaaatgaacaagatattgagcatttataacaggaacattggggaaggcattgctaaaagagattatgaattataatagtgtctgaatgtgtgatattatatttgtatatagacagatacatataaagttacatcaactcaagtgaatacaatctaagaaaagattaattatagacaattataattctgtagtaggatgaatatcatacaataaaagtgtaataagatgcaaagacaacataaacaatagggagcattttcaaagtacatcttccagcaatttttttgttgtaaaacagtataaactgatttttctatgttttgttatgcataagaaccaatacttttttatcaaagatcaagaatgtagaagcagaatattatggaatgtatgtgaaacttctgaatagcaccagaacacggcatagccattcccatggcatttacgttgtaaatgttaaactataaaatattgtgctcatctctctatcaactaaaacatttgaaaatcatggtttcttttaatgttaaccacaaaaggatcatggtatcatgtaattctattcctccacttttttatataaggatggtagagatgtccccaaaatgtacaggactagaactttctgcccaccatgaaaaaggtatagctaacatgctctgcatacttacgatttactgagcattttattaaataattctttggaatttttctctttcaacaacactttgtcagagatgatattattattcatatcttcaagatgagaaaaactgaatcttgggggtttaagtaatctgcataaggtgacacaggcacacaatagtggagctgacactcaaacccttgaatgaaccacaaagcttatgttcttaataatccattatcctctattttactgctttcatgctaggaccaattagagcagcccatgaggataggcaaaacaatcacaggttattatggaaaatataaacatttcaaccggagaattttctgttcccaaatattccagacatgtgtctacctgaagttgtagatcatgtacaaaagaatgacagagttcagttcattcctccagttctagtgttcactgcacatagtctccctctcacacagcccagtgcacacaaacagtgtcttcatgctttagtagatctctctttctttggtttcctattccaggatcatgtttctccatcaaacacaaccaacccaacaaacaatacttacctttctgtttggagaaacccagaatatacatattatataattatattaatatatatataataatattatataattaataatattatataattaataatatatattataattaataatatatattataattaataatatataattaataatatatattataattaataatatatataatattatataatatataatatatataatataattatatataatgtatattctgagtgtgtatacatatatgtgtgtgtatgtgtagatagataattatataattatattatatatattattatataatataattatataatatttaatatatataatatataatatatataaaatattatatattatatgtataatatattatataatatattatacatataatatgtatattctgagtgtgtatacatatatgtgtgtgtgtgtatgtgtagatagatagatacactaagaggtctatgattcatgtcacaaacccatcagggtcatatgttgcttctagagaatgtgctgtacactacatcattatgggtctcaatttatccctacctataccccacattaccactctctttgaaatctgatcccatctaatattagtactcatttctggaagatattttttgctcctctttgaactgtaaaatttcattaaatttttctcgctaaagtgtaaaacaatatccatagacatttgtaaatggagtacatttttgtgccctctttgtatgctcattttcactgaccttgcctgcagtatagagctgtataatgatacaccaaaatgagtgaagataagacagataaattaggaagattaagattatctgagacagatcatctctgtaatttaaatgatgagctttaaaaaactctagacagagggtagaattgttagcagttagtacacttgctctgattcaaggaaataagtttaactcaaatattcataaatcagagtggagttaaagggttgtggcataaaagcagggtgacataggagaactaacccaatcacggccacgagaagaagttcttctctagcttctaccaagtaatacttcatcctcatcctagacagacgggtatccaggctatgctagctgtattgcttttatcatatacaattagtagtgtgtatagaactttacttatgacatactgtaaaggtaactatacttatcctctaattataaatacatttattttcaactagtctttaagttatatttttaaggtttggatttaaaagtaaaactttaaagtgtattacagtgaggcaccaaatttccaggagctaattaatgattttgaaatgtgcctggtgttggctgagtcgacagcaacactctatggatgggtggtttgtggaggaattctgacttgagagtacaatagcactcagcaataaatcatattagtttcagtcaactctagaggcagaacagacctaagaacatacacagcatagcagctcctgggtgctgctggaggccctcatgacagagacagaccagtgggattgtttcaagcaaattctaatctgtttctatatcctgtctgtatgtctgtataaataagatatagatatgtcactatcaaatatatttctcaacacaaatttcatgctttcttctgtttttaaaacagagctgttgtaactatttaatttacataactttaaagcttctatgaagctattattgtgactgaatacacaggcaaaagacatagttggctcaaaagaatcaaaatccaatggaaaagagtgtttcttagactattcgttttagatgagagtcttaattcataattttactgcagaaataatttggtaggtttaagaaaaatgatactaaaggttactttctatcaagaactatacaaagcataaaaattatatttgttgacctgaaatcacagaaagattaacaacctaaaatttcatatataataccataatgtctgcgcaatcctgcaaacagctctttcctcctacctgagagcaacttgccatactgagtgtccaatacattttttcaagtggtaaatttatttgtgtgtgtgtgcgtatgtacacaggtgtgtttatatagtttagaaataaagtttgcctatatggtaaacaatttctgctaagccatatagctatgacctatattcatattttaaaaaaaacccttaggaaaatagaatacacaatttgaacttagagtgtttatagtttctcatactttcaaaattctcagcatggcttataggacattgcagatttggtttctgtcttcttttccaaccacatctcctaaaactcattgtcctccacccttcatgcattctatacagctaagttacttttcaattccttgaaaagtgccaaacactttcctgccttaactgtagcacacatagtattgtttgtgctctgagtaattttcaaatatttataatattcagaatattatatatataataaacaagtttgctaatacgtgagggaataggacaatgtaaaggatgaccaaaatgatttataaaataatcaacataaccattagaagttaaatatacaatcaaaattttaaaataagaggaaagatttaatagcagatatgacatagttcaagagaaacttagtgaagtggaataagatatacagaaattattcagaatgcagtgaagaaaaacgaaaagatgaaatgtaaaagagagcttaagaaacatggaagaatgtgtgagaagacctaacatacatataattggtgatcctgttggagaagaaaaaggaagagagaaagaatggggctgaggatatctttgaaattatagggactaaaaattttcagaagaaataaaaaaacacaaagtttaaacagctccaatatgtacccagaaagagtttaaaatatcaacacaaaaagagatcataatgaaggagtaaacagagaaagaaaatatattaaaattagccagaattagaagattgtttccattcaaaggagcaagagttaaactagaagctggcattttagcagaagtaacagaagtctgagagataccttcattgcattgcagagaataaccatttacccagagcctttaccaggaaccaagtgtctctcaagaatgaagtcaaaataaagacatttgtcgggaaaacaaactgataaaacttatcaactgcaaactttttctaaagaatattttaaaaaatgtacttcaggcacaaggaaagtaaatccataaggaaaatctaacaagaaaaaatgaaaagcaaagaaattaatagatatattttaaaaattagattataaacgatacaaactacaacaataacattttgggagattagaaaaatggaattaaagtatgtgtcaacaatagcacattcattgagaaaaggttgaatgagttaaatgctctctatagttcaaaacaatagaacaaatgttcattaaatttagattttgtaaagtgaacaacctacaatcatcagtataacactaaaagtctgaaaaatggaacaattaacttctaaacttatagagggaaaaaatgaaatgagaaataaaaatacccaattgtaattgcaatattaaaataaaacacttatttttgtaataggcactgctataagagctttatctacattaacaaatgcaagcctccactgtcacagttttaaaaatatataaggaatattaaaaagaaaggcaagatagaaaaaaacaaagcaacgataagtatgaaaaatagaaattaaaagatagtgaatagaaattcaaatatatctggagcaacaaaactgtaaatgcactaaatgattcaactaaaaaactaagattgtcagactatactaaagcacaaacaagaaactgtgtaatgcaaaattgtacattttacctgagacatcttaaattaaaagatacagaagggattttacaaaaatagaaaaatttatactagtaacatttttactaaaacagaagtggcagaaatacattatcaggtaatatagactttaagaaaaaggcttgacaaaaataaatatgaccatttcacaatcccaacatttaatgtgccagtaaggtgtatcaatttaatgtggagcacttaaaaacaaagctacaaatgtgaaaaattgaaaactaagagcagaattagtatgatgtacagcaggaaaaatttgagtaaaatttttgagtgttacataaaatagccaaaaatcactaagaatataaaaattcactaagactgtagaaagtttgataaacaagaccaaaaaacttgactcaatatgtataaaatattgtgcaaaataactaaagaatacacatcctttaagcccatggggaacatataaaatttgactgtggtgaaccataaaggaagcctcaatgatttcagtatttgaaatcctgcagctcctattaagctcaaatcaataacaaaaagatcacttaaaaaatctgcgtctgtctggaagttcagaagcatacttttacgtcacccagacagttttttaaaaattatcattgaaattagattacatttgaattaagtaataattaaaatataatttgatgctattaaattacaataatcctgcatatgtaatcttatagatgtggctaatgtaattcacaaaggaaaatgttaagccgttagtgctaatattagatccccataatatactatatgtcaaacaggctctcctggagctgcctacatttttttcaacccctaaaatcacaaaagtagttcctagaaagtcataaaagtgaccttaacatgctagcaatgacaattccatttatggattggatattatgtgccattcaacaagtgtgggggagattgctgtttgttctactaaatgtctgttcttccctcttgtcttattaataggactctaactctctctctttttttttttagcaataggttttcagtataaagactctattttccaccatcccttgccatatgtttggaccctgtacttaagttgaggccaatgggttgtgaaagtattgagaaggagcttgtggaaagccttaaaaaagaaatctcagctggtgtgcaccctctgcatgtctaagtaattctgatttaactgctggagctgctgtcttgacccatggccatgaaagttatttctagggacagcagagtgctgatctggaaggaacctggggcctagcaactttgaagccagcatgccctgtacgcttacatctgtactttgtataagagggaaataggcttctgtcataattaaacaggtatttttggttttctgtaaatgtagtcaaatctaatggatatattatgctctgtgcttcacatattttatttagtctttatgcatgctcatgaggtaggaattactatgcctattatgtttattttacaaattaggaaatagatatttcaattttcattttaatttcctggagttagtaagcagaagagctgagttttgaatctaggtcagtctggctcctgccttatgttttcatgggctaatctgtgaggttttatataatcatgcattctggggaccttatcagtgcctgaaacactgcctagctctctgtatactaccttatatgcagtggattttagtaggtatttgttattcaagtcatctaccgccatgggttgacaaggcttaggcagagggaaaggggtatctgtggggaaagggagtgtggagtaggcagatatcactgcctctcctctcacgatgaaagggctccctaaacatgtgatgtcaattcacttaggtacaaaatcatggcaaaattacaacaatagtggttggatgaaaagaaggataaagaaatgacaacacaataaaggaaaaaatgccctgaaaaatgaattaaaactgccaagttcttcttgtacccatagaatatttgtctttttaagaaaattttaactcttggctgattttcaacttccaaaaaattagatcttttttttaagtactttgttgtgtacttaaaactttaaaaataatattgcagataaacatatctgtgtaatctctacctctagtcaaaggagtaaaaagctagaagaaaaaaaaaataacccacacaatgagaatgtgagaagtgacaatagcaaagtaattatttcagtgaaactgcagaagatggaaaacaggaataaaaatgttttctcacttaccagaagagaggaactttcaactcttggaaggagggtgctgacaatgcccaagcctccattctggagaagccatgggatctcaggtttctagcatcggggcactgcaaatagagactcagaagcaaaggaagctagaggaaaggcaaaaaaaaaaaaaaaaaagtcatcgaaacagaaagaattgcaaaacagagaaaaaggacagagagcaagaaaatgctttaaaataaaatatgaacaatttgtactttattttttttttaaattaattaactttttttgaaatggagtctccctctgtcaccaggctggagtgcagtggtgcaatcttggctccctgaaacctccgcctcccgggttcaagccagtctcctgcctcagcctcccgagtagctgggactacaggtgcctgccaccacgcccggataatttttgtattttcagtggagacagagtttcaccgtgttagccaggatggtctccaacccctgacctcgtgatccgcctgcctcggccttccaaagtgctgagattacaggtgtgagccactgcgcccggccaatttgtacttaaaaaagtcaatatccgtgagacatagtgcctgtccattatgttcttcagagaaaaatagaagaactgaaatatagaaattattcagaaaaacacacaaatttcccattacctaaaaatctccagactgaaaggacgcagaatgcccaggacaataaaacaacgaagactgtctcaggaacacatcctgggatttcaaaacactagtgatgaatttaaatcctctaagtttgcaagcactggcagtgttgggggcagggcgcattgcagaacaatggcgtgcagaatgacgtcagaatctgcgccaccataactggattccaaaatggtggagccaagccttcaatccctaaggaaaagtacttttaatccagaattccacatgcatccataccatcatttaagtgtaatgagagagtagaagtattttcaaatatcctagggttaaaatgcatacaactcttatgttattatagactatgctttagaacaattattaaggcaagtagactttgggaaagagaatatccaacagagaaaccggcccaatattagaatagattagtatagatgggaacagtgggtacaagagggaggtctccaggaaatgaaaaattcatgaacagattagtgatatgaaaaaaattgagagtagcttgatgatgacttatgaggtgaatagtgataagtatgtagaaaacgaagtggatggaaaaacattaaacaatttaataaagtgaaaagtaaaatgatggtctataaaataatatttatggtttatattaatgaaaacactgtttcttgcttaaaccaaaatgttatgattttataatattgagctgtgtgaagaagttgtgggatggcatcaacaattttcaaaaaaaaagtgaatagatgatgtttaaattgatcatttgttccacaggcacatgattttaaaatatggagtcaccacaccttgaatattcaaaactttttaaattgctttgtaaaaaatgtgcaagacttactgtactacagttcagcatggtaaatggttttgcaaaaagcaatcaattctgattaattttctcatttgcatgagtgccaatgcattttctttctccctgtgaatcaccactcagtgataccattgactctcagagaaaaccacttaatgaaatttttcatcgagtcaattctttgctaataatgaaagaacatattgtcatgagccaggcatgcatgctttgccaaaatacttccctccatcatataggccttagttatccaggacacaaaaatgaattcctagtagagtctaataatttcattctactgattcattcctactgtcagtaaccaaagacagttttacaaaaacaacagttacccactgagaaggcgtaatacatagctctttttcccaagagtttgctaatgaatgcaactgtgatatgattttacttaattatgataatttagacatgacccataagaaaactactgatttaaggaaagcattaatttagtaatatataaaaatgtatgttgatgagaataagctttatatgtaacacacctaaccagaaaggaaatttttctaacattatcatttgatatgtttgtcagtatttttcctatgttgaaagatcagaattcgaagaaatgtaactgagaaattacacttccttgagtatttatttcagtgccgagataatttaattttcagtttctactacaagtggtagtaaaaagaaaattttatacattttcctataaacatttcctatattattttctatcatttagtttaaaatgatgcaatcagaaaaggaagtgctcctctaattgcctcttactattttttggagccaaattttaaggaaacatttttgtttatatctcatcttgacttcattttatttttatttaaatacattcatggtgtatttcttccattgcacagagcatggatgtctccttttagaagctttatttcagatgggtaaaatctactttataaaaggtaaggtcacacagctatgtggctggaaagaaatggataggtacatgttgctgggaggtacgtgaaagaaggacgaaagaattgccaattactttattcttcatttaagttattttataacaatgatatggttttgccttgttttaggcattggttagggttcttccccttgaaagcgatgacctatactggcaatgaaaataaattgttaaaatctgacatatttgagaagtactgatagacctttatttattaatgcccactagtgacttataacaaatgtgaaattgcatatttaaagaaataaacatcatatatgtaaaatgagagctattatgtgctgtctgggttccatagctaacattctttagtctttgtcttagaatagaagaaagaaatggaattctagagcacacaactagtttagaggggtattagtgaattaaaagaaatcactcacaaaagtatatccgatgtgtttggagtctttcattctttccaggttcggatcaactataaagcttgtgatcaactctttcccttagctgagtcttccttactgtgatctcttcccaaggaggtatactaagaattattttagtggctcttgaagggtagggtagtgggaatggttagaccaaatctggccagtaaggggtgaattgtctgaaggtaatttaaaatgagtaacacctgctaagtgccagccagcttctttgtatcatcatgcattggcaatgctcaacaatgccggtgataacgcactcctccctccaaggcagatgctcctcactgccctgctcttgtacagccaagtgacaaataattggaaaaaaaatactagagctgaactatctacatggattttaatatcagactccttttcaagttacataaaagcctgcctctagattctcacttattagacactcaacaaaaatatgatggactactatgcctggtattgtcctcaataccgcagacacaaacataaaccaaagctcctggtcttatttatttgtataagacagagggagacaaaaaagaagtaaacaagtaaatacgtagtgttggaagatcatgtttaactgaagaaaaacaaagtagggtaatggcatagaaaatactataataataatgtgtatgaagcgatttctgaagaaattgacaatgatagacaattgatagacaatgatcataaaagatctgggaccacagataacaggacatttaagcaaagacctgaaagaaatgcaggatcgtgtggctgattgatatcgggcgaaagggattttcaggcagagggaagagcaagagcacggtgttgacatgtgagcattccaggtgtgtttcagggagaggaaggagaactgtgtgccaagctgagccagcaagtgaaggaactgggggaccaggacacagaatcggcagcagggtggtcagccaggcttcatgtcatgtttatcactctagatggcatcagaagccattgaaaggttttgaggaaaggagtgaaatcatgtgccttctgttttataaaggtcagttgtatatatgttttgtaggttttacgagaattctggctagtgtgtcgagtataaactttaagaggcgagggtaaaaggccataggaaactattgtttggagctcggctgcctgttttgagaacccctagtcacatgtcactcttgaacacgtaaaacgtcacgtgtctgaattgagatgggctctaggtgtgaaattcacaacagatttccaagacttaatatgaaaaggaagtaaaagacctcaataatttttaaaatttagtaaatgatgaaataacattttgaatactctgagttaaaatacattattaaaagtaacttggcctgttccttttttctttttaatgtggctacctgaaaattgtatgctacacacctggcttgcattatatttccagagagaagagaccagactctggatatatttagaatgaacagccaagagaatgaattaaaataaagtttgaaagcatagagtcaaggatgaatacaaggttttttgtctgagcaacttggaagctaaagttgacattttaagatcaagatgagaagattaaaggaccagatataggaagaaaaatcagaagttaagttttgaacatgtgaagtcaaaaacttttatgaaatctgaaaagacagggctgtattttatgctcatctcattatcacacttggcctccacttttacatcagagaaacttcacatcccctcacagtctccccaggtatttttgtctgctcttgctttgttgtaaaggtggcatgttactctctcaactgcaaatgccatccctctactctgagccctcacggccgagggggtcacagtctgtggaacagtgagacaacagggtggcattatgtgtgtcagagcctcacaacggtttctataaaacccttctgtaggatacagtccacagttttctattactggagctcaaaggtgatctattaggacaggcagggcaacagtgtgctatgttattgtatgtgaaggtgagtccggtgaagccacagtagaggacatcagaaaggtgcaaggaaacccagattatcacacacacaagccctaaggtcaggaggcaccacaggccacctggctctggatgagtaaaggcaaaggaatgcggcctcctggggtggaagggcacagaggcagggctctggatggatcagtgtgcacaggaaaggcacactccactctgagtgctgggacatctctgcaattgcctagccctggaaggggcatcactcccaggccagtgatgtgaaaagatgtgaaaaacatcataatatacagaaaataaaaatatatgcaaaacacagatctattaccatcttgatgtttactttaggcatgcccaagtgtccatgaacagaattataactgttcttccagtctcacctgcaaagaccaagtatatcaaaaaacgcacacacgtacacacacaaatacacagacaaggaagtacacacacagaaagaattacaaggacaagaagctacacaaaagaaagcacacataaaaggaagcagattacaaaaagcacacacagggatgcacacacacacggaagcacagacagaaaaggacacacaaagggacgcacacacagggacgcacacacagggacgcacacaaacagggatgcccacacagggacacacgcaaacgggcacacacacagggacgcaaacagggatgcacacacagggacgcacacacagggaagcacacacagggacgcacacacaggaaagcacagacagaaaaggacacaccctgggacacacacacacggatgcgcacacagggacacacacatagggaagcacaaacaggaggcacacacacaggaaagcacagacagaaaaggacacacaaggacgcacacacagggacacaaacggggatgcacacacagacacacacacagggatgcacacacaggaggcacacacacaggaaagcacagacagaaaaggacacacacaaggacgcacacacaggaatgcacacacagggacgcacacaaaacaaggaaacagacacagggatgcacacatagggaaacccaaaaggcagcatacacagggacacacacacaggggagcacacacacagggacacatacacgggagcacacacacagggacacacacacagggaagcgcgcacacagggacgcacacacacagggaagcagacagagggaagcacacagaggaatgcacatacagggacgtacacacagcaaataacacacagaaggacgcacacacacacggacacacacacaagaagcacagacagggacgcacacacatagggaagcagttccacagtgaagcatacacagggaagcacacacacagggaagcacacacacagggagtcacacacacagggaagcagacacacagggatgcacacacacagggaagtacacacagggaagcagtcccacagtgaagcacacacagggaggcgaacacacaaagggaagcacacagggatgcacacagggacgcacacacagagggatgcacacacacagggaagcgcacacagggaagcacacagggaggcacacacacagggaagcagacacacagggaagcacgcataggcacacacacagggaagcagacacacagggatgcacacacacagggaagcagtcccacagtgaagcacacacagggaggcacacagggacacacaaagggaagcacacacacagggacacacaaagggaagcacacacacagggacacacaaagggaagcacacacagggacacacgcagagggaagcacacacacagggacacacacggacgcacagacacgggcgcgcacacacagggacgcacacacagggacacacaaagggaagcacacacagggacacacacgcatagggaagcacacacacagggacacacacagggacgcacagacacaggggcgcgcacacacagggacgcacacacgggcgcgcacacacagggaagcacacacacggggagcacacacacagggacacacacacacacagggaagcagtcacacagggaaacactcccacagtgaagcacacacagggacgcacatacagtaatgggcacattgtatgggtcccaagctcttcagcaaagcccagactttaaacagtaataaaaagctccactgaaatccttcgttgcatttggttgaaagtttttttgtatatttcctcatcctcctctgctggtggttttgtcttcagcagaggtgttccctcctgtattctatgctccaatgccacagaagatgaaacctacatcaaatgaccctgattccgtaaagtaagcgtgaggctgagaatctgtaaagctatttccaatgcttcaaatgatgcgaatatgtaacctcctttcaaaagatatatagataaccctccatttggatttttgatacattatcttaatttccatttttgttaagagcagcaaaaagtatttgcgactatcaagaatggtttacatcacaagactttagtaactaaaatatatgagctatatttccatttatgtgtctcagactttaaatgtggcaaaatgtgttgtaattgaagctccgattttgcctccttgtcaaccgtgatttaacagtaaggggcctgctagctgtgggttagcatggaaattaactcaccttgcaggcactttccagtgaaaagaattacaacgcaagtagtagactgaatatttagttcattaggagcaatactgtttgaaattcctattctttagttttcatgatgacatgacttatttaaaatatggtttaagaaaaagtgacaaaaatattttaattttttcagttcacttaattcatgttaatcttatagcaaacaaaccacttgattcctggagcaattatttgctcattgcaaatatttgagtagatgttagattatagttcacatttcagttttttagtttaatagacttttttagaagagttttaggtttacagcaacattgagaggaaagtagagagatttcctgtataccccctgccaccagacatgcatagaccctccctttatccacgtccccccaccagaatggtacagttgttacaattgatgaacctactttgacacgtaattttcactcaaagaccatagtttacattaggtttcgttgttggtgttggactttctataggtttggaaaaatgtgtaaagacttgtttccacccttagaatatcaaacaaagcacaggcatacctcattttatggcacttcactttactgtatttctcagacatgacactgttttatgtgttgaaggtttgtggcgataccacgttgagaaagtcaaaggtgtccttttcccacagcatgtgctcactttgtgtctctgttttgtattttggtaattttcacaacatttcaaacattttcattgttattgtatctgtcacggtgatctgtgatcagtgatctccgatgttactactgtcgtttttcggaagtgccacaaactgcatccatataaaataacagaattaatgaataaatattgagtgtgtttcaaattctccaccatccagtctttcccattttttccctctcctccagcctcccaattcactgtgacacagaagtattgactttaggccagttaataaccctccaatggtctctaaagtgttcaagtgaaaggaagagtcacacatctttcactctaaatcaaaagctagaaaatgattaagcttagtgagaaagactttttgaaaactgagataggctgaaagctaggcctcttgtgtccaacagttagccaagttgtgaatgcaaataaaaaattcttgaaggaaattaaaagtgccactctagtgaacacacaaatgataagaaagtcaaacagacttattgctgatatggacaaagctaatggtctggataggagactaaaatagccaaaatcttcccttaaattaaaacctagtccagaacaaggctgtagttctcttaaattctaaaaagtttgagagaggttaaaaagctgaagaagaaaaatctgaatctagcagaggttggttcatgaggtttaaggaaagaagtcatttttgtcacataaaagtgtgaggtgaagcagcaagtgctgatgtaaaagctgcagcaggttgtccagaagatctagctcggatcattgatggaggtggctgtgctaaacaacacatcttcagtgtagaccaaacagccttctattggaagaagatatcatctaggatgtgaagaactacaaaggaaaagtcaatgtctggcttctaagtttcaaatgacatgttgactctcttgttaggagttaatgcagatattgatttcaaagtgaggttggtgctaatttacccttctaaaactcctgagtccctcaaggattatgctaaaactactcatcctttgctctggaattgaaacaacaaagcccaaatgacagcattcctgtttgcaggatgatttactgaatattttaagtgcaccattgagacctattgctcagaaaaaaaattttcaaaggattactgctcaatgacaatgcaccaagtcactcaatagccctgacagcccagtgaagatgtattagattaatgttgttttcacgcctgctaacacaaaatatcttctgctgtccatagatcagggagtaatttcaaatcttaatatttaagaaatatatttcataaggctacagctgtcatagacagtgatttccttggtggatgtgagcaaaataaattataaaccttgtggaacagattcaccattctagacgccatgaacgcttgtgattcataggaggaggtcaaagtatcaacattgatgggagtttgggagaagttaatttcaactctcatggatgactttgaggggtttaagacttcagtggaggaaataactccacatctggtagaaacagcaagagaactagatttagaagcggagcctgaagatgtgaccgaattgttgcaatctcattagaaaacctgaacagaaaaatagttgtttcttgtggatgagcaaagaagatggtgtcttgagatggaatctcctcctggtgaagatgctgtgaacatacctttaaaatgacagcaaatgatttagaatatttcagaaacttagttgacaagacagcatcagggtttaagaggattgacactaattttgaaagaagttctattgtgggttaaatgctctctagcagcatggcatgttacaaggaaagctttcatggaagaaagagtcaattgataaggtaaatttcaatgttgccttattttaagaaattgccgtagccaccccagccttcagcaatcatcaccctgactagtcagcaggcatctatatcaaagagttgcttcttatgggtgagcagatgaagtggtttcttgaaacggaatctactcttggtgaagatgctatgactcttcacaagcaaaaaagtatgacactgaaggctcagatgatcattagcatttttaagcaataaagtacttttaaattgtagcatgtacaatgttttccagacataatgatattgcacacttaatggactacagcataatgtaaacataacttttatatgtactgggaaagcagaaaatttgtgtgactcatttgatagcaatatttgctatattgcagttaacctgaaactgaatccacgatatattcaaggaatgtttgtagctccactgtcctaaaaatcctctgcactcgctgcataccacctattcatcccttcattctcagtattcccttggtgcctacttatcatgtgtgtgtgtgtgtgtgtgtgtgtgtgtgtgtgaggggttgggggagagaaagagagagagcgagagaaagagtactgtgtttctctatatgtgatgtcttagtaaactcactcactgaaatctccagataaaatggtaggagattggaaaataggaattggatggtgtggagttgaaagtagagaatgtcaatggaagatcaagagttacctcaaaaagaaagtgaaacgggaaaagccttactttgattaagttgaggcacagtgggagaaactgttaaatcaggacagaaataaatgggtcttaagagctgttttgaatgcttgattttcatgatggagcaatttcaagtgaaataaaaattagcacgagcaaatgtgtcaatgaaattgtattagggaaaaaaatcactaattaccaacttgagatcctccacaagagctaacctgagaatacagtattaatacttcgctgtgcttcacactccctacctcaccaccagaaagggcaatgttttcaagggacctcttctgtaccccacagctgagctttgcttctgcgactagggaactgcttgagctgacctgagtatgagatcaaacatgaaggtaataaattgattggaagcagaaaacaaaactaaacaacaataacaacaacaaggaaacagtctaactgacttgacatttagatacctggttcagctatacaagttcctaaggatgggaagcttaataatatcaaaatgatgtgactctacaattcacaaaaggaattataatctgaagcattgacatgctaatcaaacagatataagaaaaaatttttactattctagtgaatggaaaatctttaataggggaaaaaagcaaatggcacagatagcgtacaggacaaggacgtaacttaaattgatctgctgtaggacataggggtagactgctctcaaggagacagacatcgaaaatacatctcagtcaaggcaggtggaatttgattaagataaatgagataaaattgtagaaatttaggttaattataaataaaatgggctgggcatggtggctcacgcctgtaatcccagcactttgggaggccgaggcgggtggatcacgaggtcaggagatcgagaccatcctggctaacacggtgaaaccccatttctactaaaaatacaaaaaattagcctggcgtggggtcgggcacctgtagtcccagctactcgggaggctgagggaggagaacggagtgaacccgggaggcggagcttgcagtgagccgagatcaagccactgcactccagcctgggcggcagagcaagactctgtctcaaaaaaataataataaaaataaataaataaataaataaataaataaaatgactgaagagacggatctgaacacaggattaattaatatgacccctcaaaaataaaaagtgattttcacaggttaaatacaacaaaattgataataataaaaatttgtattctaatgttatgtgatatatgattttatgttaatgataatgtagtgagattagaaattgagaaagctcacagtagcccttacaagcaaattaaaaacccttcctggtaaaattctttaagttcaaaagaaaaccatcaataaaagtggttacttttctttttattatttacttaaaaattacaaagttaatatattttcacagtaaaaaaaattcaaacatcaaaaacagatacttttcttctttctacacccaaatctccatttgtcgcctcaaatgtaattactattagtaacatctttggtatgtttccagaatttgcctatgaattttaaaacacacatatatgaagaggaaaaacactgtgataaattaatggaagctttctttttctctccattctaaaaactgtttaatcatttcaacaagccattgttcatttcttcagaggaggataatatggactgaagaaaaacaccaaaattctttctaaccacaaaaacattcgagccgtcatcgtgctccagagtagaaactatcccatttactttagtctccctgacattttgtaggtgtgaaacctaaattccagtggacagagagtatccccgcctgggtgtagaagggagtgtggtgtagctggttactggccattgaaacctgtgccccgtgggcttctcggatgtgtactcgattccatctaagttttggccattggcccagggaggggccatagctattttctccttcataagaccactggccacctcctggcttttgagatctctggtccaaatctgtcctctcaaacatgcacagggcgctatccctccatttctcatatcctgctggcatgtaggcaccctaaggagaagttccaggcccctctacctggacacgtgattctttcagaaccagcacttgctggcagctgaatgatcctgaattctctgatagtttcttggaagaaggaagaacgttctcatctttggatttccaaacctacatgttagctgtaggtatgtcaactatcatcatcactttatttgcctatctggctacttctgcctgcattcattcacctgaatattaatatgcatccttctatttcataaaggaattcatactttagatactcttctgaaactagtaataactatactttggacagctttttataaaaaattccattatagcaatgtaccacaattgattaaatcagtttccaattgttgtatattaattttcatcactttttatttaacattataataaacatgtacatctatgtctgacactttttaaaatatatactacatttgtaagatagactgtttgaagtagaattgcttcgtaagaagggatccaaatttaaaatgagatgaaacttggacatttttattgatgtttaaaatatttcatgtatacgtatgtgtatatgtatatgcacacgcatatgcatacaagtttatatacacacgtgtaaatgtatatgtgctaaacttatatatctgaaaacagatatgataacattatacatgttgaatgactgtactgctaatttcttcccccaattctgtctctctattttccctttagtaataaaactcctaagtttggctagatacttaatggcccaaactctttgcaaataagtgtggttaccttttagacaatagaatgcaaacggataccaacaccagtttgtgattgtatttttataaggaggctgtgtgtctttctctctcattttcccctttccactaattgcaaaatgatacataataataataataataataataataaacaggaggagttgccttgcatctcatgatgaaaaccacaatcaaaggatgaaagagtcaccctactagcttgaattccttgattattttgtggagcagagcagtccaccaactcttgactattcactttagacttgagatttgaaaaaaaaatacttctttttaatttaatctgtataaaatatcacgttatagcaatttatcctatattgcaaatagacttgtttttccttttttactttgtttttcctcttttatcacaatctcactttacatcagcctctctctctccataacctctcttccaaagaatgcatgctaatcaccttgtaattattttttaaacgtagattcagtcatgcaaagacttgtgtatacaaatataaacatatatctacacatatgcattttgaaatttttttctaaaatggaattacattttgtatacttgtctgcatcttacatttcccattcaagaacacaaaatgacaattcctctgagttgactgatacaattttctttctttttaacatgattcttgatttaaatgtaaaatatttcatttaaccattcttctaacgatttccagtcacatttttccagtttattttttgccactgtaaacatattataataaatatttgtatatccttaaaaatgttaatatattagtgttattagaaaaaatataaacatatttttattgaaattggttttgctggtgtgattttcaaaaagattacaatgctgcacattttcacaagcaatgtctgacagtgttcctttcatcacagcctcaacaacagaaaagtttagaattcttacttttaccagtctgatgaacataaagaagtatctcattgttaccttaatttttatgtcttatttacaaataaatttattttcctgtgtttcagtatttcaatttgtgcctttataaactgaaaatgtatatacattaaccctctttctgttgaataatttttatttccattgacacactgtgtaaacttttcacacatacatatgcatacatacataaatatgtacgtgtgtacactttttgtctatcttggtctttgcgttatatttttcccaaataatatgttggtccacttactatgcatatgatatcttttaaatgttcaattagaaaatattttgtgaaatgtctgacatttctttcatacattttgagtttttagaattgttcaagtggatcgccattaaaatgctcatgtgatcgcttagattatcgtgaagtaagttattctttttcacattaaaaatttaatatatatgaattctgtttttctttgtgacataaaattaatatctatttttattttcttccaaaattgcaggttgtccttcagcatttattaaataatattttttccccaaacttatggtactacctttttatgtgcaaaattctcatatacagtgtgatttgtatttgggttctctattcttttccacggatacatttttttctaatttctacacttacagtaattttctaaactatatacatcaacatcaagtagtaaaatactcatttttcatgtcttttatacctttaaatttgtcactcacacacacaaaaaatgcaaccaacaatggggtggaatgttttgttctggctacatggcatcataaattaaacataaattctgttgttaaacccccttccccaacaaaattgaacaactacaacaacaaagacaacaaaaattttaaaagcatagaagtgctagtagaaaaaggaaaagaaaaacaaatacacacacagaaagaaagatgaaatctctatggaagagacacaaaggaggcacacattgtaaataatttggttaaacattacagcagttggagggacgttggtggcaatcagacctgggaatattcgctaataactatgggctttgttttccatggccacagatgcacaagaagtaagctcttgagagcatttaagaaggaagttggaaaataacacaaaaagtgcccctggatcagtgatacactattgtgattggctcagccgcaaagagaaaatcacctggaggtaacagttgctccccaaaggctgcgtggggttttcacagcactggaagaggccacacacaggaggccgacgtgaggtggggttaggacctactgtaacaaactcttatgaatgttttccaaagcatcccaaaagctgcttatttattttataaggaaaatataaaacgaattctaaaccaaaggcgttttcctcattaaacacacacacctgttgtccaattttccatagcttgtttgctactctctctcttgccccaacagtggataagacattctataattttcataaatctatcagcaaatgttaaaaataatgcatcaaaatccaataatgtttatatcagatatgtaattatgtttaatacagggatttctgttatgaaagatatgatcaaaatggccaaatatgaaatagtaaagttgtttacggcatgggcttcaatgtcaaatgcctaatggttcaagtctcgacagaaccgtgtctgtgtgcctattttaccccttccatattagaaatatgataaaacgggaatcaaaggagtccttcttaattgtatagagtggtgatctaaaaacaatagtcattgtcatattcagggtaatttacagatgctttctcttacaaacaggaatgtaaaaggaatacaaaccttcacaactactatgatgggactgacattttggaaaaaaaaaacaagataaaaaactaaaagaaatgagttctaaaaaagacagatttgtcattattttttagcaatataaatacataagtaaccagtcaataaatatacaaaattaatacttttttttttaaatgaagcacaacacaggaaaactatatacaacttagaaactgtcctctccaccagcaccagccacctggaaaatgtattgaaaaaagagatcccatttaccatagtacaaacaataacatgttggcacaaccacaaaagatccgttgtaggacctccagattgaaaaagtcattgcgatgaaggatttgaaagacactttcaaaaatgtaaaatttatagtgtgttccgtattactattacactctccttatacagtatacagaagtaggttctaattttcaaaagttcccagaatttgttttggatatggatgcaatttagattcaaattcttttgacttcaaatttagtcaaattcttttgacttggcttttacatggcttcagatttaatattttatgaaatatttcataatagttatatagatataactattataactatataactatatgaaaactatatatataattatatataactattataactatgtatagctatatagttatatctatataactattatgaaatatttcataaaatactaaatctgaagccatatgaaagccaagtcaaaagaatttttggcagcatggcattggaaaaggaatagaaagacatcagatccatccattaatacataggtgatagataagtataacaaaatagtctctaagaagaaacattataaagatttaatatgtaaaaaatatgcttattctaaataactcagaatgattaggtgattgagaatttgggtgaaattcagttgtgtggggagtttactttaggtaacaaggtaataaacagctggattaaatagtttaatgattcagagaattatcatgggagaaagagcacataaaatattttaactgagtatgaaaaatctagagattaaacaactttttatcccaaaacacaatagaaatattaacagagattagatatttaaggtataaaaattaagacataaaaatgtaacagaatttatttttcacgcccttcgtatggatgaatcacattttgtgtattctttctgccaccaatggacatttacactgttaccacatttgggctattgtcaaaagtgttgtaattaatatttgtgtgtaagtttttatctgaacatctgttttcaatttttctgaatatataccagagtgaaatttgtgggccatgtgacggcattgaacttactgaggaaacgccaaaccatttccatagtggctgtagcattttgtaatctattcccaccagcgatgtctgatgtatgagggctccatttctccacatcctcactaacacttgttatttttcattttaatttttgattattgctgtcttcatggatatgaagcggtatcttactctgctttcgaattgcacgttcttaatgaccaccactgagcgtttttcatgtgcttgttaaacatttgtaggtttgccttggagaaatgtgtattcaagtcctttgccaattttaaaaaagaattatctttttgttaattgtaagagttctttagatatttgggtaacaaatacatgatttgcaaatatttctctctcattctgtgggttgtcttcactttcttgacagtgtaaaagttttctattttgatgttcaagttatttattttttcttttgtttcttgtcctttcattgtgatatcaaagaatctattgccaaatctaaaatcatgtgtatcatgattttttctaagtattttctatgtgtttattctttttattgttattctaaatggaattattttcccagtttccttttctgatcattcattgctaatgtgtagaaatgcaactatatgttttatgttgcattattttgttctgcttttttactgaattcatttataaacacaaataggtttttgatgtgtattaattctttaggatttgctgtatataacatcatgttatgtaagaatagtgctagtttcactttctttacaatttggatgccttttatttcattttcttgcctaattgctctggtgaaaatgtccagtataatattaaacattagtgatgaaacaggacattcttgtcttgctaccaatctcagagagaaaatatccagtctttctctattgaatatgatgtgagctgtggatttttcataaatatcctctattatgttgaggaagctctcttctatttgtaggtttctttgtgcttttatcacaaaagagtgttggattttgtcaaatgctttttgtgcagctgagatgatcacgtggtttttttcacctttgttttattaacatgacattaattaattttagtatattgtagagatgtatgtttcatcctatttttatgacattcttgaaatgacaaaattatagaaatgtaggaaagattagcggctgccagggatgaatgcgggagttggtgtgggaaggaagcggtgatggctgttatagggcagtatgaggaatgcttgtgatggtgatagagatgttttgtatcgaaacgggtaaagggtatactggatttctgtattattttacattctcatgtgaatttacaattatctcacaataaaggttttttaagaaatgtaaatttttgttaagaaaaaattaagtgtgaacaaagaacagaaaagcttcatgaaaatgtttttgatttacctatcctcagtgcctagcacacagtagttgctcaataaatgaaaatataagtgataggattatctttccattgctttaatgtacacacctaaaaacactggttctcaattctaatgaagatgtgtgctgaaaatgcaatttagagttgatgtcaatgcaaatttgtagagtcctatagatatgtaattcgacagttaaaataagatttggagtgataacttttgctttcattttcttaattcttaatgctattttagtctctattacagttatattttaaaatttaattctctaaatattcagcacagtttaatttgacaaaaccttcccattctagttttattttaatgaaataaattgtgtaatatattcaaactattaggtcctctgttatttgctctaggttatcagctaattttttggttaaataaatttaataaagtgctttcttctacaaataattattccaactcttgggaaaacacaaatgaataaaaaaataccattcaaatgtctgttgaatgaagacattttctttggaaagaaaacttttcaagccttaaatggaaaccaccttccctatacatttgtcctccagggtatagccttacatttgattaacttaaacttcaaaaggataaattttatagacctatgttttcaactctaatggatggcatttagcatctattaaacaaatattttaagattgccctaagactgtatacagattatacagttggagctgcaagtacataagcacccagcaggcagataccatccagagcaacatcaaatctcctttgatggccatgcatttctaaacctagctgctatttagggagttactgaattaacgtggattaaaaccctgctcagtggaggataaggtctgctgaagaacagatgttctatatcactaaaaactgtgtgctcatcgtcggaaagatattatgggtctttcatcagatatgtgtctggtggtatcatcaatagggaagaactctgacctcaaaacccaaaacctcggggaagtgaggaaattcatgattctcaaaaaataatcataattaccactttatatcacagtatacttctatcaaaactctactctccctcaatgagtctgtcaaatgaagcaaatacctaaatgctttcagaatgtagtatgagaatgattttttaaatctcataaataaattggaaggaattgaatttctatcacataacatttaggtattaatgtacaagtgactaaatattttccttggcttaaacatcgttaaattcatgataattaattaaaaagaattgtttgtattaattgttatttgtattacaaatgttcatgatatgaattttatacatgtatatgtaaatatatacttttttttagtgactgcatttcataccccatgagcatgaaatgtagcatctggttttgaccgtgtgcattcacttcaaggaaatagggaatagagtcaattatgtaagaaattcaagccaaaatacatttgtgatttatttattcaactatttttatattcaatgttgcattttataaactattgctttatttttcccaggatagaaatgaacaacctggattaaaactctgaagcaatcagattatgtttttctctggacatttactttcaaaagtggcatttaattttttaaaaataaataaaaatgataaaaagtggttagatttattataataatttataataacccaagataggctcctatacaatctggagagaaagatagaggtaaaatgtgagagaaacaaagaagaaaatcttattttttttaaaacaaagaaaattagacacagaatccctgaaacaatgacaagctagagatatgggaagggtctcttgctccaaataattggtttgatgttaaaggtagaagtgcttgtttcacatgctaacaaatgaaggcaaagaactcagctatgttagtgtgcttcaaggaagagttcgttctctttcagcctgtgtcccacgtttaaagtgaagtgtgggtatgaaagttgtatggtacacacttgtgttgtttgactaattgtttggggttttttttggtaaggaaaaaggaatggatagagtaacttatacctcaaacttttcctggcacttctcaccttgttgccattcaaaaatttcgacacgttttaactctactcatgttacgatcagttggagaaaacaatcgcttttccttcaaacttctttgtaatagatgatgatgttgcatgagtcctgaccagcctttccgagagagggctcagtaaatttctaaggtaccaaatgtattttgaaaatactgagccatcaacctgctctttggtaaatctagtttaataaataccaaaatgagcagaccaagccatctgtgttctctctgcttgtaataaaaaaggcatttgtctgatgatgacatgtttttcagagtgcaccaagtactttattttatgatggtatttatgcagcttcctctaaatgaaataatgcaagatgtttattatttcagcatctgctcccatattctcttagccacttcaccagtgactcacatttctttgacacaaaaaaaatcattagattgtttcatctgataattacacaggtaggtctgttttctttttggcatattgttgactttcaatccaacaagtgctatcaaagagaaatgttaatattttgaattaagggaaagagaaaaagtgaaatggatagtaatgaaaagtatttataaaccagttctgatcctgtttaaattgctattgatacatttattgataccccctcctggtttggaaggatttaatatggttgccctgtattagattttgaattcctctcatgtgaccaagaataagatttttaaaaaccacaaatattcacaattgttgttactatcattattattgtttcattctcagaaccactaaggctcagctgctttccctgtatttacatactagagaagtaaatagtgacaagtgttaagtattcacttgaagatcctgctccagaatatctgcttggttgtattttcattgtgctaaattctgacagttaacacgcttctcttaaacacgatctctaacatatttcatgcatttgtacttacatatatactgtagaacttcaggaaagtcacctctaattcctgaatcaaatagtgtatactgaatacagagctgcaggggaatacatgatttactttatataactgcaattaacaggagtaggaaagatgtttacatttagtagcctacttttaaaaaacaaacaaaaacaaaagaagacaatagagagctcatttgaggatagcacatattacatagctcatgagttggaatgttgagctagcactcaggtgcagaccacactggagtgtgaggccatcccattgcagtctggcctctgggtgcccttgttgcaccagttagtttttaaaattctgggtattgccttggcttattggggattttacatcctgagaaaaatcatagatcttaataaataaaccaaatgagatcatgcattacatgattaccccaaagtttcgcctttcattttttattaatgtagatattccatgttaattggatactactgtattcccaaatattttacctagaagatgttgttaccaaggaagacagtagaggacttggtgtttgaatggaaaagagagatgtggagggtggaggttttcaatattagaagagggttaacgtggggtaaattgagataaaaaattgggttttggtcatgttgagattcagattagtgataaggctagtttttgttactggttaagccaatggattacattcacaaatatattaaatattctcaactgcagtgactgtgactttcatgtaatcagaaaccactactagattttactgactaaaacctacaatctacttttaacactttgctatgggtataaaagaaggggaatgaccacactcccacttccttagcccattcatcacacaggcatagttggcatatagtgtctaaaccaatacctaaattcatcctattggaagtgagacagtggctcaaatgagtaccccctgattgtctatagagcgtaagaaccacatcagggtccagaagagagcaagccaaaacttgaagcctgtgatcagaacgctccctaactctgcgaggccagagagacgtgttgcaatttacaatgtgctttgctcgttcccagagttccctaacatgaggttctttgcttgtggggtgtgagtcaagcttattcacatggttaagaacacattaaaacaagccgacaggaagtttccagtggtccttggagatagtctaaaatatgaaacgaaagaaaataaagagatctaatttagcgaacaaaacacgtccatccagactcataaacggtgtgcttatgttcttattccgttttattttggtaatggaaaaaaaggcttggggcaaatacacaaggataattcatgtttccttcttttagctcagagctgctgtcctcacttaacccctccagccacatcaacttaaccttgacaaatcaattatttttctttcaggaaaaaatcactgttattgccaatccatagaacccattaacccttcaagaaagaaaccatcaaaattatgattttaagatctcaattcagaaaactttcctgaaataataagcgcacacaccttaaacataattggaggattcattctaagaaatcctcttcccagtttcctcagaagtctttagagctgtaatacagtgtgagctctcaaaagttattaaaacaaagaaaaaagtggtagcaaaaaatatgaaaattatgaagaaaaggataaatagaatttttttctaattttgtatctttttcatttatatatattcagcaattttgcaaggagaaggagcaattttttatacatttcagtacagacccacaaaataaaagtccgtttttagtgacaagttaaaattcaatataacctataattagtttagcagtatgataaatttcactatttatatctaccttctaataatcttacattacaacgaaagctgctattttaggtaagttaccctctgctcctcatgctagggaggaaaaaagcaaaatgtgtttagactccctggcattttgaaagtgttgattccaatcctcattgagaagacaatgtgaggtgtttgactcagattcatgtatttcagttgccatgctttaaactttaataattaaaggaatctttttcaaaaactcatcaaaatcttagaggtcaggatagttttataatatctaccaagggataaacgaagtagtttatcccatttgtaattaaaatgctccaacagagagcaccttgctccattatgaggacactttgtgaatttgacactaatgtgtgtttaccgttttaaatttttaaattctgacgttctaacaaacgttctaagggtacataggttagatataagaataattatggtctgtcagtattaatgactgtttctcataatcattaatggaaacaatttttttgttgttttcctatcagataactccctttcttattttcacaaatatctatttatgatatttctgttggttatttaggagtgcagctgtgcagctgtaatcatctatcactagacaactattaagtttttcatcatgttttaccaaagttaatttgcaaaagcttttttaatgttcactaatggtcttttctgcattaaaaaaatgaaagctcaatcatgctattttatgggataggtgaagaatccattacacatttttctaattaattaaccatttcctaaacatatggataaataatgcactaaagcactattggcatgtattactgtttaattttagaatgctctatttacacgtagtaggcctaggtcaaggcgggatgctctgctctgctctgctctgctcattgtgtgtctcgttttcagcagctgcactgtgtctttgtatgtgggcttcatgatctcttttaccatatggtatcctgtcttcctcactgtgttttccaataaatgtctacttattcttgcctgtttgcttctgttgatcaactttagaaccattttgtaacttttgtgtgtgtgtatgtgtgtgtgacagagtctcactctgttgccaggctggagtgcaatagcacgatctcggctcactgcaacctctgcctcctgggttcaagcaattctcctgcctcagcctcccgagtagctgggactacaggcgtgtgccaccatgcccggctaatttttgtatttttagtagagaccgggtttcaccatgttggccaggatggtctgaatctcttgacctcatgatcctcctgcctcggcctcccaaagtgttgggattacaggcctgagcccctgtgccctgccataacattttttaaagcaccaaaaggaatgtaattgggtttctgttttatttacatgttcacttgagacaaatagaaggtttcccaatatatattattcacattcacagtgatgttatatagctccattaaaaactagtaataatttcagatttataaaaatttcaaacataaaattaatacagagaacatgtgtatgcctttcaccaaggttcaaatattaacattttattccatttgcattgtaatttgcccatgttctctttctgtgaattttttttctctgaactattcaagtgtaacacatcatggccctttacctgggacttcctcggtgtacattacattacctaggaacagggatcgtcttcatcaatttctattgatagactacatttaatttcttatttatattcgttttattctatttgacttaataatgtcctttataccatttccccccttcagaaccgggtccagttggggtcaagaattacatttagttgccatgtctctttaacttcctttaatctagagcatatccacatatttctttatcttgcattatttgatttttttaaatccctccattttaacagacttgtcctcattttgagtctgttggttagtctaattattataattacactgaaatgatgtattcctggtccaaatatgaaatatttagcattacactcttcacagtgtagcacatctggaggcccatcactgccatgcgctctttcattggtgatgttaatttcatcacctggtcaaagtgttgccaaatttctccgttgtataattactatttgctttttctcccttccacctaatttcagattgaggggagattctttaaggcaatgcaaataccctgttcttcatgaaaccgctccctagatttagcacccatccagaagccttgcctaacgcactcttgccctggtggttgccaaaggatgatcgttcacccagcacctctttcgcttcttgaagtcacccttaaccattctactgcaacaaacagcccccctcttaaccccatttatttattcattattaatgtggactcagtctattttttaatggtgtatcattcagatgcactcattgggacgctgtggtgggaagctactcaagctggctcccgcaatagaccccgtcattttttaagcacttctttactttttggcagaactagagacctggctcatcttgtattgtcttgtcccagccctgtaacgagccattttcctgaggaactctggtttccagatcttggcattcggtatgtccgttgttactggagtgcatttgcatcatggtcctttcagagactagacctaggaaatacatgcacacacacacgtacgtatgtatgtccacacacacataaacagtcatgaatatacacatacacatatgtattttaggaatcatgagctcacagcaatacttccaattccaatcctaccagcagggttttcttcactctcctccattccgtacttagatgccctttcttcaacatgggcagcctgagctccccaccacctcaacacattgatctatggttcaatcctggaatacatctcaaaaggtttagtattgctccaccaggacctctacattaacctacctcaaaataacttattttcaactgcttttgctgtactccaacttttctttacaactgagtataataaactattgtatttataagttaataggattagttttctctaagctatgtggccctgtatgtctctttgtctttctccttcagggtgcttgtgatagtcgtttgaaataaagttaagttcatttttaaaagtttacttatattttagagttttcttttgttcctttctcattctgattgatttaaatatattttaaatatatgtagtattaacatgctatctgctgtggtgtgaatatggtttgtcctcaccaaaactcatgttgaaatgtgatccgtgatatggcagtgtttcaaggtagggcctagattaatgccctcccactggggtgaatgagctctcctaagaacagggattaggtcccccgagagaagactgttaaaaaaaaaaaaggctggttttcttggtttcactgtccagtttcttttgtcaccatgcgatctctctgtatgtactggctccccttccactttccagcataagtggaagcagcccgagatcctcaccagatgcagttgccccatccaggattttccagccaccagaatcacgtgccagataagcctttcgttgtttatagattacccagtctcaggtattctgctacagcaaagcgaaatagaccaagacactatccaaagtcaaaaggcacaaaaacttatactcagagaaggcccaccccaaccctgtcctttcccattcatactcctctccaacactttaaacaacatcattgttttctaatttatctgttccttttggtagcaataagcagatatatgcatgtttttctctttgtcacacaaaagttaggatattttttatggcttccttttacgttttgatttttttcatctggtaatatctcctgcaaagaagtcactgtcaattcacagagcccttcctcatcctttcttacagatgcacagtgttccgttgtatgcatgtgctgaagtagatataataaatctcccatggttaggttttccgatagtttccaatatatttacaattacaaatcatactgcaatgactaacattgagcatgtgcatttgtatattgttggaggtttacttgtggaatcaattcttaagtgtgtgatttctaagtggaagggtaagtgcatacataattctgttgtacaaatgcaaatttccctcctcaggtattccactttgcatttcaaacagcaatgttgggagtgactgtgtttccacattctcaccacagagtatattgttaagcttttcaatttgtgtcaatctgatcggagatgggtaaaaaatggtacctgagtattattttaattttcatttttgttattataagtgaagttgggtgtatttttatatacatacaaagggtctttaatatctttttgaaaattatatttttgtccattcttatataaaatttcaaattttaaaatttctataacatttttgctagtttgtctcctaaattttaaaaaagcttttgtaaaattaagtgaggggtattagcctttaatctgtgatatatcttgcaaatatcttccccagagtatcatttgtcttttgacattacttacgttgttttagccatgtaacttcttatatttatgaacattaattaattaatcttatattttattgcagctggattattatagttagaaagtcattcgttgtagctagattataaaaatattttcacatgttttcttgtaggatttttgtgtctaaacatctaaatttagaactctcatccacttgggtgttttatagagggtggtgattggatctaaatttaccctttccaaatggctgtctagttgtccatctccatttattatgaagattacattttgtccctatgactgataaatcaccataatacactgaatttctgattgtagttgaatctattcgtggaggttgtattctattccatttaattatcttttcattgagatgccagcataacacgttagtagttatggaggcattgtggcatttataaattgtggtcaaaaacacaacacataaaatttatcatgtcaactattttttaaatgtacagtagtgttaactatatgcacatcaatgtgcaacatatctgtataacttttcatcttgcaaaatgggaactctagatccattgaacaactccctgtggcctccctttagaccaagcttgtccaacctgtgcagcccaggatggctatgaatgcagaccaacacaaattcgtaaactttcttaaaacataatgagatttaatatttatgcatggaccttttttttaagcttatcagctatcattagtgttagtgtattttatgtgtggactaagacaactcttcttctttcaatgtagcccagggaaactaaaagattggatacccctgcttcagattctgatgaccatcattctaccttctgtttctatgggcttgactactttggatacctcaaataagtgaaatgatgcatttgtcttttggtgaccggcttaatttacctagcacagtatcctcaaggctcctccaagttgtcacatatggcaagatttccttcctttaaaactgaatagtactccatggtatgtacatgttatagtttctttattcattcatctcttgaggggcatttatgttgcttctactttttgactattgcaattattgctgcaatggacgtggatatgcaacaatctctttgagaactttctttcaattcttgtggatatgtactcaaaactgggattaatttttttaattgccatgctcatttccatagagttgcataatgttatcttcctaccaaaaatacacaagggtttcagtttctccacattctttaccaacactagttatttgcttaaaaattattcattaatttttattgacacataataactgtagatttatggagtacaagtgaccttttgatacatgcatacaatgtgtaacaattaaatcagagtatttacaatatccaccactttgaatattttgctggaaacatttcaaatatctcccagctattttgaaatatacagtaaactattgttaactatagtcacccttagctatctcatacaggaaattattttttctatttaattgtatgtttttaacctttatccaaaccgttgtcattgccccctacttcaaacacacactccatttcccagcctgtggtaactatcattctactctctacctccatgcgatcaacgtttttagcttctgcatatgtgtaaaaacatgtcatatttgtccttctgtgcctggcttttttcacttaacatactgttctccagttccatccccgttgctgcaaatgactagatttcattcctttttatggctaaatactattgcattgtttatatataccacattttctttatttatacattcattgatagacacttaatttgattccatatctttgctattgtgcatagcacttcagtaaacctgagggtgcagttatccctttgatatactgtttcttttctctcgtataaatattcagtagtgtgattgtggaatcataaggtaggtctattttttagttttttgagaaacctccatatttttttctacaatagatgtactaaattactttgccattaatagtgttttagagttctcctttctttgtatcctcacaagcatttttttttgtcttgaaaatagctattctttttttgttgttgagaccttgcttgttgcccaggctggagtgcaatggcaccatctcagttcaccacaacctctgcctccccggttcaagctattctcctgcctcagcctcctgagtagctagaattacaggcatgtgccaccatatccagctaattttgtatttttagtagagatggggtttctccatgttggtaatgctggtctctcacgcccgacctcaggtgatccacccacctcagcctcccaaagtgctgggattacaggcctgagccaccatgccctgaccaaaaatagctgttctaattggagtgagatgatatctcattgtagttttgatttgcatttccctggtgataagtgatgttcagtattttatcatacacttgttgaccgtttacatgtctccttttgagaaatgtctattcagatcttttgcccactttttaatggaattattatttttttcccattgagttgttcatgttccttacatattttggatattagtccctggtcagatgaatagtttgcaaatattttctcccattccacatgttgtctcttccctctgttgattgtttctttgctgtacagtaggtttttagtttaatatagttccatttgtctatttttttttgttttggtgcctgtgtttctcaagtcttagctataaaaatctttgcctagaccaatgtcctgaagcatttcccctatgctttcttctagtagttttatagtttcagtgttgtgtttaagtcttttatccattttgatttcattttttcttttgtatttggtgagagataagaatctagttttcctttttctgcacatggatatccagttttctcagcatcacttactgaagggactgtcctttcctcaatgaatgttcttggtgcctttgtcaaaaataattttgctataaataagtggattaaatttatttctgtgttcttttttctgttaccttggtctatgtatttggttttatactaatgccatactgttttgattactgtagctttgtagtatattttaaagtcaaggtagtgtgatgctccagctttgttctttttgcttggtattgctttggttatttggggtattttttggttccacataaattttagattttttttctgtgaagaataatgttggtatttagatggggattacaataaatatgcagattcccttctgtgatatggtaatttttaataatctcaattattctgatgcatgagcatatctttccatttgtttgcatcctttttatttaccttcaacaatgttttgtagtttttattgtagaagtattccacctcctcagctaaatttattcctaggtatttcattttattttttgtaactattttaatgggattatcttcttgatttccttttcatctagtttgttattgatgtataacaaagctactgatttttgtatgctgattttgaatcctgtgttgtgggaagtcagggacctcaaatggagggaccggctggagccgcggcagaggaacataaattgtgaagatttcatggacatttatcagttcccaaaattaatatgtttataattttttacacctgtcttgactgcaatctctgaacacaaattgtgaagatttcatggacatttatcagttcccaaataatactcttataatttcttatgcctgtctttactttaatctctgaatcttgttatattcgtaagctgagcatgtacgtcacctcaggacgactattgtacaaattgattgtaaaacatgtgtgtctgaacaatatgaaatcagtgcaccttgaaaaagaacagaataacagcgattttcagggaacaagggaagacaaccataaggtttgactgcctgtggggtcgtgcagaatagagccatatttttcttctggcagagagcctctaaatggacatgcaagtaggagagatattgctgaattctttttccagtaaggaatattaataattaataccctagggaaggaatgcattcctggggagaggtctataaacggccgctctgggagtgtctgtcttatgcagttgagataaggactgaaatacaccctggtctcctgcagtaccctcaggcttattggagtggggaaaaaaatcccaccctggtaaatttgaggtcagaccagttctctgctctcgatccctgttttctgttgtttaagatgtttatcaagacaatacatgcatagctgagcatagaccctcatcagtaactctaattttgccctttgccttgtgatctttgctttgccctttgcctggtaatctttattggcctcagaagcatgtgatctttgtgacctactccctgtttgtacacccctccccttttatagtccttaataaaaacctgctggtttgcgggtcaggtgggcatcacaaacctatcgatatgtgatgtcacccttggtggcccagctgtaaaattcctctctttgtactctttctctttatttctcagaccggccgacacctagggaaaatagaaagaacctatgttgaaatattgggggctggttcccccgataatcctgcaaatttactaaaattgtttatcagttctaagagttttttggaagaatctttatgtttttgcatatctaagattatgtcacctgcaaaaagagaccatttgacttgctgttttcctatttgaatgccttttatttctttctcttgcctggttgctccaactaggattttcagtactatttttgaataagagtgataaaagtgggcatacttctctttttccagttgtggaggaaaggttttccgcactgccccattcagtgtaatgttagctgtgggtttgtcatacatggcctttattatgttgagatatgttcattccatgcctaactttttgagggttgttatccccaagggacattaaattttaccaaatgcttttttctgcatctattgagatgatcatatggtttttgtcctttattctattgatgaggatttttatatctttgttcactgggctattgtataacaaagccactgttccccagtgaacaaagataaaaaaatcctcaacaaaatactagcaaaccaaatattacatcaaataaaaaaataatgcatgatgatcaagtaatgtttatcccaggaatgcaaagatacttcatcatacataaatcaacaaatgtgatatatcacatcaatagaataaaggaccatatggcttaaaactcatcctcaaatataacaagcagctatatgaaattacggatgtagaccaaggatgctgaacataccataatggcaatttcatttggttaaatctaatacttatatcaatggtaaattatcaaattatcaatcacattaatctctctgaagtcattttctacattcatataaggcataaattctatacataaactattttaagatataggttctgggatctataacctgtaaatcaagagttattatctttgagagtatgtattttttatattctcaactcctataagagatattttatgtaaatttaatggtttcctaataactaaagtggtacattaagcctcattttttactcttcctccacaaaactcaggaaactaatcaggttgcctgtagttcaatgttgatcaagttaattatctcaaggattattctcattttgtgacataatatattatccattgttgtttaattcccagcaaaatagagacattttgaaaataattttcactgactttttagaattcaagtggctttcacaaatgaaataactttactatcttgctgttattaatctgtacattggctaatctgactttatatcatcaagatgactattttatttgaatgagcatgaactcataaaatctttacaattcctggcttactcaagagacaatcatatagtataaaacagtactcaaattaccatcagcatttattttttcattacaacctcattacaaaactatttatcatgtcgtatagttcaatataaagctggtcaagggatctttataaccgagtgactgataagattattgtcatattttgaaaggcaccaaagggctttttcaaaggacaagacctcagaacagttttatgttgaagtgagaccccagtgtgcctataatagctttattgagatagaattgacataaaccatacatattcaaaatatataatttgataagttttcatctatttataagcctgtgaaacaaccaccacaatcaagatagtgaatatgatttattttaattttatttgctttcaaaataaacatagctatgttttcagaaaatccaatttttccttaaatctgcaagttttatggttccatttcatttaaaaattaagtcatttttcaaaaatgatagtgtgcacagttttattaaagtaattaccatcaccatcattgcaacagcaagagcagcagctacaaaaactcagcaggtcatttttaatagatgcctttttctcactgacataaaacatgagcatctttacagtacaggttacagcaggatggcccatgatggttcatgcaatcgtatcactgttattgcctcaatggacattcctgggtgctcacttaccagcagaagtattttcctcctcagaattcttacctactttgttctcctctgccatgctctactttctcttttctcatctatacttttgggataattttgatataaaaatatgcccaaagagttagactggaaattaaatgtccctcataattcagtaaataaacatctggataaaacagagtttctaataagcttagggtttgttggaataatactcgtttaataaaatactaatttattgaatgcttaaatgaattttttatattaagaaaacgagttagaaaaattgaaatacgaaccacagaaatgtgtatttttaattacagggctttgaataaaaaatgaaatcagttaaaaattggaggtcagccattcactgtgtagattaggattaattagtactgatacatatatattttcaaaatattccattgctataataaatttccattttggtattaagaaaacgacggaaggatatatggctgattgcctagtccatgactttgtgacatattgagacaagggtattatatagaaataataaaatatctctttagatttaaatatatatattttcacatatatttatgtctaagctaatagatatttttgtactaggtaatatgaaattgctcaagagtgctgaaataatcgtaaagaacagtaggagccagttttattgggcagtaagttagaattactttaccagctgtctccagtaactacagcaatactagactgtagaaaacactcaacacatagttgtttaatgagtgagccattaagaaaaaagaatagatctcaggttaacttttattagtgcagcagaatattttttgtaaagaaagaaaatattttatactagttttctctggctactgtatatagatagtaacacactttccaatttgtggagtatatttaaaaatatacattagcaatgtctgagaggagggaagttttattagtagaaagataaacaaaatagtagtgatttattaaaatttgcaaatatattagttataaaacaggaaaagaacacgtggaaagcaggagttttgaatttcaatttcatcacattttcttaattagaataatataattgaaatccagctcttccccaaaaggagattttcccttgcaaacaacttactcatttcctttcactttttctttctctctctctctctcttttttgtttgctttcagtcttttccagtttatttccaaagatgtttttatactcagtgagttctcatcatggcagtattctccacaatgtattcctagagtttcaacttagtttttctcttctctgatcctctccttatcctggctgtacttcacggcctggcagttttctgggaggctcctgtctatcgcttgataccagaggagtggatcaaaattgttccagaagtgaattcaggaagacagtgggcaattaattcaagatttatttttctatataaattgcagaagagaggtagtttggtggaaaatctcatcataataaattgtgaaagttatatttattgagacctattttcccggcatttattccttcttatgctattttatttacttcttatatctctcaaaaacttgagaaccatatgcattgttcaatgccatacacaattagtaggcaatagatggcaaaatccagagtcttatcattaaacgttttagttttttgagaacattatagttttataatgcttaattaatgtattgcttttctaggtacttattatactcaattcactcttttagatgattagaattttataaagatgtatagtgagcctgccctcagttatatgttaactttgcttattgccgaaattttccctgagatttggaatttatcacaataattagtaaataatatcttcttaaactaactttggaaaatttctatccaataattcaaaatatttgactggcaatcaggtaaattaaactgtgcaatacagtaggtagaactctgtgggctttgatatcacacaaacatgaatttaaagatgattcttccacttgtgttatcacaggcaattgaatcaattatgacattcttcagttcattactctataaaaaagggaaacgaagaataactaccttgtaatgcagttgtaaaggttacttgaagcaatttaggcaacatcaccaactatactacctagctcatcataaagactccagactgaatggtcactattgtccatttggttagactcatggttaaaagtgcagctctagaagtctgttgttggcatggatgggtcagctcctactagactaaatctcccactaatagcaacaacacattataaagtatataaacaaagacatccctaaagttgtgaagagttgacaaactatgcagttgctggaggggaagacttggaaaatgaagatggaaccgacacagggtgagcttgctgtttgaccatttttagcatgagacaagtctgcattaacatgctacacgagaagttcttcagttcctctggcctggataaagaggatggagttgaggtgacttactggttctgaaaagtaaggaggcagtcccaggaagcaaagaagcaggcaggggcttcagcttctgtttaagaaatctttccaagtctctggctgacttttcaatcatgcagcttccagccagactacaacagtagaaataaatgagcaaagacaaaagctcttacccaagcagtaaagtttgcagtttgagttcaagctagttaattacctcctaaaacaaaaatattaagacattttggggcactaaaacagaatcaagattcacaatataacattaacaaagtccaagatactacacaaaattacttgacatataaggaaccatgaatatgcaaccattttcaagagagaagaaaataaattggagtcaatccaaaaatgaaccagatgttggaattagcagagaaaggaatgaaagtaaatattattactacacctatgacaggaaggggacaggctcacaatggagggcagagactctcagcagagacataaagaagctaagaagaaccaagtggaaatgttagcgccgaaaaatgacatctgagattcaatattcagtggatggcattaagatcaaaatggagatgaccaaggaaggtattaataccagcaaacatgaagatagttcaatggagaggatctggtctgaagagaagagagaaatatatttgaaaaagtgttgaaaagaggctgaaaccaatgaggcaataccaaaagtgccaacttgtgcatagttggattcccagatggagggagtggaaagcgagaataagacagacaaaacataaataaataacataaacataaatgtaaaaacagcatagccaggtattcctccaaattattaaaagttgtatatttatatttcaagaatcccagcaaaactcacacagtgtaaatgtgaagaaatctatgcacaggcatatcatggtcatgattatcaaaagcagaattaaacaaaatcttatatgtgtatagagagttacacatagaggaacaaatgggccaatattttcaaagtgctgacagaaaaatactaaagacttggaattccatactcagtgaaaattaatgtcctttaacaataaaagttaaataaaaacttcttcagacaaatgcaggtggagagaatttgttgcaaagagaactgtcctacaaagaagcatcaaaggacatctgtgagactgaagggaaatgttaccatagggaaactcagatcttcgggaagtaaaacacaataccagacatcagaaattatttggaaaatataggagaaatgttaaaggtaaaattacatttaaaaatttaaaacatagaaacatatactttgtttttgagacaatgtgtccctctgtcagccaggctggagtgcagtggtgagatcacagctaactgcaacctcgacatcctaggcaaaagtaatcctcccacttcaggctcctgagtagctagaactatcctataggcacatgctaccacgcatagctaatttttaactttttgtagcgtcaaggtctcagctatgttgcttcagcaggtcttgagccccagttcctggcctgaagtgaaactcctgccttggtttcccaaagtgctgggattacaggcaagagccaccatgcccagtctaaaacttcctcttaatttttttaatatacattggaaaaagctgatttcctgtaagtgtccaaatgacaaattcccagctagacagatcaaaaacatatagtgagatacaaattgcagatatcaagaatgaaagaaaaattaaaactagattttgcagaaattaaaataatattaagaaaatattgccaggtgcagtggctcacacctgtaatcccagcaatttgggaggcctaggtgggtggatcacctgaggtcaggagttcaagaaaagcctgaccaacatggagaaaccccgtctctactaaaaacacaaaattagccaggcgtggtggcgcatgcctgtaatcccagctactcaggaggctgagacaggagaatcgcttgaacctgggaggcagaggttgcggtgagctgagatcacgccattgcactccagcctgggcaacaagagtgaaactgtctcaaaaaaaaaaaaaagaaagaaagaaaatattaagaaaaatttatcccactaattttgaaaactgagataaatgaataaattctttgaaaaatacaacttaaactgtaagcaaaaatgtaaaaagagacactaagatgaaaggtaaatgtgttaaatttattaaatacatttttattaaattcattttttaaattattaaattatttataaatttgtttaataaattttaattaataatttaattatcaatttaaccaataattttattaatccatttaacaaaatttaattaataaagttattaattttatttaacaaaacacattttattaaataacatttaaatgtattaaataaattaaatatttatttattaatatatatgctgccgaagtgagcactatttatttgtttttattatactttaagttctgggatacatgtgcagtaatatatgtgccatggtagtttgctgctcccatcaaccaatcatctacattaggtatttctcctaatgctatctctcccgttgccccccaccccacaacagatgctggtgtgagatgttcccctccctgtatccatattttctcattgttcaaccccacttatgagtgagaatatgtggtgtttggttttctgttcctgtgttagtttgctgagaatgatggtttccagtttcattcgtgtccctgcaaaggacatgaactcatccttttttatggctgcatagtattccttggtgtatatgtgccacattatttttatccagtctatcattgacgggcatttggattggctcaaaatctttgctattgtgaatgctgttgcaataaacatacgtgtacatgtgtctttatagtagaatgatttataatcctttgggtatatacccagtaatgggattgctgggtcaaagagtatttctggttctagatttttgaggaattgccacactgtctgccacaacggttgaactaatttacactcccaacagcaatgtaaaagcattcctatttctccacatcctctctagcatctgttgtttcctgacttcttaatgattgccattctaactggcgtaagatggtatctcattgtggttttgatttgcatttctctaatgaccagtgatgatgagcttttttctatatgtttgttggccacataaatgtcttcttttgaaaagtgcctgtttgtattctttgaccactttttgatggggttgtttgtttttttcttgtaaatttgtttaagttatttatagattctggatattagctctttgtcagatggataggttgcaaaaattttctcccattctgtaggttgcctgttcactctgatgatagtttcttttgctgtgcagaagctctttagtttaattagatctcatttgtcaattttggcttttgttgccattgcattttatgttttagtcaagaagtctttgcccatgcctatatcctgaatggtactgcctaggttttcttctagggcttttatggttttaggtcttacttttaagtctttaatccatcttgagttatttttgtataaagtttaaggaaggggtccagtttcagttttctgcatattgctagtcagttttcccaacaccatttattaaatagggaatcctttccccattgcttctttttgtcaggtttgccaaagatcagatggttgtagatgtgtggtggtaattctgaggcctctgttctattccattggtctatatagctgttttggtaccagtaccatgctgttttggttaccgtagccttgtaatatagtttgaagtcctgtagcatggtgcctcccaccgtgttctttttgcttagtattgttttggctatacaggctcttttttggttccacatgaaatttaaagtagttttttgtaattctgtgaagaaagtcaatggtagctggatggggatagcattgaatctataaataactttaggcagtatggccattttcatgatattgattattcctatcaatgaacatggaatgttttttcatttatttgtgccctctcttatttctttgagcagtggtttgtagttcttcttgaagatgtccttcacatatgttgtaagttgtattcctaggtattttattctctttgtagcaattgtgaaagggagttcactcatgatttggctctctgtttgtctattattggtgtataggaatgcttgtgatttttgcacattgattttgtatcctaagactttgctgaagttctttatcagcttaaggagattctgggctgacatgacggggttttctaaatgtacattcatgtcatctgcaaacagagatttcacttcctctctttctttttgagtaccctttctttctttctcttgcctgattgccctgtccagaacttccaatactatgttgaataggagtggtgagagagggcatccttgtctttgggcggttttcaaagggaatgcttccagattttgcccattcagtatgatattggctgtggatttgtcataagtagctcttattattttgagatatattccatcaatacctagtttatggagagtttttagcagaagaggtgttgaattttattgaagggattttctgcatctactgagataatcatgtggtttttatcattggttctgtttatgtgatggattatgtttattaatttgcatatgttgaaccagccttgcatcccagggatgaagctgacttgatggtggtggataagctttatgatgtgctgctggatttggtttgccagtattttattgaggattttcacatcgatgttcatcagggatatttgcctgaaattttctttttttattttgtctctgccaggttttggtatcaggatgatgctggcctcataaaatgagttagggaggagtccctcattttctgttgtttagaatactttcagaaggaatggcaacagctgctctttgtacctctggtagaattcagctgtgactccatctggacctgggcttttttggttagtaggctatttctgcctcaatttcagaatttgttattggtctattcaaggattctccttctttctggtttagtcttgggagggtgtatgtgtccaggaatttattcatttcttctagattttctagtttatttgcatagagctgtttatactattctctaatggtagtttcgaatagaactaataaagatagggtaagagatttgctaattaaaatttgacaatgtctaacactgagatttagttagaaataatattctttatgtatcttatagatatgttaggtgtaggctttatcaggtaataagtaagaaagagtaaagatcaatgtatttcttgatctcaaggaactttttaaattcagaataatgcattttcacaattttaaggtgctatataggttacattttcatatacctataaattatatacacatctaaaatcaatttattttagagattagagatatgagtaaatttgatataaattattagcataaacattagctatcaaccacttttgaaatggtactcattaggaggttattctccaactaacataaaatttcttatatcatttttctatatgcagagtagagaaattcaagccataataatagttgctatttaagatagtccagctctgctcttttatggaaagaaaaattataagaattcaagaaataacacatatacaaatatcaaatttttgtcaaatttagagacaagattttataatgttcatcttaaatcatcacaataagaaatagtttagatccagatttatctcttattaagaattcctatcaattataaccagatttcatatcagctttgattctttttttgtttttccactgtactatggtttaaatgtgtcccaaaaattttatgtgttggaatcttaatccctaaatttatacgttgattggaggtggaacatttaagaggtaattaggattaataaggtcctgagggtggggcccccacaatgggactggaggctttataagaagagaaagaaagagctgagttgacacgcatgctcttgccctcttgccatgcgatgtcctccaccatattatgacacagcaataaggcccttgcaagatgtcagctccatgctcttggacttcccagcctccaaaaccataaagtaaataaacgtattttctttaaaattactcagtctcaggtattttgttatagctacagaaaacagagtaagacaaactcaatctgatgacacacgtcaactggtagacacaggtagcttctttagctgagtcaatctggttcgtgagatgtagaatatagcaaagcttacagtcaaagggtagggccccaactgctatctattttgtcctccaagtcatatttactaatagagtaaagattctagagcttagaggagcgctttagtacctattaccccctaagaaacaccatccactgatctgggggcatagcttctgcctaagtttggcttagatttgcattctgattgttgaatactcttgtggcctcactctttttacattcacaattagaactggagaccaaatttccatttctctggctaggctgtggtgcctatcaaacacagtttggagccaagaggaagaaactgcaggaatatacagactgcctgcatgatatacttctcaaatattacaacttaatgtcacaaaggtgaagaaagatatgtagttgacccttgacatgggcttgaactgcatgggtccacttatttgtgagttttcttctgcctctgccagccctgagacagcaagaccaacccttcttcttcctcctcctcagcctactcaaggtgatcaagacaaggatgcaaacctttatggtgatacacttccatttcataagtagtaaatacattctctcttccttatgagtttctcaaaaatattttattttctcttgcttactttattggaagatagtatctaatacatataacctagaaaacgtgtgttaattgactgcttatgttatctgtaaggcttccagttaacagtaggctattagcaattacgtttttgagaagtcaaaaagtatacaaagattttagggtatgtgaggggtcagtgaccttaactcctgcattgttcaagggtagactgtatatctgtaaaaaatgaatcacatttatgcttacaaaatctatgtatctgtttgtgttctggtagtcaacattgtacactttgaatgtactaattaaaccatgaactattaacctatgaacaccactttatggagcgatctcctacactatatcatactgtgcccctttgcccagcacttcagctctgtgtagtttccctttttcagatcatggtgctgttttcataacctccaagcatcaataaagatgttatcaatgagagacaaatctttcaatgctgggctccagacagaatttcacaaaatggcagctcctgtattttctcttatttgtgctccaaatcatcttattctcctaatttggaaataacccaccccaaaataactttaaagagccaaatatgttagaaagcaaaatgtagaagtattataagaaaatataggcaaatggttgtgatagttggaaattggtaagacattcttaagcaacatataaaatgcaaagccataaaggcacacattaagataattagtaacatgcaaataaagtcaccctatcttctccttccctatgcaacgtcaccccatcgtcttcttccctgtgcagggtcaccccatcttcacccagacccaagacccaatctcccttccctgtggagcgtcaccccatcttctccttccctgtgcagggtcaccccatcttcatccagacccaaggcccaatctcccttccctgtggagcgtcaccccatcttctccttccctgtgcagggtcaccccgtcttcacccagacccaaggcccagcctcctttcactcctctccactctccatcactccatttggatttccctttgtgtgacaactcatgctgcaagctttttgctactgtctttttcatagaaaaatccatgttcttgttccttatttcatatttatctttctactcacataagattatacaatcatttcttgaagtcaggcccttaacaaaggagtaactaaaaatggctttcgaccctggaaataccagagaaggctttttgccttttgcttttttttttctttatatcagcctatctagcgatgtcctgaagcaatataaatggccagcattgttccagtactccagcattccattcacgcttatcgatctgatattcgtagtgaaaatcccacttttcccccagtcacttgatctgtaagaggtgagaggaaacttcaaagtgattgcactgagcttccgtggcttttacgcggattttagaggaagctgattaaacggtgataagtactttcaaagtttcaaatgcgatttctgttctaagcccatattaataagtcattttaatatactgaacaaaactacagatgtggctagaacaaagaaacattttagaccaaagctcatgtatttatccaagtgccaaatccctttggctggactgcttgtcttttacaatgcctgtgatagagaccagagtgtttagaataggacacttatgtgacaagcctttcacaattaattttagcttagccataccaaacataaaccgtaatagtattcctggaaaggaaatgcgtaaccatcacgaataccagagtttttaagacaaaatagtttaatcagagtcagggtatcaaaaacacagagagaaaagttgaaaaattccccaggaatttaaaaataatttgttcatttggcctgcaaaaaaaaatgcacttgttctgaaattcatacatgccaacattatgcctaaaatacagaagagatagaagaaacgaattgaaatccattgactctgtaaaaattgagatgacactggctggatggactgttaaatataagattttggtacttatcggagatgacggtgagattaggactaaaatgagacaatagaaatattatggggaaacgttatattacatgaagttctgaaataaaaacattttggagaacattaatctggcacaaaattttatgcatgttaatgataaaacggcttttcaatgttaacttactggaaaataaaatattctgtttgtgaatcagtggttaactggtgtcatgagggagctgctaacctctagcagataggctgcaggtgatctgaacgcaagccaatcccatctagatcatggagaaagcagggtagtgggaggaatggcaccaaagaattaaatgttaaatgcttggaaaactaaataaggcaataattcttacaagctactctcaggtgagaatccaattacgataccattattatgaatacattttccttttattaaatagaaataatttaatgaaggagtgcctttcattttgagcctcatcgtgcagctttgtgcaaagtggcctatgggtgtcaataaataggaactaaacgtgactatgttcttggaggccaatgagatcatctatgtaaagaaaaggcagaatgttggaaatgatcattttatgataatgattaaaatgataacttttaattattcatactccctgcctatttaagaagctaattcctttcaagaattaggccttgagccacaacagaataaaatataaagctcaatttgctttttctagtaaattacaatggactagaatgtaatataagccaatattttttaaaaatcagttgtgttgtctttctccagacctgccaatcaatcacagagaaatagtatgtattcttccctctctgattccgttgagtctagatagttttaaaggcatttacattagatcttcagggctccacacaagtttaagtaacttatttgctgccacaaaaaattaatttcatagatattctaagtaaatgtccatgtttaaacagcttcacatttttctctttttcaatgactctaattcttggacaaaacatatttctctttacaaattcatttatgcattcataaaaattcaaatataaagttaaagtttgggatattttaaaattttctatatcttataattcagggtagacattatggaaagtatggaaataagcactttagccaacaaattcttcaaagcaggcattctactctgtgtattttcaccagagcctgtggggagttccagatcagaaaacccaatttatctgtcactgctgttgtcttggggaaccaggatcttttgcaagtttaagacccagtgaacttcttacatttccccaaagaaataagattgaattttatgtaaatatacatccaatgacatttaagcttacctcatgtgccacaaaaactataaactagggtcaaacagagatattaccttttaaaaggggatacatattcaaaatgaaccaatacttttttctcagaaaaatagctattgcaggagaattctaacaaaaaagataaggtcttatttcttaaaacattaacatttagactaggaagcatcaaaggacatctcagagactagggcagctcacctgaaaggtcattctactgccaagttttggattacaattgaattcagcttctgaccccagaaatgaagataaatggtggactctctgcatgatgttaacttatatttttgaagaaagtcttgttacttttttaaactttgttctgtatagtgcactgactcctttagcatgtatcttaaattagcttgcttataatattctttctctctctttccctctcttcctgttaaaatgaaaacaaagtactctgaaaaattagaatgaactacagcctcattaatgtatgtgtatgtgcatattgcatctgtgaatgaaaatttgtaatgtaaattaactgataatttaagatgaatactcagttcattattactttggttttagcttttttctagaatctccatttatagacataataattttctttttacaggatacagtctgatttctaccattctcttgctcttaaaaaattattatctcaaaggtcaataatgacattttaattaccaaatgtagtgactgttattttcattgatttccttattgttttcattgattacctgcagcatttgaaacacttgccttcattcctttttgaaacatgtccttctcccttttctttctttttccttcctccctccctccctccctccctccctccctccctcccttccttcctccctccctccctccctttcttccttccttccttctttccttactgcctgtctttagcttactaagggcttagaaatttgaagcccagcaaaccaacagtgatacctacataccagttgtgcaaccttgagcaacttgctacctaacctgtctaatcagtgtggtgtcagcttgtgatgtcaagattgagcttaaatgcttaaatgcttagcttaaatgcttctgtcaattgaaaaaaaaagatataaagaaaatggtaatacgtgcaataaaatcctgagtgttgaagccctagccactcttgagaggttctcaaactaggtagatggtgggaggcctggacacatcgccacaaaccaggttcaggtatggatgggtcttagccctttctctctcctggactcagtggctgaatttccaaatagatatcatcttgtgaaggtgctgctaccattgcagatgcaaaaatagccatgaactcgggccgagcacagtggcttatgcctgtaatcctagcactttgagaggccgaggcagagggatctcttgagaccaggagttcgaggccagccttgccaacatgatgaaatctcatctctactgaaaatacaaaaattagtcaggtgtggtggtgggcacctgcactcctagctactccagaagctgagacaggagaatcacttgacccttggaggtggaggttgcagtttgccaggattgtgccactgcactccagtctgggtgacagagcctccatctcaaaagcaaaccaaaaaaagccatgaaatcagttttctcatctcttcatcctggggacttgagagctctctttccctcttccttgctctgcatgtggaatgttatgaaatcttgcccttctagctgccctgtgtgcccctccataattctcctgccaccactctcatagctgccctgtgtgcccctctgtaattctcccgccacagccacaactctcatagctgccctgtgtgcccctccgtaattctcccgccacaactctcaccacagggctcactttcttttgccacagctattgtggtatcttccatatgttccctttccctctaatctttccagtcttgaacccaacctctctgtggctgccaggtgtcaagaaagaaaactccattcaggttgttcccctacaaatcccacccccacctgccactatcggcactgctctagtgatgacttctgccagcataccacctttctttcttctttctttttttgacagagtctcactctgtcgccaggctggagtgcagtggcgtgatctcggctcactacaacctccgcctcccgggttcaagcaattctcctgcctcagcctcctgagtggctgggactacaggtgcgcaccactaagagcagataatttttgtatttttagtagagacagggtttcaccatgttggccaggatggtctcggtctcttgacttcatgatccacctgcctcggcctcccaaagtgctgagattacaggcatgagccagcgcgcccagccgcataccaccttcctatgctgtgacccccacctgttttagcatcttatctacttagtcactcattgatttcatttaatatcatatacatatgtactgagggcctactgcatgtctatagttatagtagtgacacacatcacatatgagctcccacttccatctcacttacattacaaaaaggagaggttgatgacaaacagctaaaagaataacaaaacaggacgatgcaatagaggacgaatgaggagagaaggatccatttcagatagttagccagtgatggcctttctccagaacagacatttgagctaagatctgaatgtaaagaggaagccaaccacgctaagtttcagcagaggcttccgggcagaagggaggcagaaacaaaaccccagtgcgagccaacatcaacatactatacacactcaggccaaaactggactcctggctgattcatgactcttgctttgcaacttgtttccattaatgctgttgttcatgatggttcctctactccaaccctttttgttaaaatccatccgtcaagtcctaattcgaacgcaaccctgaagtttccctttttcatcaaaattacgtgcattcttcctctccattaagacttgtctcattcttggagttttatattctgtcactatgtacttatctgtgtgctcagctcatgcccctagcaaagtgtgtgttaccggaggacaagatttaaaataaattattggtttttgttctgtatggagtctgatataatgttttaagtacaagaatttttcaaaaagtatttatggaatttgagaaaatgtgcacacttatttaaacatcagactaccatttactaacatttgtctgcagtgatcatggcttccaattaccctctagaaaacatccaaagtgcctcacaaggatgcagggcttttgcgatctggcccccaccttcatgttgcagcttcaaacttgtttacactgggctttatttccctgttatccagctatgtttagctatttttatttctcataatggagcatgctatctgtccatattcacctttgcacatgccattgagttggcttggactcaccgtccactcccagccaccacaaatctaccttctccgttgctcccgcctggatggtagtctaggacttcctatgccagcaccagactccccagaaagcatttcttttcctgtctctgcccacatgtggattagcagcccatcttatgtgtttcctaaagcctcatatttatccctatcccaacactgaagaaagtgtggtgatctactcatttatttacttctcctaatgcactacaaggttctcgaggtaggaagttaactaagttctccctctcattcccagtgatagcacagttcccagcatatagtgagtgtttaataagtatctttgaaagaatgaatgagctgatcaatcatgaattccgcaagagcatcttctataggccactgcatcctcactgcctgggacagtgcttgattaatcatgaattctgcaagagcatcttctataggccactgggtcctcactgcctgggacagtgcttgatcaatgatgaattcctcaagagcatcttctataggccactgcgtcctcactgcctgggacagtgcttgatcaatcatgaattcctcaagagcatcttctataggccactgcgtcctcactgcctgggacagtgcttgatcaatcatgaattcctcaagagcatcttctacaggccactgtgtgctcactgcctgggacagtgcttgatcaatcatgaattcctcaagagcatcttccataggccactgcgtcctcactgcctgggacagtgcttgggtatatggtcagcactcaataaacatttgttaaatagaggactaaaatattacaattatgactgtctattttcctctattttttcacacttgtgctgtgtatttaaggggactgactaggctgaggtgaatagactacagtgccttctctccaggaactcaggatcttgttgagacacaaaatactttaaatatgacaagctgataatatcaactgtttatagataactcataactctaattgacttaaaaactacatagtggaaacagcatagaacatgaattgaaacaaaactggatttagttatggtgtgattgtctaatcacattttacatttctcacctttggcgtcagccaatgtaactgaggatattaaggtattttggatttggaggacgatgtgcctggaaatatgctaaggcattttggcatctattctctagtcattggggcaacaataaaatattaaatattctttccaaaattcaaatgtttgtatttgtaacatttattcctgatgctgtatataaagtataatgctaattaaactacagtccccattctcgagtgggcatttttgttttgggttatgactggaatagtctctatttcttatgaactacgtggatttatccagtgaaacttccttcagaaattatataaggctgttaggatgcaggactcactgtagcaccagtatcatttcttccctaaacatgaattatcatttaaatttacttcttaaacaacgcttttcatgagtgaaaaatggcatatgtcatatggataaagaatcaccgaatgacatcagtgtatccaaaaccattgcggaaagataacttgaaagtactggattaggccgggcgcggtggctcacgcctgtaatcccagcactttgggaggccgaggcgggcggatcacgaggtcaggagatcgagaccatcccggctaaaacggtgaaaccccgtctctactaaaaatacaaaaattagccgggcgcagtgacaggcgcctgtggtcccagctactcgggtctgaggcaggagaatggcgtgaacccgggaggcggagctcgcagtgagccgagatcgcgcccctgcactccagcctgggcgacagagcgagactccgtctcaaaaaaaaaaaaaagaaaaaaaaaaagaaagtactggattaagtctaacgccttaagaggaggcggatggtttacatagtccttgacactggaaacatgtctcaatgacactgtatgttttctctctttagttttcacttcattttgatccatcgcttcatgtgaattaaacaatgggagcaggtggtatggaagtcctgatttgaccacattc

SEQ ID NO: 688 - DNA, 609168 bp, Homo sapiens
tgtctggcttccttttgtattgagaagtgacattttgcattatgggatgagtaaatcgagcctcaccatagtttggatcagcctatctgaagtaatcagtgtccttatgctacgagtacataaagatgatcagtgcagcccagctattccattgtgcctcaacatgtcattctgttcagagcagagtctctctagaagctcagcctgtctggctgtcactacagctcggcccattgggagatgtacatgaagcatgaacacccacatcttcacccagttgaaatgcatccaaatggaggccattttctaggccaggggttgtcagctccctgggtggcaaaccggtacacatagcaggaggtgagcaggaataaggaagcattcctgcctgaactctgcctcctgtcagattggaggtgggattacattctcataggagcgcgaaccctattgtgaactgtgcatgtgagggacctaggctgtgtgttccttatgagaatcaaatgcctgatgatctgagtgaaatagtttcatcctgaaaccatcctccacccccttcatggaaaaattgtctttcacaaaactggtccctggagccaaaaggttggggaccaatggtctaggtgacatcaaagtgagacagtgggaaccactgtctcagcaacagccctctgacttgtggatgcttccaaagagccttcactttgtgtaaagggtcatcttcccttccctttccccacatggcctctactcctgccctgcaaatcctatctatgatggtccatgacctgggaagatgggagagggaaccccaggagagatccccactatccaactccaaggacgtctgacgtttgtggaacactaagattatgaaagagaaacaacactgcagtgaggaccgctgattctggggcaaataaaaataatgaagtgagaaatgaagaaccttgaacaattctaattccttaagagatgtgagaacatacattaccataaaataggtagaggttgcaatgaggaaggactcatcagagactaagaaacaactcttggaaattaaaataaggctgtcaggtaactacccatgaagctgaattccacactagtcagctggaaaaaaaaattttttttaaagtacagaaaatttcacagaatacaaaataaaaaggcaaacagataatatgaaacaaacggtaagagaaatggaggctagacccagatggtccaataaatatctaatacaggtgtttgaaggacagacctgtggcagctgaagagcctttcttctccaataattaaaacataagtcctgggattcagtctcactggactaacttgaattgtaaccctatccttgaagcaattactgtaccagaaatatggagaaaacatgaaagtgatatattgattttcaaatgttaagatggcttaaagacagaacaaatacgtaaaaatttatggatctgaatgcaaatgttatcagtcttgcctatgtaaatataaagttgcagtttacataagatgagaaaaagaactacataagatatgtgtagagaataggttcctaaaattgaagcttcaagtgatgcttaaaattgtcaaaaacagaaaaccatttatgtaccttatttaaaggtactataatattaactgaagaactaaaataactttccttaatttaagaagagggactgtcaagctaaatccctcctcttatgtagaagagaatcaacagttagtacctaaagctgataaactgaagaagtatgttatttacaattacagtagggaacaccagcagaatttaaaagagaaattattacaagttctctctggagagttggatttggtttcaaaatggattgaggggattctattagcttttatttcatacccttctctatttttaaaaaaacaatttgcatgtagtcagccctctgtatctgtgggctccacatccatggattcaaccaaccgtggacagaaaatattcagagggaaaaaaattgaatctgtaccgaatatgtacagatgtttttccttcttgttatttcctaaacgacacagcataacaactatttatgtagcatttacattgtattaggtattataagtaatctagaaataaagtataaaaagggtgtgcatgggttatatgcaaatattacaccattttctatatcagggacttgagcatcccaggattttggtgtccctaggtgtcctggaaccagtcctccatggatacctagggacaattgtattattttgtgatacaaatgtgtgcataaatacatgagtaaaatatgtaattataaagctagaaaactttagattatcttagaatagtatctgtaaacatttaaatgatattactatgtatatacataaaacattgcgtgagcttgggaaatatacatatttttgcacttgtaagaactgttaagaggtggaaaatatttttctattctagcagttgacagtttctttctgtaaagggccagacagtaaatatttagggcttcgtgatcataaggaacaattcagggcattatgtatgtacatatataaccagggaaaaaaatcccacaatttgtattgtcaaaatttagaatatgataaaaattgactatgattttgtcataatacaaatttactaatgagaagaacaaaaaccttttttgaggggaaaggtgataatattttgtttagttgcggttcaaagtgagtgttctctcttgtcaacccagttttaacattcatctgtaaagacagactcatttgtgggccgtaaaaaaaaacacacgtgctggaccggattttgttcatgggctacatgtagttcgccgactgccgctctatttagtctgctcccatttagctggaatccagacttaggatttctcagctctctgttgtgaatcgccaggtttcttctcagtttgttgcagaatcaatactctgttaaacaaaataaaaactgagttactataaaaatgaaatttaaaaaaaaagcagacatacaaaatatagcccccaacatttaattattagaattaataaacaaaattatcctgctaaattactacaaaagtttctgaacacttacattttcaatttccatatttatatagtggcaaaaagataataaagagctttgcagcctgatcccaaatagttccttcatctttttggacttttaaaaaatatattttctaactgcattgtagtataatttctaacatatatggcattgccaaaacttggaatgtgcttttctgcatcattagtgacttctgacttctccgattggaacacacgtatgtttgtttcctttgcaggcctaattggcaagactgcagataccctagaggaattgaggaaaggtggataaagcaactgattgctttttttcaggaccctttagtctatttcctttgtgaattcgttcatttggaggacaaccttagaatgagcattagttaccagattgagccatcaactatcttccgagagacaaactataatttcctgaatttattacccaatattttataccacttgtcttgcagtattttgctgttataagatgcatttattactgatgatttccatctactaaggcgtaagtcaaaccagcattccattttgtcactcttctgcatttcatatttagccaacttagagttcgatggaatagaaatacgctctatcgaaattactcaattactgtattcaaaagtttccacaaatgctgtaggtactaagagaatatttatgtaaattcacattttccaaccatgctcatctatgttagtttaaaatgcaagagttaaatttttcattttgtggtgatactattcccaagtgcattatgttcattgctttgaagaagcatctattacatcttaaaacacacttgccatcattttctttctttgtaagaatgaaaacactttagagctacagcagactcttaattaacttaagaaaaagatgaaaaaaaaagccttgcttcctttctctgtctctgtcaggctgcaggaggactacattcttgagtaggaaatgaaagatttacgacatttttgagactacaatttttaatgagatgcacattccttttctcatgtaagccttgtctcagggggtctcggagcagagagggaagggtttttttgtctgcgtctcctgatggtcctcactggatacgttttgtggagtgttcttctgtttaagaattattttctttcatatcgttttccccattaaacacatatcttatggcatatttgttttgtgccatacaaaggaaacgaaaacgctaagtcctgtttatagcaaccgtttacctgagtatctggaatctatacagtgcacgattttctccaaattacttgtatgtttctattctttaaaataaagaataaggtaattataaaacagtattctgatgtgtaacttccaagatcctaatttctctcatacatattgctactaatggcctgacaaaaaagaaaatatacttcatatacttttctttacttcagtcgcattaaacctaaactgtgtaaaattgatccttcttgaatacagagttggagctcaaccattgttgtatgttctcatgtcactgttagaaaaacaaaaaggtgcttttaagatcaaagaacaacacaaacccagaatacacagtcatggtttgaaaacatagttttagaaatgcacattttgatcttaaaagatcaatgaaggaaagggtttgtgtactagactctgccacaaatgagtacctatattttgcatgtgacatgctgaatgtaatcatatcaacactagtgaatgaatatcagggtatgccacaaacaacagctcattctgattaactggctcatatgctgttttcagtcttcctcttgggagaaaagtatctcatatcaacaaagttgatgtttctacaactaatgtaattccaagctactctacatagcctaacatagagcaaccatgaggttttaaagcatttttcttatagaatattaggactcacaaatacacttctaaatctgcttcaaaataccttgagttcttatcaacactgacactaagttatcccaggtatccatattataaataagcagataagaataatttcatatttttgcaataaaaggatgctatgtagctcatactgcataaaattttcaaaaatataaatttttggctccacggccttcatttcaagcatcttctaaatgtgtgccatttctgcaatcagggagatggcggctggacagcaatctgaaggtgctgattagaggtgttcagggatgaacccaatcaaaacagttaagggcaggaacctgccagttccagggagtttcacactgaatggaaaatactgagtaatcagaatttcaagcagtggccaatgacacagaaaactcataaacattctaaaataaaaatgttgcaggaatgccacctaaagttttaaaaatctttaacaataataataatagttaacatagatgaagtgcttactatgtgcgagggactcttctaaacatttttacatcatttgattcttacagcatttctgtaagtatattattatccccattttaaaatggggaaataaaaacacaaagaagtcaatatcttgcccaagattacacagcacagaaattctgtaaataagattttaactctgatagtttggtctagagcctgggctcttaaccactaggtataatggtaagcaaacattggtgaaaaaaaagtccttatctaaaactatgaaaattaatgttaacatcatcaccaccaccatcatttaaatattggatatgcttgggtttaaagcacaatttagttctgctacttaggagctccatcgttaacatgtttcttaacctctgtaaaatggtacaatagctgtctttcagggttactgcgagattgttatgaatgtatgtaaaccaccgacacaacctcctggcacatcgcagttgctccaaaaggggtatttttattataagtatgataacggaagtgatacatgcatgctgcttacattaactgcttaccagatgattaagcagatatgtctgaatatgaatacaaaatataaatcccacaccagcaaacgtctcaataaaacatttcaaaaaatgtattgggtcatgaaaatgaacttcctagatgtagtgttttacggttgtgtatcacatacgtataacttagggcataaggagaagtctcggcccagacttcacagcctcagttttgaaaaaagggtgtccatggtaggtgtttgatacgtgcttggggctgatgtttatgctgagtttcaatgatcattctcccacattaacgggtttggctgaaaatatcaatatgcaagtagcagatgtgtatagcaactcaaaatgtttatatagcatgaaactcatctatgcaagacagagactttgctggtatactctccaaagcttgaaagtagaggccatttagccgtaaggcaacggtcccaatctgctggtccctaacaccaccccttaagggttcccccaacctacagtcgcaccaagtactatttgcaaactaatcacaagctgctattctgattaatagactacaaattaactcggatggattgttaaggtcatagtagcatgtgtgtgtgtgtgtgtgtgtgtgtacagaagattttctttctctggggtaaatgcccaagaatgtgactgccgagtcatagggtaagtgcatttttaaagatttaaaatgaaatatacttgatttttagagcagttttagagcaagtgaagaaagtgcatatataccctctccctccacacatgcacagcttcccccactaccaacgtcctgaaccagagcagaacatgttagaatccacgaacctacttggacacaccattattccccaaagtgtctgtggtatacattaaggttcgctcttggtgttgtatattctacaggttttgacaaatgtataaagatacatactcaccattttagtaccatccagcaattttcattgccctaaacatctactgtgttctgtctcctcatccctcccttctaccccaattcatggcactcactgatctttttctgcctttttcagaagatcatatagttgcaatcacacagtatgtagccttttcagagtggcttctttcactaaataatatttatttcaggatcctccatgtttgtcttccttgatagttcagttccctttgttgaggaatatgagtccattgtccaaagtggcacagtttttttatatagtcacctgctgaggggcatcttgcttgcttccaagtttgggcaattatgaataaagctgctgtaagcatcacgttttggtttttgtgtggatgtaagttttaacgcatttggttaactatcaaagagtgcaattgctgaatcctatgataagaggatgtttaatttttaaagaaactgccaaactgtcttccaaagtgggcgtagcatgttgccttcccaccagcaatgaatgcgaattcctgttgctcctcagcagcatctggtgttcatattgtagactttggccatcttaataagtgtgtagtgatatttcattgctgtttgaccacagtagcttttcatcatgatatagtatctcagtaaaaacacagaaaaagtataattactttatcataaggggaaactcaaaattttgttggaaagagggactctcatattcaaagaggtaagggatcactaagtaaaaggatcctgatgagaaaattgtacatttcaaagtacttgtgcaaaaatgtccccttttactttctggccacacaccattcctttacctgaaactctggtgcagcctcccagttcatgctgtgcctcctatttcttcccaattttatattccctcaaagcacataagggaaaatttctctttctctttctcaagagaaattctctaaaactgtgctccatgagatcctggtattatgcaagatgtcgttaaaggctctatgaaacaaagttccatctgtttaatataactcgttacacttctccttctctccatgcatggagatacacaatatttaatggcccattaaagggtttgagaagtattagaattaaaacaattaataaagtagcattccaaactatattcacatgtcaggggccccatgggtaggcggtggaggagagagattcagcagaattttttttcaggcagcaccataattacctagaaaacatcatgattagaagaagtcatgtgtctaagactgtcctttctgaaacaagggagcaatttctactttaaagatttttaaagggtgagagtggctgggcacagtggctcaggcttttaatcccaacactttgggaggctgaagtgagcagatcacctgaggtcaggagttcaagaccagcttggtcaacatggtgaaaccccctctctacaaaaaatacaaaaattagccaggcgtggtggcaggcacctgtaatccccgctgctcgggaggctgaggtgggacaatcacttgaacctgggaggcagaggttgcagtgagctgagatcacaccattgtactccagcctgggtgataaagcaagactccatctcaaaataaataaaattaaaaataaataaataattaaaactgtgagagaaaatatagtggagatatggataaagaagtcagaggagtatgcagcacatcacccttccttagaccatcagtaaaagtctgcaagatgaggaaagtggatggtactggatttcctatataaaacagtgacggacggaccagcacacaaggtggccacatggacaagggatagtctgcatggacaaggcacagaaggccgttgtgggccctggactcctgtcaatgagatcactcagctctccctaccagccagaattctgcccactcgagttaacccaagaagctcaactccagatacctgaaaccctttagaacatcatatgataagatgtaaacagtgtaccctctcatttctgatggcttaaactaactatgcattcattaggtataactataaattcattagctttttccacttaaacctggccaggccacatggaatctttgatcttgagccatacttttctccagacagagactgataaatgactttttctggtagttagaactgaatctttattcattgtttcagtatcttcactcttttatgctcctttataaaatactataagaaaaatagacatcttcattaaatagaattctttaaaaattgcctttcatggtatttgctaaattttatttgcttataatagatgatgctcaacacaaggccagctgttgatggtgtgttattacgtaaaacttgtaaacaaggaagcaaggaagtaaactgtttggtccataggcatgggtccacagaatatctaccccagaatcaacacaagtgggttctcaacatgctgattcctaaggctgccctggacctattaatcctgaggacctgggacgtggccaagcaatctgaaagttaatggtctctgaaccactgggttggatcttcatagacagcaaacctggcccaaagaattactcagagtacaaagagaacacaaaaggatgaagaaaaagtagttggaattttgcaatttaggggctgtaaggggccttaaaagatcatctagctcaaccctatgtctttatagtagagaaaaatatgttatttaacccagatcaccaagttgaatcagttgacattctttcccatctaaaatgtcgttagtctagaaattgaagaaatgaagaaaatctgaaagaatggaaaaggaaagaaacatatatctggaagaagtcaactaaccagtttcagagaaatgttctaattgttcaagatgtactcaacttgaatctgtgatcttttctaaagacatttttttaaccttaagatttgcttttcagtattagtattgcttgagacaatagaagctaaatatttgtggaaatctacatcatgaacaggtactcgcttgggcagcaaattacagagtaagtaatcattttctaatttcaaggttcctattcttttagtcatttaaaattcagacttcaagccaatctatgaatgccaggtttctgttaattacaaacaattcatcttaattagcctgaaagatggttctaacaagaaataaattattgagcacaaaaagcaagttttatgacatgtttaatgttcatttcaaatccctttcaaaacaaatagcagtggagaacgtggagggttagaaagataacttttgttgctggattgatttcaaatcttccctggctgcttgcaggtgtagcactgttcacttgaaaatttattgtaacagatcacaatcattacaatcatgatggtaatcaatgttcattaaagatacaatgaaaattccatgattaaaggccatttgtttcatcacaataagatcatttatttattattgggtaaattgttacaaattgcatatgtttggggcagttgaaacagggaacatgaatttggggattgaggccgtgagtgccttttacttggtgaaattctgacaattcaaagagaagactgcatgtggcccgtgaaagaaagacaggctgtgcttttactcaccacaattctacactgtgatctgatggtcattattcctcccaactcggctcttcatttttctaaattagacaatgctgaacatatcctggtgcctttgcgctgtgttataaatggttttaagcagcatggaagttgcactgttctttatttaattccatcagcactcttagctagtctactatgtaaaaagagagttgaagacattatatgggcttcttctctttatttttgttttcgttttaaaaccaaagcaaacatctcagatcaattcaaaaggaatgagcaggaaaccctcaccaagatggaaagtgctaacatttcacatgaaaagaagttttttccctgaattatgctccctgtttaaccatctaactcagattaacactatcttacttgacagccaccagcaagattcacctacccctgccattcaaattccaaacagtcagtacaaacaaattttttttaaagacgaattcaactgttctagtgtaaagctgttttgggctcatctgcaggccaaacacattggctcagagaaacctgtttgctgtcagacaaaggctgttgctgtcattaagagttgttcttagagggtggccaatcagacacggtgagtcaggtggtcccaaggaaagagaaagaaaatgccacccacccactctgcgaaggctccactggaaaggttccatatgatctggctgtcattgcccttgaattagggctacgggaacaatttgccttacgattcactgagcaggaaagggtcctcgtgttcccttgtgtacagagggtgcacatttccctaaactctcctacttggaagatggacaattgccgaggaatactaaatatggccagcaaattttgtccccaagaaatctgagtgatctctgaggtcaggcaagaatgtgatagcaatttagaattgggcggggtagacaattaaaattagtcatgaggaaacatgcaaaaaacttttgccttctctgacttccgatcccacgaagctgacttcatgttgctaaatattccgattacaagtgaaaaactcagacatatgaaaattctgtttatgagaaccaaaatctacaaagaacacatttttccccaagacactaaatttatgaggtctcaagtttattagtcagtccttagttcctatttgaggttcctattttgagccctcaacaagagctaagaggttatgccttgattaagaatcaatcagaactggagttttactcaatgatatacttaactccttacttaacctgacttagcacaattaattatataagccacaatttcctactccttaaaatgaaagaaatagtaatatctgtgccatggaaatagtaatagaattaaatgatacgatgtatggacacatcctatatggcacatgcttaacaatcaatgaaagctacttacaacaacaacaaacaaacaaacaaacaaacaaaaaacctagggccaggcacagtgactcacacctgtaattcaagcactttggaaggccaagatagaaggattgctggaggccagggtttccgtgagctacgatcgcactgctacactccaaagatctctttttagcctaggagttaataattaatttcatcattatttattgttctatttgatgtaaccacatacagaaactggaaaacagaaaaaagaagattttcttagacacacagaccgatggaacagaaaagagaactcagaaataagactgcacacctacaaccatctgatcttcgacaaacctgacaaaaaaaaaaagcaatgggaaaagggctccctatataataaatggtgctgggagagctggctagccatatgcagaaaattgaaactggaacccttccttacgacatacacaaaaattaactcaagatgaattaaagacttaaatgtaaaacccaaaacaataaaaaccctagaataaaatctaggcaataccattcaggacatagaggtatggggaaagatttcatgaagaaaataccaaaagcaattgcaacaaaagcaaaaattgacaaatgggatctaattaaactaaaaagcttctgcacagcaaaagaaactgtcatcagagtgaagagacaacctacagaatgggagaaaattttttgcaatctatccatctgacaaaggtctaatatcaagagtctacaaggaacttaacaaatttacaagaaaaaaataaatatccccattaaaaagtgggcaaaggacatgaacagtcacttctcaatagaagacatacatgtggccaacaaacatgaaaaaaagctcaacatcactgatcatcaaggaaaaaccacgatgagataacatctcacgcccgtcagaatgagtggcattattattaaaaagtcaaaaaacaacagattctggcaaggttgtggagaaaaagggatgcttttacactgtaaatgggagtgcaaatatttcaaccattgtggaagacagtgtggcaattcctcaaagacctggaggtggaaataccatttgactcagcaatcctactactggatatatactcaaagggatataaatcattctattataaagatacatgcacatgtatgttcactgcagcactattcacaatagcaaagacgtggaatcaacctaaatgtccatcagtgatagacaagataaagaaaatatggcacacatacaccatggaatactatgcagccatacaaaggaatgagattatgtcctttgcagggacatggatggagttggaagcagtatcctcagcaaactaatgcaggaacagaaaaccaaacaccacatgcaatcattcataagtgggaggtgaatgatgagaacacatggacacatgggggaaggacacacactggggcctgtggaggggtgcagggagagggagagcatcaggaagaatagatagtggatgctgggcttaatatctaggagatgggatgatctgggcagcaaaccaccatgacacatgtttacccatgtaacaaacctgcacatcctacacatgtacccctgaacttaaaataaaagttgaagaaaaaaaaaagagatgctcccaattgcaagatcctaacaacttctgttagcattttggtataattttcccagcattttttcctggctgcatttttttacattctctctctcgcatatgtgtgtgtgtgtgtgtatatatatatatatatatatatgtatatatatatgtgtgtgtatatatatatgtatatatatataaaacctatatatagtccatatatagagatatatatgagctgtctttccaacatttcttatagctttaatcatgaagtaaatcaatgtcataataaattttggccctaattatctgccattgtttatttgccttttttcaaagtcaattagaaaaagagagaacattattaagtatttattaagttaaagctccttaatattaaaaagattaatataggagaagatatgaggatctaagcctaaaccttaactggcatgaaaaaaaaatgactttatccgatgctactttgtttcatttaacacagtacactcatgtaggatgttctcttctttccctctcaacagaggcatgtggcactctaagctccacattgctgagttatctttaacttaggtttttctacgagaagaaatatgtgactgcatgcaatacaagtacctgcagagatttagtttagccttgggacaaaaattcataatggctaatttaaagcacaaaggtgacgccaccttgctggaatgaatttagagttgtaacagttgtaaagcatcagtcctgtagtctggatactcggggttgttgctactttctgtttgatttggactcaccatgatgtaactctggcaccactgagaccacgcctggaaaatgcatattcatttgatgccatatataatcaaccaaatatacattgtgtccttattttgatctagtcaccagtgatacaacaataaacaggaccagtctctgacctcaaagaattcatctagtcattctactgagctgatgtgtgccaagattgagttacaatcagcctagaacagtagcaaccatagacacttccagggtgtcaggctgattccccatcttctaaaatgcagtacatttcttgaataaattggccacccaaggcagacatgtgcctcttcactcatctaattcagttcatccatccatgactttagaattgttcaaaaattgcccagcttcctaataccaacaaatattgatacttccctgttttattttagatcacatggtatcttttccctaaatgtattaggtatatttgttaaatagcagactaccaatctggggagcaactgaaatcagaaacatagtgaaagtacccaagatgtatatatgggaataataatattggtgattactacaaggaattcttgtgagaattgaatggaaaattatatacatatatatatttatatatgtaatttttaacttaatcttggcccacatcacatagaaatagtagtagcagatattgtcttcatcatcatcaagataataaaaccatttcagcccctttggaaaataatttggcatttccgcaaaatgttgtgcataaacctaccatatcaccaagcaattccactcctaagtatctgtccaagagaaaagaaacatctatctacataaagacttgcacatcattgtttataacagcattattcataaaagccaggacctgaaaacaacttgaccacccctcagttggcgaatggataaaaatatggtctattcatatgatgaaatagcattggataataaaaaggaatgaactgctggcacatgctacatcatggatgaacctcaaaaacattgccctaagtgaaagaagccagtcacaaaagaccacagactgtggattccatttttaatgatcaatactagattagtagttgcctggggattaaagtgtgaaaaagaattaactgtaaataggcagtagggattttagatggggcatgaaaaaatgctccgagatcgatttatggtgatattcctatcatgccacagagttacaaaacagtcattgaattgtatacctgcaatggctgaactcttatgatatgcaaaacagacctcaataaagttcttacaaggaagataacagaaccaagttctaagtacaccaattatccagttgcctcctttgtatctttcatatatttagagaatctatgtccactaaaatcgcatttatccagttaaagatgagattaagaaattgtgttttcctgttgatagcctgaaccttaacagtataggtaatataggacttaacgtgatttttagattcggaatgatatattcatttgtgaaccgttttctggatcacataaaactttattccaaacataaactgtagcacaaatgacacagtccttcttcacacagatacacacacacacacacacacacacacagccatcagtacgagcagaatggggcataacctttcattcctcacataacatctccacatgatcctcctgccccattaagaagacggcccaaaccaagtacctcaaatccagtgtcccaagaactgtttttagtgtttgaggttgtgtacctgtctttacttgttcccaaattattctaattctaatcctttcaggtctcattttgatcttcccagctctgatctcccaactctgtgaccccaagcttgatcactaactatagatttatggctttgaattgatctctctctctctctctctgcacagtttgtctcctgtgtgtctgtctctgggagaaaccctctgctctagccatgtgaaaacaaattctgaaccaggccttctgactctgtcctcatccctccctcaccatctcctaaacccttcgaagaggaagccatctttttcttttccacatacagagccttttatctgtacatctattatgaaatttaatactttctactatatattaaatatagttatttatgtagttgttgtaacctcaattgtttcatctttacttaatatctttcaaagcatggaatacagagctttgctctcaagaaagtatattttccgaagtgtcccgatagattgaaatatctgttaagtttaagtgaaagggttggttctgctacagtttatttcagttatcagtatagcacgcactgatgcctgagttactgctggaaaatactaccttcctgtcttcttaaggcattgcaaaaggtatggggaaagatcctgaatttgccccaatttttaaacaaaccagagaaacagtaaagcatttaaatgacttattaatgttaacctatttatatctacatatttgttagcctgtgagtaaatggaacttcggatctttgcaaaagaactgccgggttgtaaaaaggattggaaagtcaggctcacttagtagtgtgcagagaaacagactctatgcctggagcaaaaaatcccagcatcccctccacctctacggtgtgatttcttaatgctgtacttggctcgacaaaggaagtctgatatttcagaggtgagttgcaaagtggccaaaccactctttaatgcactatagcttgacataatatttgctgccagcttctcgtttaaaaatgccatcagtttaacattaactgaaaaagtaattattctccagtttcacggagctattaagaaaaaaaaagttcattgaaactccaggaaatgaaatactgtgctttcaggacctattggaagcctttcaacattcagagcagaaaaacataaatttattttttaagaagcagatttaggaactttagtgaatgggaacagaaagcattaacttaagcctcaggggagataacgattcaacaaaattctgaaaaccctccttagatcaaactctcacatattctgaaaactcagtaccatttattgttacaagatccttgatgatttagaaacatgtacccacacatgttaagtcctctgtactaaatcaaagaaacttcaaattagcttgaactttgaaatgctgtaagttacatgaatgatgattcatttctttatattcagtcaccaaatgttattgagccgatgataagcttgaagacgttaaaggctttggggtacagaagagagatactaaagtaacagcctgcacatgagatcttgacctgtaatgaagtgccaatttagttgtaaagacagaacatgtcatctataacatctgaggaaaatcttgctgtgtatgcggcataacctcagtttataaaaatttgagaggaaatcacaagaatggagaggttttgcaaggttatggagtttgtacaccatttttttagaacatgaggtctaaaatcagatgcaaatgtgggctccacatcctattttttaggtaactttgaacaagtcacctctttgaacctcagtgaaatgcagctgaaagttctttgaaaactgtaaagattatttattattcagagatgatttctgtgggtataagcagaaaacactactttttgaatgaattacaaacataaaaccatgactttaatgctaacattttttgaaatttttataaaactttctaattcacgttcccctactgttccaaagtcagtaattttaagatacatgatttaaaaaggaaaaaaaaaaacctaactgtcaagaaatatcgctaactagattgatcatgttatttccttatttttataattgaaaaaacccaaaactttaatactaatttctggttgcttaaaaacaaattaaatataaaactgtgtggctgtcatagatgatgatattttaatctattgaaaattattacagtagaaaatttttaaagtctaggaagcaataatcagcaccaaaatattgtttttgctgttgtatgcacagctttagtttccattttatgaataaatacataaaaatatagggtaaaaatatatgtatttaataggattcttacaactttctattagcacaatgagtgcagagcatttgtgaataacatagaactagggtctcccctacagcttttgagttaagtctttttctaacaactgctatttattcagagaggatgcgaagtaacaggtctaaacattacattggcaaaggagtacctttaaattgtatgtggcacaagctaaatctgggaaaggaaatgaaacacaaatgaaagggcaacttcttctggaaacctcccttcctttgtggtatttttgtccttcctccattccatgaatcctattaagaaaaaaatttctcttttgctttctaattcccaaatctttactgcttttctttaacaaggcttccaagaagaatcggaaggtgaaggaagggatggccataaagaagactgttctttagatgagatttttgtcatattgttactgaaacaccaggggtttggtctaggtccccgctgctcccaacacataaggccaacgactagggtgatgagtatcgccaaggaagaagctctaatcaggtgctgcaggccaagagatggcagctcagtctcaaatctatctctgggacctactcaaactaggagtttatatagcaggaaaggattgtaacaacgtgtaagaaaacaggaactagggaggggaaaggaagcaatcatgatgaatgagggatctggcatctcattgtctggatgtgatgatctagtgagtttcagttctttgatactttttttgagaggtctgaagggtcatttcccaaggaaggaactcagataaaacaaatgtaagtttcaagctttaagaccagaaggattggctggtcacagtggcccacggctgggcgtggtggctcatgcctgtaatcccagcactttgggggtccgaggcaggtggatcagaaggtaggagttcaagaccagcctggccaacatagtgaaaccccgtctctactaaaaatacaaaaagtagccaggcgtgatggtgcacaccggtactcaggaggctgatgcaggagaatcgcttaaacccgggaggcggaggtcgtagtgagctgagattgtgccattgcactccagcctgggcaatagagtgagactccatcaaataaaaaaaaaaaccggaacgatcaatttctatatttatccaaacatgattgtctatgggactcctggatcagtttcaggcctccctttctatttatcaattcctcaatcatggggaacctggttgttgatcttcctggctgcttcctgctgaggaggggtgtcatgggcagctccataccatgggtgaccacatggccactcaggaatcaaaggttaatctcatattagagttttgttctgaaacacagtatttctctctccagcccccccacatccaccagagacaaattgttactgaaacaccagtgatttggtctgggtcctgctgctccccagacagaaagccaatcgctgagacaacagtgttgccaaggaagaaggctttaatttggtgatgcagcaggggtttatatagcaggaaagaatgtaacaatgtgtaagaaaacaggaactcgggaggggcaaggaagtgatcctggtgaatgaggggtatggcatctggtgtggtgatctgggttctttgatgctttttgtaagaggcctgaaggtcatttcttgaggaaggaattcagataaaaccaatgtaaggttcaagccttaacagcagaagggcccatttctatgtttatccagaagcaactgtctatgggactcttggggatggtttcaaaatcacagcaggaccaatctacctgcaaaataagcttcagtcccatatactagcctgattactcacacagaatgcaacaagatcattgtctacataggcattcctagacttgctttgctggagcctctgacaaggtcatttcagtcaaagccctgggaaataaccagttcctccaaccgggcggggtcggggggtccattataaaagcaaacatgttgttattatgcaaacaaacacattgccatgagttaagaatattcacaaatagtttacaaattatgaagaaattgagcagagagagaaataggcctcaatttctgtttataaaagtatactctattcggtacacttaaagcatacttaaagcctgtaaatatctcaaaaggaaaaaattattcagactctgaaaaacaaaacaaaaacaaacagcaatatttcaaacataaaaatcataaaagattatctcagtccttattagttcagtctatgcaatcagctcctgttctgcttcatattggattagtggcaatctttatacaacagcctttcaattaggggcctagaagttttctctctaatccaatggcacaatctccaaagttaccagaaacttccattcaagagtcctttttatgaactcttccaaagaagcaatgtttggactgtggctgattgtaagtcactttttgagaaggatcaaagcaaaacaacaattgtggataacaaaaagtcttgagacagccatagttagagacacagttgacaagaaaatttggttatttctgtggcatacaacaacttaataattataattattactgacaacatatatttaaaaataccagaattttaagaatctcatacaatcctggaacacatattatcaccacatttatataaatataacccaaaggaagataaacaccacctcagatttgacaatgcttcctgcataattctaacacaatgaataagcctattatgtctgtcttgcatgtcagggaacctaatatctagaaaagttagtttgaggacaaaaagactgaattcagaacttgaaattttactcctagaaagtttaccaaatatcaaagttttaagacacttaatatcacaaaataggatcacaagtcactataaaatagtccttcatttagccaaagtgataaatcaaaaacatttacgttttgatagagactctgtttcccaaacaaagacctaataaagacagcatgaggccaactgaatctgtctctccccactcccttttctctctgcaatttactcaaaaagtaaacaaaatcttttatctctcaatattacatattttgtttaaaaaaaccaaaattttcctttgaatggtatggtattaatgttaaagctaattttaataaaatattataaacaaatctatctaatttaaccactttgactataaggtacagatttctgtaaactttttttttttttttttgagacagagtctcactctgtcacccaggctggagtgcaatggcaccatctcagctcactgcaacctccaccgcccgggatcaagcaattctctgcctcagcctcccgagtacctgggactacaagcacccgccaccatgcccggctaatttttatatttttggtagagacggggtttcaccatcttggccaggctggtcttgaactcctaacctcgtgatccaccagcctcggcctcccaaagtggtgggactacaggcatgagccactgtgcctggccaatttctataaactttttgtaacctttttccaattttctattaaacagcagatcaatgcttcaagaaaactgttattccaagacatgggtccagacactattcttgtatcaatgagcttttgatattaatgttgtttaatgtatagaaaaactctgaactaatcctatgcctcaaaaatcagccctgacaatctcacatgactacctcttccacaataatccctgggcctagagggattaagtagttttaatttctggcctgtgtctcacgaaacagttccttgtgatcgtcaccttctccagagtctgaagagaaacctttgactgctgtcaatgctcaaaatttagcaggaattggtgccttcttcaacccaagagtcaaagccctgttacttaacagcacaagcgttagttaataggatgtttatactacagaaagtcctatcattccctctaacatgttacaaactaaaacactgtgatttggcatttgcgggttactgcctgcagcgcttcaaaccactgtgttaaagtagttaggttactcattgcataattgctaggattctagtgacagaactgtgaccaaaagcatcaaaacgtgacaggttctatgccaaacttttcaaagtaagacaactaatgtttcttgttgtcattttaaaaaaaatggtaaatgcaaatatcagttttggaaaaaatgtcatttaaaaaatggtaaatgcaaatatcagttttggaaattcagtataagaattaatcatctcctttcacttaaatactatacaacaaaacagggataaagtaaggaaaagcacacagcaatttattttcagctattttaaaagagcatcatcacacttttccaagattggtttctcgatgcagtgccgaccaccaacattttcaaagcagggcaacactggtgcatatcttgtttccaggtacacacatgaaggcccaccagtgataaacagcttaggatcagaaatcactacaaagtctcacatgttttaaatactattattgcttcatccaaatgaatgtcacttaatggtaataatgataaacacaactacaatagtttgaggaaaatcccaatcactataatttccttaaggaaaaggccaatatttcctgaacattaaatttgcatgtgtaacaggttttcctcattaaaagaaaagatctgaaaccaactcaaattattgactgtattgaattaccttggaaataaataccattgaaacatttttactctcacctactttttcaaataataaataatgtactatttctgttcagaagttataaaaaatcttttatgcagtttttttgccaggaaccttaaagctctcatagctctctagatcatcagaggtaaggaaaaccaacaaaattttaaatggctgatgtcctctatcaatttttggaggcttcacaaaggtatattaggaactttagatcaatagaacaaacaatgaattgttggaaatgtatagaaaacaaatgactacttatagaaccagatagtttcaagctttaagaccagaatggtcgatttctacgtttatccaaaaacaactgtctacgggactgttaggtctgttttttggggttttgttgttgttgctgtggttttgtttgtttgtttgttgacggagtctcgctctgttgcccagactagagtgcaatggcgtaatctcggctcactgcaacctccgcctcccgggttcaaacgattctccagcctcagtctcccaagtagctgggactacaggcgtcctccaccacgcctggctaattattgtgtttttagtagagacggggtttcaccatgttggccagactggtctcgaacacctgacatcaggtgatccatgcacctcagcctcccaaagtgcggggattacagacgtgagccaccacgcccagccgggtctgtttcaatcttcctatttgcagcagaattggtaaagtgagttaacagagtagcatcaaaatgatggtagtattgtgactgggacataagatgcatagattcatgatacagtgacaaaatgcagcgttcaaataggatcccccataactctatgctgtaggcatatacaatattgtgactagtccacttataggacatttctgtttccaaagttggcacgaaaaaaaagagacaaaaaacaaagacatgcccagcgaaggtcttgagtgctgggatctagttacaaaggtttgggaagtagattttttaatcttagaggactattcatggctgatactttctcaaatgtgccttagagatgcttccatttgcagcacacattccatagaccgcatcaatcactccattcagtcatccttgtctgtgtccttgtcttgccacgtgtgtctgctattctttccacaataggtgactctgggtccaggattcagacttgctttagccaataggatgaggtgagatgacagtatgggcttcacaaggttcacagtacctctgcttgcccttctgtgtctcggcctcagccatttttgggggtctcaggaggaagataaaagacaagtgggacagagccacacccaaggaccccaacccaacccagacggcttacactcggctggtgacatgcgtgagttggtgcaattaagactgcaacttctgatcctgtcctgcctggatccatccaccctgggaacttgtaagaaatagtgagtgattatagtttgaagtcattgagtttggtgtgcatgtgcctgtgcatttggggtggggggaggcaacaggtaataataaaggtaactaatctcaaaattgtggccttttctatttccaggacctctgtagaaatcatgtttttagtatgtacagactgaatgctaaacttttgtctccaaagagtaaatactgtccacaggggaggtctacagaaaagaagtaaatatatgagtcataatcagtctcaagatatagtacacatgtcactgaataaactgatgaaccaaatggctgaagaggaaaatttttaatgctctgcttcacactaataaaaacacagtaggctcaatttccatattctctgaaataatataaatgattttgcaatgatatatttacttacatttattctgctcattgaaatatttcctttaaggaaaaatacttggaatccaacaaatttcttcactcagtatcttcagcacatattcatacaggtaaataagcaaacaatttttatttaatatttaaagtatcaactaaaactatctgaaaattatcaagaatgtaaatgactatagagcagttaatttttttttaagaaaacttactgtcaacttgtctttcctttgatgggtgggataaaaggagtaagttacaatttcttccttcatctctgcctctttcaatgtcccttcctttatgctcatgtcagtctctctttaaccaaacttgtaagctaagtctggcaagacacatagcatttttcaagaagtcaataaacatttagccctctgaggagacatcaaagaagcaaattaaatttgttacaacgacttgatccgtgttcttttggtctaatgatttaagccccaaatccaaaagttaaaagaaagcagaattagttttaaatcactttgcacttaatctctctttgcctcttctctccccacagtactcattttttttacctagaatattctttcttaaatatactaggatacaaactctaatatacacagggaaatttgagcctttagtgcccaacagtgctcctcacagcacttagcatggggatttgtgacaggtgctcactctgctataaaccaatgttgtctgatacaccaattgacctagcatgaccattcatattgaaaatctttgtgttatcaaggttaatcttttcctattcacaaattccttgaaaacatgatacatagtgtcaaatattgccaaaattgtgaggtgttgtatctaaaactgcagcctttattttttaaggtgttataatagtaaaattccaggaagaaatatgccaagattgatggaaatactattgtgtttcacaaacaaatctcaatgtatttatatgtacgagtagtcttcaactttacaacaacagaaaaattaaataagaactctaacaaaaatttgtttttctttttgaatgttgaccaatttgtgattttaaaatttttacttgtgtctctgttaagtctttgagactatccattttgcttttctgatcttaagttctttccaaaaacacagaaactctccaagctgtcagtgtcccagatggaaccaaagttgtagtttgcactggacattaaatgccgaacttgaaattaatcagatctctacttgagtaaaatgaaagctatccaacgaaaaagcaccaaaatattgtacctacacagccaggaaaacatcaaaggccttcaaaaagctaatatatctagtgttgacaacctagtaccacacaagaactatgggaatgccaaggttacaatgtactaaaagcgcctccatgaagagatgaaatggtcaaatgtccaggactctttgagaaaataggggtaaatagctaaagaatattgaagttgctccaataatcaccaatatgtttcttctggtttttcttccccaactagaattaaaaattgtgtatgctccaattttatgcttgaaatataaaagaatcaaaattttgaataacacacaagtagatgtttttatttactttttaattttatggatacatagtaggtataaatatttatggggtacatgagatattttgacataggcatgcaatgcataataatgacataagagtaaatggtttcaatttagaaagatatttttgctggatacagaattctaggttgggagggacttttgctcttgttgctttttggcacagtcttgctttcattatttgtgataaaaagttagcaggatttctcatttttgtttctctttatctctgactgcatttaagagtttctcttaatgtattttcaacaatcttattataatgtgccttgatatgtttttcttagtgtttctcatgcttagggtttgtcaagatttttgatctacaggtatatttttattagaaaggggatcatgagttaaccagacatgagccatgcttgggaagctgttactgctcctgcggctacagacacaatggaaagaggtaaggtttccacatggacaatcacggcgggtttcctgacagaagcagggttcactgaaggtgggtgactgggagaaatactttggtttttccatacctgttcttccctaatcttctgtcagtacctcctatagtcagaatttaccctgtgatgaatagcagagcatgtgaaggctggaaacggagctcagagaaaatcagcagctgcccctcacaaaagcaacgtattctgatttcttcactgttggattcatgccatctggaagaacaactgggcatatatttgttgaatgaatgaatgaaatataactaaactcatgttttattattgagaaaattgaagctcctgcgggcttcacaatttactcaggtggttaagaactaggacttaaatttaggctatttcatattttaacatagcaatcacctctgacttctgtaaattgaatcatattttaaatccatatgagaactttctttccaaagacactctgtattgcgttttttgcaaaactgaaaatcctttatcacctttttaggtagatttttcaaatttcagtttctcttcaagctttctggactatttctttcgctgggaggttttacataacaactctattttaaaagaacagagcatttcaaaagggttatcattttggtaaaagagtcagcataatgtgaaagaaagagcatggtttttgataccagatagtactacattctgatctaggatttgcaagtaatagcaattagacattagagaaaacacttaactttcctggtccttgattccttattctgtgaactggggataataataccttctctaatcatgtcacagaactgtaagaatgaaattagatgatgcgtatgttatgcaaatacatttcttactattgcttagctgtgagtcaccttctctccagattagcttttattactgatactcattgtggacatagagtccagctgatagctggatgggtgggtatggctgaagcagaagcatagaatgtaagagacctgcaatagagacttcattgtctgatgagatctagtgagaacagcaacactcatagcaggtaaaagtgctgcaaaaagttggtaggaggcagtaagaaagtaactgagatgaatctacttattttgcatttcctatgctaatggtcatcttcattaataaagacaatccagtcactttaaaccagaggctggcatcacagtaaaaagggaccatttccattcttccagtatctatccttggcacttaaatccacgtgattttttaacagctttattgagatgtaattcacagaacacacaattcacccatttaagaacacagttcaatggcttttactgtatacacagagttatgcatctattgccatgatcaattttagaatcttttcactacccccaaaaggacctctcttgggtcccttagccattaccccttgagaaattcccccagccctggggagcccctcatttactttctgtctctatagacttgcttgttctggacgtattcacatgaatggaattatacaatatgtagtgttttgtagctggcctatttcgcttaacataatgtatttgaggttcaccatgttgtaacatgtatcagtactttatttctttttatagctacataatatttgctatatattttttcaagcattccacttcactgttatttgtttttccacttaatttacctgttctgatcatatgtaagatcaaaggagtccttgggtgttatgaattcaaccactgtttaatcttgaagagagaaagtctaaattgtcagagggtcctgagtcaaacactttcctgtgtgcaggaggacacggggccaggccctgccctctgactgtgcaccactggcttcctctaacaccgactccaaaatggtagaaattctcctccagataacatttaatcattataaaatgcttccttatcaaggaactcataatctgatcccaaatttgtattggtaaataggtaaaagagaactatatatttgaagcataaaatataattactggccaaaattctccagataattttaaaatagacatatcttacaatgagccccccagattgccttttaaaatgataatgtaaaatgtttgcctggtctcactgattacttggtaaattctgaatatgatgactttctgttcttacaatccataaacgcaacagctataaaagccacaagagtcttgatgacaatgaagaagcatttctgtgctgacaaagtcattctgctttagaactgtggatactataagccaacataagtcttctcttttcctccccatagcatgtcataaactttctgagaccatttgtaccaacgagacccagagcatgcatttatatgcaattgctgacgtttaaaatgcgataatttaataccagtactaacagaagctgcagaatcaagtgctattggtcctgctatttacactaaaatgggtaaccccagtgtgagtgacggcgaagtcctttcaaacccagaggttaaaatcttacttcctttcttacactccttttcatctttgcttcggtgtaaaatctgcatgacttattatgccattgttgaactgctctctgacctcattaacattcttatctcccagaaaaaaaaaaaatgttacaagagacctgtctggttattatctctgccacctaagacttaaagcttcactataatttccaaatacatctaccttgaaatatctaagcttacgtgtctcagctacttccccaagtatgctgaattctaacggtagagattcactaaacctattttctttttcacacttcataatccctggtacaggaaatggctcaaagcactaaatttgatttgtttttcaaaaaacaacaaagccataaaattctagaacagtaacactcaatcttaggatatacaacaggatacagctacagataagagctcttggtttattccggtgtttcaataggtatgaaattgatttttgcaaatagaaaattggcagattataattttacttgtggaacatttagcatattaattatgagtttgaaaattgcattttcgaatgatagtgagggcagcataagaactgtgaaaggataaaaggcatatctcgaaaaaattttaagacatataagtaagtatatcttcaataataatttaatgattgaaataatattacttattactgttttaggagcacttgatgtttctagtaacaccctggcagttctgtgctccttcccagatctttccatttctaccccaacttaaagaaaataacattacagctgaaatcaaagagaatttaagcatcatttggtttgagaattatctttctcactgggtggttgtcagacaacctaaacgcttggcttctttttttttttttctttgagacggagtctcgctctgtcgcccaggctggagtgcaggggtgcgatctcggctcactgcaaactccacctcccgggttcccgccattctcctgcctcagcctcccgaatagctgggaccacaggcgccccccaccacgcccggctaatttttttgtatttttagtagagacggggtttcaccctgttagccaggatggtctcgatctcctgacctcgtgatccgcccgcctcggcctcccaaagtgctgggattacaggtgtgagccaccgtgcccagccaacgcttggcttcttttatagcttcctccaaaagtgtgattcaagtcggtatgagggtagggtgtagggctgtttgctgagacagtgttgtccccaaactcacacacacaaacacacacatatacacctgtgtttacctatatatgcctgtgtatatgtgtaaacgtgtggatctctatctatagattcatctactgttggccaataggacataaaaaaacatccaagttttttttcattcttctgctctgctgggcggctgggggtcaggggaattgccgtttcttctcacaacagagacttattttcggtatctgtcctctacttcttcctcattaataaaaccctgcatttcagatggactcaaataaagatcacatccatttctccccttgaagtcagcgacagtaatgcatacaacttactatacctgttctttaaaaagggagcctagtcttctcttgctgtttcctgctggtaggaacacagacacacgtgtgcgtaaacacacacacacactgtgggagagatggagcagttcttgccccctcggactacagagtggaagctgcatgctcccagcctgcacatggcaagcatggaggttcctgaggcttgtggagctcctacagcctcactgggctcacttcacatgtaagtgttcaccaaacgtaggtaggcttctcatcaatattcactgggtcaatctccactttattctttgtgtctaagttcaaatcctcttaagctcttacctagggtttggtaatgatctcaaaattgttctttctctctccagatctctccctcccttattgtcttctgcctgctgttgccaaaatacaatttgtaatgtacaagtctgctcatagaaaataagtaacagaatcagaattctaacttatgtctatcttgatacagagctagaaatattagagacattgtggatagctaggaaaaaaaggagaaatttgacctaaaaagagggcacgtgttaaactcaaatgacagatgaaaggtatgcaagggctgagcatgccggagaagacgtgacggctatgttccctgtgttaggtcatgggtgagttattgcttgccattatttcatttgtacctttatatttagcatcatatctgaagcagcttttacacaacctggaattgctgtgaatgagcagccactaagaacgagtgcaggagatgagaagtgagtgacatttcccagcagttaaaaacccttcctgcacaaagccatgcctgactcacattcacccgtgaacatcattctctccctgtaaattctgcatgagaataatcctagggtttctcagttattaccatgaattgttcattagattgcgcacatggtgattttatctattgaacagttgaacctacttgaacaattctatacttctccataacaacccacggtgtaatatcacatttttaaaaaacactaaatgaatgagcttaattgagttgggtattttgtaattgaggaagaggcaaaatacattttttgaagagtaactccttgatgagagatgttaaatgattcatgaatccacatcagtgatggggctagataatgcagggttttcattcttagatcagaatccttagtctatcattagacccaccagatccaaaagataactttataaagtcaaagaaatgattttgtctacttgacttatagcctggatcatacaggaatattttgttttcatacatgaaaaatgatcatatttcctcactgatgttttacaatccaaactaaagcaaatccaaactaaagcaaaatcagatggttttacaatccaaactaaagcaaaacggtactttgagaataaagagttaaagacactgcctttatacaaataaaacaccatgtgtattaaaatatatgatccctaatgagatggtatttgaatgagaaaagctgggcatatcataattcttagcctagatatcgtaactgtgctttagaattggaccaagacactttcttactaagaactatctttagaagccattgtgtgcaaataacttctttctttaactagttggtggccttttattctgtgaggtatttaacatttaagtctgagtcacttgcttttaatgtgccacaatgatgtgatcccttaatatcgctgaactatgacagtgacatcctctttgaaaagaccaagctaccattagaaatgggtcatgaagcaaaagtcattaactcatttaaaaaaggccagagcccagcaccgcattactgacaaacctccttccctgtgtccatttgtctttatcaaatatcactttaatatccatctcccaagcatgagatagggttgtgaagcagctccctttgaaaaattaaaacccttagcaattaaatttgctttcaagtttcactttagatgagcaacttaattcttgtatgcaatattataaagtaagtattaataactcccagtaatacaaataatgattccagagttgctagtctgaaaacatttgaggactctttttttttgagacggagtcttgctctgtcacccaggctggagtgcagtggcttaatctcggctcactgccagctccgcctccggggttcatgccattctcctccctcagcctcccgagtagctgggactacaggcgcccaccaccacgcccagctaatttttttgtatttttagtagagatggggtttcaccgtgttagccaggatggtctcgatctcctgaccttgtgatctgcctgcctcggcctcccaaagtgctgggattacaggcgtgagccaccgcgcccagccttgaggactcttaaaagaggaaaattcaattaatagagtcaatgatgaaaaagtcaagacagagtttctaatattttccttgatgttagttttgcagaaagacaacatgagatagaggtcgtatcttttccacataccaaatgagaggtttattttaaaataatgttaaagtagtaacacaaatgatagggaataatatatgtcaacgtgagtgggcttcttgtactaacattttaagttttatatcagaatgagcttccaccttcagcattcaaatggaaatttctcacaacaaggaaagataatctatgctctaggaatccccttctggtagacaacctttgtagaatcaatttttacgtctgttttcctctgttatatctctcagaaaacaaaaagtttcatgaattttttcttctctgggctctcagctacagatgctgttgcaaaatgaggcaagagtgagttctgccaagagcaatgtccatcatgcaaaatgcctactacctaggagctttcagaagaagtaagacaaaggctgaacatagtagaagtttgtgtttctttccttcaactgaccccatgacaggaagcaggtggtggcagctgtttatccaataaaagtatttttgtttgttttgttttcttttgctttgaatggagtcgcctatcatctcagatctcagatatacctataaataaaattttaaaatttaaatattcaaatattttggccaacgtgcaacacaatccggttgctctttaaaagcagagataaagctattttataggcaaagcaaagcgcacagtcacaacagaacagcactggatgtttgcgttttacttattttatttttattttttattgatttttatttttgtttttttttacaagacggtactttcattattgaactttaaacatgaaagattacatttctacaaatataatagaacaaaaatgaatgtggagaaaaaaggaattatggtaactgtacagggcatgaaatgggcactttccgatgattgagcaagaaattaagtacagattataatacattctttttaaattcatttgacacattttatctttatttataacctattcttgtcttcattttcctcctccctcctcccttcctcttccccctttcttcctttgtctaccactctgatcttcatttttcatttcacttttttcttttttattaagcatttgtcatgtattttataaatctatactcctctgttacaataggtattagttattctgcagcagatcacctcagagggccccacgcaccccacaataatccctccacaaaccccctccacatttgtttctcagagctgaatctttaaggccacctgctgctgggggcaggcgccctccaatccggcagcttggatggagctgaagctgtccacgcggaggctcctgggcccctgacctggcctcacggtgtctccttcggctgctgctacatccttcctcctacctctgctgctgctgctgttctattatacgtccgaccttgacccagctctgttgcggtgttgacacctgtctgtcagcactcgttgaattttagaaaatgcttgacatattttctccatcctcttattttcagtctttctgagtattcctgttttcagtttctcttccagacaagatatttcttcatccaattcagggtgtcacgttcttttgtttaccttgggttttaatttgtgtaattagtattaaattagatcttatttttgacatctttattcacattttcaatttaggtgtaaattataattattattaaattaagggccaggtgtggtggctcacacctgtaatcccaaaactttggggggccgaggcaggggggatcacttgagatcaggagttcaagaccagcctggccaacatggtgaaaccccgtctgtactaaaaatacaaaaattaccaggcgtggtggtgcatgcctgtaatcccagctactcaggaagtgaggcgggagaattgcttgaacccgggaggtggaggttgcagtgagctgagattgcaccactgcactccagcctgggcaacagagcaagactccctctcaaaaataataataataataataataataataataataataataataattaattaaaacttatttctgccatctttttttttatttcttctctttcttcagacctttctaccccccttctttcctcctttcaataagataacttcacattttctctttctgatttaaaggtaacatctttctatttttataattatgattgtcatatttatgacccatactctttttattctgtccttattaatttcctaaatttatatatattcacatcttcctcctaacacaataaaaactagattgtttctaatatttattttgtcttgcctctagtgattatgttgttatttcctagggcttcagttttagattgctgtggatagacttttacttgttttcatccttctacttacctaacaaaaatgagttttactaagatatatatttatccttaatatctgttttttttttcttcaaaatgtgttttaaatgagggccattttatagttaaaagttctgaggccttttaaatgtatgaaaaaacatatgaaaatacttttataaagccttcatttttatgagtcagcttctctttagattcatagttctttttctttagtacattaaaaataaccctaaattttcctattatatttagtttgctactgagaagtcagctaatctgattgtttctttgcagatgatctttcttgctgacattctttaaattttcctgcctttgaattcttaattctcattataatatttaaatgcaaattgttccttatctttccatttttccttgataaactcttcaatttgaagtctttcaagtttctttaattctgaaaaatgtctattaattctccgcatttttccccttatcttttcacttttctctccttttgggactcatccaggtattgatatttattgtattctctatatctttcagtttttctattatgttttctctttctttattccctcaaggaattccttaatctgatctttaaactcacttatttactcttcagctgtaaacatcaaaatattccatctattatgttctttatatcagcaattatattttattatataatatttttcctatattctattttatgattatttcttattttatattgttaacatcttagattatcatcttaactatacttatcatccatttataaaattcttagtctacctgctctgacaattctcatttacaggatatatagtgactatttcatcttgtttctttatttcagctcataaaggtgtaagggccgtatttgtgccagtcttgggtaagtttgaggaaaaagctagggttaagataaaatgcagagagcccaggcattgtaggatccctctcatccaatgacattcctccaaacagtccttctgatcatggctgtacttcaaagtcttaagatgaagctctggccaggcgtgttggctcacacctgtaatcccagcactttgggaggccgaggcaggtggattgcctgagctcaggagttcgagaccagcctaggcaacatggtgaaaccccatctctactaaaatacaaaaaaaaaacaaaaaaataggcatggtggtgggcacctgtagtcccagctatttgggaggctgaggcaggagaattgcttgaacccaggaggcagaagttgcagtgagccaagattgagccactgcaccccagcctgggtgacagagccagactccatctccaaaaaaaaaaaaaagatgaagccccactcggaaagggcagcctctctaggatccggtccaccagccctgagtgctgtgagaggctagaggagtgaatgtctaagggcggctggtaggtccacatttttccaaagatttcccaaccttacaagacttttgatctgcttactataacttcagaacacatctgtaagaaactgggctattgttactttttgctattctggaggaattttttttaatgaattatgaaaacttttctacaatctattatgttgttctcttgccaaaactttcaaccatggttcaaaccaggaccatctacctagttttcccatccacatcaactcaagccagccttcagtctccctagggtggtttctctctcctctctccctccatctctcccttcctcattccctccctccatcccttctctctctctatgtctgtctgtctgtctctctctctcttcctggtatctttctccttgtatctacagtttgtcccacattgattttgggggactgcagcaatcagcagcctcagcttttcccagaggccttgctcatacctcccaggcctgaacacctaaagaacccatagctgctggacccaggagggatggttgaccagttgattggagttaggagggaagcacagttggaatgcgttctaactgccatatccctagaatcctttggtgtttaatatttagtgcaataattttcatgtagattgaatttaactaaagcaagtgtcatggctttgtcaggaatcttaatcatgaaactttccttggcttccagtatctatttgtggtaaatgttaacatgtacctgactaggtggctcctgttgaaagcaattgcaaaaataaaggcatagagaagtatgagtgaaggtctggattacactttctttcaaataagaattcagcatgcattcttttttccagagatcttaattcaagatccataatattgcatctttctcttttcttctaaaccacagggtaaatgagccctaaaataattgtgggttctgaatcttcactggattctacttatgtcacctgtctcttcaattctctaactacaccctccagacacaacctctgaataagtgtccccaagcacctgacactctcacttccacgcctttgcagattccttccggcatggaatactccgcacttctcatcttattctcttgttctgcctattctctgctcatgctgaagaggcttcttggcgccttttcactaagacgattggtgacgaggccttctcctggaagcatgacatcactcacctctcccagccgacgccatgctcaagtctccttgcatgagaccatcatactctggtttggattttgtaatttttatttgactttttctgccactggaatatagggtctttgagatcaggactctatgtcctagacatttttacactcaaccttagccccagttagcttttagacaagtaattattgaatggcagtaaatattccttgggtttcactgaagtctgctctaaatgcagttgagtttaatgatcaagagcttggactctagcatcaaatgtgagttcagattatttctccattacctcctagttgactaacacctactttctgactataacaacaaatgttactgataactatttctaggaaattcattaataacatatctattatgtagtaacttatcaataaagacaagctgttgtaatttgatcaggtcaacttcctttcattaaaaaaaaggtgaaattaactaaatttatctttggtatgcccaaaaccactctcccatctctccagtaacttctctgtgtctttatgtgactcgggacacttctttgtcaggagataaaatactttgatgaggagatttacataaaggcgtaagtaagaacgacttaaaaaattatctttgataacatagttgctgctaatccaaaggagaaactttaatgctggaatggcaggcattaacaataaataaaccgctggaagtaattttgaacgggatggcctatgggaaacatcctagaaatcttactatgtaaggaatctacttactcatttattcactaagttgaaaaattcatactgaattcttgctgtgggaaatatttttctgggtgtgtagaaatgtagagatttatattacttacttttatcctcaaacgtgctcataatctaacaaagcagacaataatatcttgtatttatattgttttacatatatttacttataataactatcttgtgatgaaggttaagaatttcattcccagtgttcaggtttggaaaaggaattggatttacccaaggtgatacagctagaaagaggagaaatctatactcatatgcagttctcctgaatataactatttttcccccatgacacaatgcctatacaaccataatccaaataaactgataggtatcataagtgccaaagtaatacatttagatgagagtaaaattaatgtttgcaattaattagtaatggtctcatacatagggcatttcagtgcgtgggcactgaagaatgaactggattttgacaggtggagatggtggaaaggacattccagactggaaaactggagaaaaaataggaagtgcacaacagaggtgggaaagaacagatcttttttttttttttttttttttgagaccgagtctcgctctgtcgcccaggctggagtgcagtggcgtgatcttggctcactgcaagctctgcctcctgggttcacaccattctcctgcctcagcctcccgaatagctgggatgacaggtgcacgccaccacacccagttaattttgcttttgtatttttagtagagacaggggttcaccatgttaaccagggtgatctcgatctcctgacctcatgatccacctgcctcggcctcccaaagtgctgggattacatgcatgagccaccatgcccagcctagaacagatcatattgtaggaaggccaaccaccctggctgactagaatatggggtatgtgaaagaaagaagtggttttgataatatttaaaatatagattggaactagattatagagaattgtaagttttcactcttttccaaagccagtagtactcaggcctggctcagaatcagagtcgattttgcagcttttttttgaaatgcccacgccttggcagcactcccagagatcctattcattagctctcaggtgcatggacatctgcatattttaagattcctctattgatcctgccctgtaggtacagtagagggtccgcgtcatggtgattgaagcgcggtccacttggcgtgtggtctgtagactgtgctagttttcaaaggattagtgcccatgaagagaaattgaatagtgaaagggtaaaaactgtatagcagtttgatgaagtaattttatatctgttgagacacagaacttaaaaatggcaatgtgttttatatgtgttttgttcattcttgcacaattcatcttattatattttacaaagatattgttacctgagaattggaaattaaaaacaaaaacaaaactgggtttttcacacagataatccaggaagtgtcatcactccaggccacggtggcattcgtgaatgggaaacaatgtttggaaagtgtgccgttttgacatcagtgtggctctggcacgttggatggatgagatgagtaggaatcagtgtgaagtccgcattacaacatgcttggattcagttatgccaatggtaatggaaagaaagaggaaagatttcagagaagtatgcaaagaaaaaaaagaaacaaactgtcaatagatagaataaaagaaaagataaaatctaaaaatgttcttgatgtttcatgcctgcgtgactgaaaaaaaaagtgctactatttagaagtatgtagatatcattaagaacatttgggggcaaaaagggggtggaagtgagggtggagacagtgattttagctctaggcacattcagtttaagaagtctgaagtaaggccgggctcagtggctcacgactgtaatcccagcactttgggaggccgaggcaggtggatcacgaggtcaggagatcgagaccatcctggctaacacggtgaaaccccgtctctactaaaaatacaaaaaattagccgggcgtggtggcgggcgcctgtagtcccagctactcgggagactgaggcaggagaatggcgtgaacccgggaggcggagcttgcagtgagccgagatcgcgcccctgcactccagcctgggcgacagagcgagactccgcctcgaaaaaacaaaaacaaaaacacaaagtctgaagtaagtcaaatggaaatgtttccaaagccggtgaacatatgggccctggaacagtgacagtcacagcagttgggatcataatcaggggtggtattaaggacatattcaaagtggccagtggagcacagcactgacagccccgaaggcacagtggccataaatgcacgacgttgccaagggagtgcctgcccactgaagggcagccctggctagaggtgggataaccctggataagagtgggcagggagggggatctctgagggagagatgatagagaaagcaaagagattgtaaaataactcttagtgaaagtgagaggagaaaggggatgtgggaaatgtggaagaatgatataaagttggttttctttctttcttttttttttttttagacagagtctcgctgttgttgcccaggctggagtgcaaacctccgcttcccgggttccagcaattctcctgcctcagcctcccgagtagtggagattacaggcgcccgccaccatgcccagctaatttttgtatttttagaggagacggggtttctccatgttggccagactggtctcaaactcctgacctcaggtgatccacccgactcggcctcccaaagtgctgggattacaggtgtgagccaccatgcccagccagttttctcttgaaatcaggaagagaagaaattttaaaatgaaaagaacaagatgacaaacattgatgaaccatacagagaaatggaagagaatgagaaataagtaaagactagatttagggagcaaaaataaacaggaaagcttgaagaaatcagctttagtatgttaggaaaaatttaagatatagagcaatgaatagcaatatttggtaaatgctaccggctggattgtgacgccctaaaacccatatgttggagccctcattccaatgtgatggaatttggaaaagggaccttggggaggtaattaggtcatgaaggtagagccctcatgagaagatgagtgtccttactgattttatttttatagatttaggaggtgaaagtgcaggtttcttacaggcatatactgtgtactggtgaagtctgggcatttagtgtactcatcacctgagcaggaaacactgtacacaacagttaattttcaaccctcacccccctcccaccttccagcttttgtagtctccaatatctaattttccattctgtatgtttttgtgtacacattgtttagttcccactaataagtgagaatgtgctgtttctgatttattttacttaggataatggcctccagttccatccatgttgctgcaagacataattctattctttttttttattattatttttgagacggagtctggctctgtcgcccaggctggagtgcagtggtgcgatctcggctcactgcaagctctgcctcccgggttcacgccattctcctgcctcagcctcccgagtaactgggactacaggcgcccgccaccacgaccggctaattttttgtatttttaatagagatgaggtttcactgtgttggccagaatcgtctcaatctcctgacttcatgatccacccgcctcagcctcccaaagtgctgggattacaggtgtgagccactgcaatcagccgattttattctttttatgttcacgtagtattacaaggaatatatatgccacatcttctttatgcagtcgtctgttaatggactcttagtttgattccatatgtttgctattgtgaatagtgttgtgataaacacaggagtgcaggtgtcttttggatgtaatgatttatttccctttgggtagatacccagtagtcagattgctagattgaatggtagttctttttttagttctctgagaaatctctgtactgttgttcagaaaggttgaactaatttacatttccaaaaacaatgtatatgtgttccctttttcttgcatcctcaccaacatctgttgtttttagactttttaataataggcattttctctggtgtaagatggtatattcttgtggttttaatttgcatttatctgatgattagtgatgttgagaatttgcttatatttttcttgaccatttgtatgtcttcttttgaaaaaatgtcttttcatgtctttcccccactttttaatggggttgtttttgccttgttgagttgtctgaattccttgtagattctggatattagcctttggtcaaatgcatagctcacaaatattttttaccattctgtagattatctgtttattgattgtttcttttgctgtgcagaagcaaatacaaaacactgatgaaaggaatcatggatgacacaaacaatagaaaaacattccatgcttatggattggaagaatcaatatcattaaaatgaccatactgcctaaagtaatctacagattcaacacaattcctatcaaattaccaacatcatttttcagaattagaaaaaaaaatcctaaaattcatatggaaccaaaaaagagcccaaatagccaaagaagttctaagcagaatgagcacagctggaagtatcacatcatctgatctcaaagtatactacaaactacagaaactaaaacagcatggtactggtgtaaaaatagacatgaagaacactgaaacacaatagagaatccgcaaataaagccacattcctacaaataactgatctttgacaaaatcaacaaaaatatacactggagaaaggacaccctattcaataaatggtactgggaaaattggagagctgtatgcagaagaatggagctggatccatacctctcaccatatactaaaattaactcaagacagattaaagacctgaatgtaaaaccaaaaactataaagatcctagaagaaaacctacgaaaaattcttctggacgttggcctagcaaagaatttataaccaagttctcaaacgtaaatgcaacaacaacaaagacaaatgggactaaattagattaatgtctttaaaagacaaataggaggctgtcatctgcaagccaggaagaagtcccttaccaagaactaaatctgcaggcacccagatcatggggcttcctagcccccagaatggtaagaaaaattttctgttttacaagccacccaagctatgacattttgttatggcagcccaagcaaggaatgacactaaagaagtggaggcagtgaatataaagtcttcacaatgctaccaaataaatgaaagaaaaggtaagattgtcgtttaagaagggtgaagaaaacaaaggcagtatttgaagagtgagtggctgaaaattattcagaaatgatgaaagacatcaattcagagatactggaatcccaagaaatatcaaacaaaataaataatatatattcaatccattttaatgaaactgctgaacatcaaatacatggaaatcttaaaagtactcagagatagcaggcatgtaacttgctacgtaaactgaaaacagatttttcaacagaaacagggcaagctggaaaatcgtagaatcatattttcaaaatgctaacagaaaactcagaaattcatttccagcaaaaatcttccaatgggaatgaaggcaaaataaagacattttcagacacacagaacagagcttgtcactaaatacaattttctggcagaaggaaaataatcccagttagaaagttgtgaatatagaagggaataaaatatgacaagactggtaaatatgtgaaaaatttaaataaagatcaactacattaacttggcccaggctggagtgcagtggcacgatctcagctcactgcaacctccacctcccaggttcaagtgattctcctgcctcagcctcccgagtagctggtattacaggcacatgccaccacatccggctacttttttttttttttttgtatttttagtagagatgaggtttcaccgtgttagccagatgatctggatctcctgatctcgtgatctgcctgcctcagcctcccaaagtgctgggattacaggtgtgagccaccacacctggccaaaacttatgtcttgtagagtttaagatatggaaagtaagtgacaacactgtgtaagtcacagagcagtaaaagaagttggaatattttaccacagttgcaaaaaggagagggtttgtgaggcccgggcttctttatatacaagaaaaggcaacactgccaaatccgagtctaggcgcccagaaagctaatgcaaaaccagtgcctaaaggaggaaagtatcaatgtcaccttgaaagtgaacagagacactactgttattaaaaagaaaaacaagtcatgaggaagaagaatgtattgagtcgttagcatgctcaaggaggtttccacatattaatattatcttaatttatgttatttattcctgttatattctaatactatgtattattatttatgctaatactatgtattattatctcctttttccaaggaggaaactgactctgtagggtgagctaactcatcctgaatcaaagctgcaatgtggagattggtgtgttccattacatctcattgcccctttagaagcaggctgtgctggggaccaggaggaggccattggatgggtgccaggaagctcagggcttcaggcatggctgaccctgtttccactgggccccagggaaattgaagccaaatgtatgaggatggaacagttctgaggctttcataagttattttctgtaatccattgaccattttgatgatcatttttcctcccagaaaaattcacttaccccttttctcttctgtggactgcattgccacattttcctctctcatttgatttcacaagtgtccataatcttacttgctcctttcctttggcattttctcttggaatctaagtatctctgttttttatattttatagtcacttgcttcatgtttatcctctttttgttttctatctctttctttccccaaagaaataagtctttgctgcaattcataggggctgatattgaaccatacgtccagggtattactttacaatgtccataagctcccagaaatgcaccagaaatacgccaacaattaaatgacactttatttctgggcgtaggtaggggttcttgctgcccaagcacagcctggcagacagaggcaggacttcaaatgaccactgcaagcctctctttttgacggatgcagctcatccaatacaccaagagaaggattgtccaaattaaaatctatttctaacaggaacccatcaggaacaatccctaatactgttcttccatgaagaataaaaaaggtaaaagtcatataaaagagggaagacatggcaagatagttacaagaatattttcagagtataagttttaggaaatatgctgaattatccagtgttttaattaccctgaagctggactttccaaccaaaactcataatctaattaaggaagtccatcatatcaacagcacataaagcaacaagcaattaacattttccaaaaatgaaactgatgcaggagcatttcgatttactctaattatactgtgaatgctgtgcctaatgcaacaatgcctttgcatttaaaaaattgtctttaaaggtctccctccaaattgtaataggcttatatttctcccattctagctgcctgtaatatacataaaaatgagaattacaaagaattctcaactcatggatattataaaatatagatgacagaaacttggccctgaatgctcccacaagaacagtttgcagcaatcacactacaaagagttgtaaggatagcactttgatcaatctgcttcattcatctctatgcgcttgaaagaaatgtcttggaaagggctaagagccagcgttcctgaacctccgaatacaggcttgttcttgcaccagatatcgtgcctaccgcagtgcagagctcgctaagccttcaggaagcttttgtttcagaccacagtggtgtgcactcctctaaagcatatgctgcagtacatgactgagccttctgtcagctgatgaactgcatctgactcctggtgtttaaagggtctgaaacaagcatatcattctgcaaagtctgagattcaaaataagtaaatcctattgattatatcagtagaaattacaatcatgggattctagaagtacagggaaactggaggaaactccagatgaagaagctgacatccaggaaataaatagttgcccactcctacacaaagtgggaaacaaattggctttattgactcctaaacttttggaatcagaaagatctggcttcagattcaacttttccatttaatgtgggaatgtgagcgagttacttccctagccctttggtttcgtggtctttaaaatggaaacagtaatacagaccccttacaacatgaagatcagatgaaatgacacatggggaacctttgatgttcccactgttctgagctgcaggctctctgaagtgatcttcttccttctcatgtcattttctgaggtaataaaaagcagatgtgaagtaaaaatttgtcagataattaatcaagaagaaaaaccagagcaggcaggaccttcagatattcaaaatcataaagttgacattttatctaaattcctcaagttggcttttcatagaagctatataactggtgtttcacactgcacgtcatgtttttaccgaaataagaggaagattacatccctaaatacaaatttactaccaaatcatgacgtgagaataggagaaatagctccgtgggacattagccaagaaccgtgataaataagaagagagaagaaggttgggtgctaagttagatgataaagttaccatgattttctagctaataattatcctacattctcagatgcctgaagaaagatacatgtgtttgtgtgtatatatatatatgtgtgtgtgtgtgtatatatggcatgcaacaccataaattaattagatgtgccttgtatcacatagcttgaattaagaccatagaaaagataacagaagtaagaatttaaaaataggacccaatataaatatctatttgatttatgagtgcatttattaattcatatatttattgatacttcctctgtgaataactgtgcaagttttagaaatataaaaatgcagctggtgcagtggcttacacctgtaatcccagcactttgggaggccaaagtgagtggatcatgaggtcaagagatcgagaccatcctggccaacatggtgaaaccccatctctactaaaactacaaaattagctgggtgtggtggcgggtgcctgtagtcccagctactcaggaggctgaggcaggagaatcgcttgaacctgggaggtggaggttggctccactgcactgcagcctgggcaacagagcaagactccatctcaaaaaacaacaaaaaaaagaaatataaaactgaattaaatatgatcccagccatcaaagaatgcacaattctagaataacaaagcataagcttatagcactggcatggtttcctgctgagtctatagagcctgcttccaatgttatcatgccactgtcaaaagacatacaaaattaaacaatattttaaagagcaaaaaacctctgtgtctcaaactccaacaaatactatttctacaggacatacaagttttcaaatgctttgagttagcctttcacaataaattattttccaaaaaaatgatttttaatgtgtaaaaatttttctgctgtgagaaaaaataaaatattgtttaaaatcttaatactttaacactttacaatactttatatattattttatataattgtcctcatagagtatatgtaagtttgtgtcatgtattatatgcctagtgttacatcctaaacatgtccccagtggtaaccactgtttgtttttatggcagcactgtattaaatttaagtaataatttactgaataatgtctgtattgttggatatttagaatttttctgctttgtgatcataataaacaatgtaattggtacagggctttaaaatgtgataattatttagaccatcactgaagtcccaaaatactagctaccatattccaaagttaagtcaagaaaccatgaagggccgggcgcaggggctcatgcctgtaatcgcagcatttcggaggccgaggtgggtggatcacatgaggtcaggagttcgagaccagcctggccaacatggtgaaaccccgtctctcctaaaaatacaaaaattagcagggcgtggtggcgcttgcctgtaatctcagctactcgggaggctgaggcaggagaatcgctggaaactgggaggtggaggttgtgagtgagattgcgccactgcactccagcctgggtgacacagcaagactctgtctcaaaaaaaagagaaagaaagagagaaagaaagaaaggaaggaaggaaggaaggaaggaaggaaggaaggaaggaaggaaggaagaaagaaagaaagaaagaaagaaagaaagaaagaaagaaagaaagaaagaaagaaagggagaaagagagaaagaaagaggagggaaggagggaaggagggaaggagccatgaaggacctgtgcagatattgggaaaaactgtgttaagccgggtcatatccctgccccccacgaatgcttcctcctcatctcaagtgacgtaaggcgatttccaagagcatgctatgaggctctgggaatttggaacctcgtggcctggtctggctcagacaagagaaatgtaaaacacaggagaccttggctggcaaggagaggttactgcattgttggacaaaggatgtgtggcaattgtctcaaatactgtctaaaacacgtcagaaagagaaagacttcccagatgcctcaaagattagcgaaattaccagcaacctgttaaaaaagaagtctcaccaatattaagagaacgctaagtaaaagatccctggaaatacggtcttcaaagaacccatgtgagcatccaggagggacgtgttggcttaaatacctgccagaccaaaggagcgcctgtcccttctcattccaatcagtgaagtgaaacatggcagcctcctttaagtgaatgtatgtagtgtgtaaggggtcggagagggaagccacaaaagcaaaggagggaaaaacagaggggaaatcttcctccctcccatcacaggactgaggctgaggagacaagaaagaatctttttaaataaatatgaagctgtaatcactctactagagtaaagaaactaatttgtaagtgattcttctttgtttttctaaccataagcatcagtaggactcttcactatctaagaatgagttgggggaccacgagatctgagctccttgtcatccaggaagatgggaggaatgagttttacagaatggttgtaacaagaagtcagcagatagcaagctgatacctgataccgtaccaagagtcttgcttttccaacataacagtcagactataatacagattacaatttgtaatcccagcattttgggaggccaaggcaggaggatcccttgagcccagcaggtcgaggctgcagtgtgctatgatcacactgttgcactccagcctgggcaacagagtgagaccctgtctcttaaaaaagagagaaaaagaaaaaaagaaaagaaaattatgttgcaattacattttgcattcttttagtatatctcctttggataaatcctcagaagtgagattgctagggatttcatgcaggtgccatcatttacttaatcaaaccctatttgcaaacaatctaggagtttttccttcattttttatgatgatcaatgatgttgaaatggatgtaattttatgtaacagatttttcctccttttgggctatttactgtttatgtgtgacccatgggtggaaattgtttttgctcttgatgcatttacaaatggctctctaaagggattgttcccccttcattattaccagtggtgtgtgaacatccattttactagaactagatattatttaaatacaaattaataaatataaaatatcaatcttttaaatttgaatctcttctttcactaaaaatattatcccattcacttaccatttacaatttctcctttgtggagtggtttatatttttgtcaatttatcccaaagggattttctgattatagactgctcatgttctcaccccaggctctccagctgcatctgtaccagcagggggaaaaggaataaaataggtgataatataatcataaatatttgcaggaatcctgctgtccaagtttcctactactctgggcattcacatttatttatttatttattatttattttagacaaggtttggctctgtcacccaggctggagtgaagtgccacgatcttggctcactgcaacatttgccttctgggctcaggtgatccttctgcatcagtctcctgagtagctggaactacaggtgcatgccaccatacctggctaattgtgtgtgtgtgtgtgtgtgtgcgtgtgtgtgtgtgtatgtgtgtacagaaggggtctcaccatgttgcccagggtgggttcaaactcctggactcaagcgatccacccaccttggccttccaaagtgctgggattacaggcacgagccaccacatttaattcttaataaagacaatggaatttctaggaagaacttcctcttacgaaaggagctaatttgttttcttttgcaagatatgttgtatttatcattataacttagatcaaatgaaaaaaataacaagggaattttgcatctttttggtaaaaaaatctgataagtttcagcaatattaagattactgtaaaggcttctcttcacaaagagtctaaataggacattgaatagcttcttaaccaaaatgaagtaaaatttgagtaactaaagtaaaataaaatttttcatgtctgagccagaccaggccacgtggctccaaattcccagaacctcatagcatgcgcttggaaattgccttccgtcacttgagatgaggaagcattcatggggggcaggggtatgatctggcttctgacagctttttcccaatatctgcttctcttgccctcatctccaaaagcctcagacctttggctcacaagcccttcatggtctccttctttcttcttcttcttcttttttttttttttttgagtaaaagaacactaaaacagcaagaaaatttttctgtagttatcagaaatttcgctgttatgcggatagctttgtttttcattattaaacataattttgtgtttcttctaaaagaaattatattttgcatctaaacgatagccacaacaaaatcattagaaagatattatacaaccatatccaagtaggataaatagttgttgtagaaatcacaaagcagaaatacgttatcacaatcagtgaatttgatttgaattttagataatcatatatttctacccaaatgaatcttgcatttatatctatgtgacagctgccaaattggcctggaatggaatttggctgatgtaatttacaacagttcatctatttggtttaaacaaatagcaaagaccaggaataccagagttgggacatacctgatttacaaagagcaatcagacgaatcggtgttttcattctactcagatctacccaggttgtgtcactttaggttaggacacagtcgtggagattttgtctttaactgctatgcggttttggttgtgagaagccaatcaccttagaactggcttctgccactttttggagggaaacatcagaaaaaagggcaaagtagagttttctctccttggctttctttggttattaagagctccccaccctctctctagtatttgtgatgctgcttctgtccctctacttaatcctattgaagctcacatcacactctagcctggcatcatttttgtgagtcttagagataaaaatggtactggagtattacttaataaaatccacccacttttctaaatacaaacaaaacaaactgacaaatgaatagaacaattacttagcaaccaatgggtggaggatgacctcctgacaaagggtgggtaccaacagtatttaacctgcagcatatacttagcagaaaacatcagaagcctgcttgttaaatatcccagcaacaagacacaaatactccctatcactggtactattcaaaactgtagagaaagtcctgccaaaaatatacaagctaaacgtgagtgataggattactggaaacaacgaaaaaagaaattctacctagaaaagccaaaaaaaaatcaactgacaaactggtaagtcactttagccagctcaaaatataaaataaaagcaggacaaaatcagtaacatcagcactaggctacttgaaaatataacttaaaatgttcaattacactagcaacacacttatctacataggaagatacctaattagaaaagggtgagtcctgtatgaaaaaaacataaaattgaatttaagaacataaaagaaagtgaaaacagacctacatcctacgccaggttaagagagttccatataatagaaaagtttttaattcctaaattaataaattctgttcaatttttaaagataagcatgtttccaagaaacactaccattcaaagcttcatctggaagagtgaatttaaaaacatagacaaaggaattttttttttttgagatggagtctcgcactgtcgcccaggctggagtgcagttgcgccatctcggctcactgcaacccctgccccctgggttcaaacaattctcctgcctcagcctcccaagtagctgggattacaggcacccgccaccttgcccagctaattttttgtgtttttagtagagatggggtttcattatgttggtcaggctggtcttgaactcctgacctcatgtgatccacccacctcggcctcccaaagtgctgggattacaggtgtgagccaccacacctggccaacaaaggaattttttaaaaagaacaagactgtgaggtgaagctaaagaactagcccttaacaacataaaaacataccataaagttgtaataattcagttaatctccattactgttttaagtgaggatttggcataagaaaggaaaaaatcaatctgtgaaacagaataggaaatatagaaactgacccatgtgtataactcatgtgcagaatgataaaggtaaatcattcaaaattgtaggaaaaggatggataggaaaatacaataaaaatagaatttgaaaacctatttatccatttgtggggtaaaaataactttacagctcacatgtcatatattccagattcagtaaaaccataatattattgtaaaaaatagaataattttcagaatatggaaggccttgtaagtaataactgggaaaaaaacaataatgggaaagacagacaagtttggctacatagaatgtaaatttttgtataataataataataaaagtaatataaatagaagtcaagagacagactgggagaaactcttccacttagaaaacatacaaagacaataccacacattggtgaagaaaggatgtagactgcgtttgtctgactgtctgactttgtgcccagctctgccaccaactgtgaccttgggcaaggtcattgtcatcaatttgtttaatatagttgctgctttggcatccattcctaagccagacattttatatatatatatatatatatatatatatatatatatatatatatatattcccccccagacggagtttcgcttatgtcgaccaggctggagtaggagtacaatggggcaatcttggctcaccgcaacctctgcctcctagattcaggcgattctcctgcctcagcctcccgagtagctgggattacaggcgtgcgccaccacacctaattttgggatttttttttttttaagtagagacggagttttatcatgttggtcaggctggtcttgaactcctgacctcaggggatccacccaccctggcctcccaaagtgctgggattacaggcgtgagccaccttgctcagccgttaatatattttttgaagctcagccgcaccccatcacctttgtcctagttaaacctcccctcgcgtgtgagtagttgtgatacagcctgcttcttcctcatctcactgacctgaaacccagcacaccccacggctgctggtggtggtgaagcctcctggtcagcaccagaaactataacaaagttcctcgctttgccgtggtttctttacagtcgcccatccacacctgcacagggaaggcctaggggaaaacacccatggaccccaataaaggcacagcccccaagtcctccctctctcagtcagccgcaccttctgcttgagcctgtgtccctgacagccctgactgctccccgcttcctgctggccccgtaaggtctgctgccctcccgccgcggggtctgtgagtaataaaactgctctgttctggatttcgctgtactgcctccactgtgtctcacctggccgactcacctgaacccagcttctttctccgtcaagactctcctagagatcggccatcctggtaggaataaactgcacacaggtcaggcaagagccacagggtgtctgccagtatcaacaagcttcttgtggaagggaggcctggtcacaggttggacatttaggcagtaggctgtctgccagaatgaagtcgttagtaaaaggcacactgtcaacatccgtgaccaaatgcccaggaatctcatcagggcagggctaaagtttgtagccactctgctgagagagacctccagacgaaatgagaagctacgtgcgcgcacacacacacacacacacacacacacaccccagtctttcagctctctgtgtctcaattcccttatttgtaaaatggggacagatgtgccggctcactgtactgaaagaatgaaatgcagtcatctataaaaagtgcttagagcagtaccaggactcaattaccattgggtgttattattattatatacaaccaaaaacatctagaatatttgactatgcgaaaaactcctaaaattagttttagaagtataaacaatacaatttacaaatgagcaaaaaataaagacaggcaactcacaaaagaaacatgaatagccaataaatagaaaccaaaaattttcaaccacaatgataatcaaagaaatgcaaattaaaatatcagtaagatgccaacctgcatgcatcaggttagaaaacgtatgggataactatggcgatggatacgacaacaccatagtcagacagcctgttgacaggcaggcagtcattcctaccagtgttggtgaatacaaacccatgcattcttttggggggtgaatttggtagaatattataaaatgtaaaatgtaaacactctttcatctaacagctccaatccttgagtctgcactagagaaatactctaaacaggtattgttcatcactgagaaggtaggacagcctctaaatgccctacttacaatactgtaagataattagtagttcatggttcaatgcaacgatgcatatctgtacatattgccaagaaattttcagtcatactgttgttattttttaaattgaagaacaatatataaaaactggtcccatatatattttaaagcccacaataaaaaatagtatataatatagaatttacacatataaacatatgtggcatataaaacatatttatagaacatatgtaaaatcatatgtatcatatgtaaatgaagagcaacagtgatcaattctaaggggaaggcatatgggtaggggattggaggaacagagatttatcaaggttgaattttgtttgctgtgtattgactgaattatttacaataaggatgcattcacttacggattgtgaaattttaaaattaaaaaaaaagacctgacatataggtaatattcagtaaataattgctgttattgtagatgtgaatgtaattattaatcttgaaattatgtattagtctcttgctcttttttttttgagatggagttttgctcttgttgcccaggctggagtgcaatagcatgatctcggctcactgcaaccctcgcctctcgagttcaagtgattctcctgcctcagcctcccaagtagctgagattacaggtgcacaccaccatatccagctaatttttgtatttttagtagagacggggtttcaccatgttggtcaggctggtctcgaactcctgacctcatgtgatccacccgcctcgacctcccaaaatgctgggattacaggcatgaaccaccacgcccagccatctcttgatcttaaggcaccaagagtctgcttttctgacaaccagaatgccactgtactattatttttttttaagctgaagtcttcaaaccagtttcatacaaccaaagcaaagaggaagcctacagagtttcataaagtgaccaggaacagctgtctggattgattcgaaatgaaagaaaagctcgaacttccactgcagcaatcttgtacagcactttacttcggtagacctgacccaagcagcacagagcccggcatttgcaaaggggagtatactttcagacataatgggaaagaagagaattagcattttaagggttgtgtcttttttgctttatttattcatgctttattttcatctttttaaataaatcacattaataggctatatctgtgtagcagacagaaatgtaatttatttgagaaaggcaaaaataaattgccattggtttttaattttgattgttaataagatgatacagttaatactgatttaaaacgcctgcaaacaagctctgcagaattcaaattatttatagataaaacgttaaatattctataacaagcttgtatcacagaaacatcagtaattttgggtctgccttgcagcttatgtcacagaaacctgtctttttttggtgtgtccttcagttattagatataaggtcaacagtctcatgtattatacttaatgcgatggttgtgtccaattcatctctttatcacctaatgataattcttattaatgtaagttatttggaatagatggagtcaggccaatcacaaaatcccttgactgtagttttgaaatatgctcaacatcataatgatggaaagtcatatttggaaactctgagggtatcttcaacttggaagttaacttctttaagtaaattaggattgtccttggcagatggtgaaggacctcactaaatgaaacacataattagttttacactgacataaatatatctccttatgcctgtatttgttcattttaaaaatgagatttgattagatgatctaatcctatctttcagttacaaaagaatgtatatacacatatatgctctcctatagatatcataccatataaaattagaacaattgtaaattatttctaaagaagaaaataaaatataggtctaactctgatgaaatttcagaacagatcatcaaagatgtgttccattagtacttggcaaatgaaaataaaatgatagtaaatgtaataatagtgattagcatgggttgcatgagaaattttatcaaacaatactaatcagtaaatacgacatgccttcgggttgttatcaagatattttttataagaagattgaaaagtttcaataacaaggtcttcttgtggcttgtagaataaaaaggattgattatttgtccattatcaggctgaaagaggatatctgttttcttctgaagtttttgtccatggccccgactcagtgcacactttttttagatcaataacttgaagatatagagagtatcaagtttacaaatcatttaaatcaaagaggcatggctaactgtacatctagtagcaaaaatatgattccaaaagtttaataggctgaaaacatgagattaaaactaaaacagcaagatgggagctggaggcagtggcagacacctgtagtttcagctactctggaggctgagactggaggacagcttgaggccaggagttggagactgcagtgagctatgattacgcctgtgaatagccacagcaccccagcgtggacaacaaagggtgaccctgtctctaacaaaagaaaaggcaaaaactgagcaagatgaaatgtagaaaggataaaataaatagaaaacccaaattaccgatattcgctgtgaataagacatagaagtttatttgttcacagtgagctcaatatgagccagtggtgtgattggttgtgtttcttccttctgaaaatgactgcagtttaaactaaactattagtgttcaacacacacaaaaatatagtggcacttggttagtttatgtctagaaatccatgtttagttctggttaccgtatttaaaatatttggttacctttttagttctggttactatatttaaaagcagattacagacatgcgtagacaaaaggtagttttaaatatggtaatgatattgggaagtgtgtaataggaagccaaatgtttttagcctagaaatgtaaggtgtatgcatttgtgttagggtgcacgcttttagagagggtgactattatgattgggaggggaaataaagagatgccattactatgcaaatatttataggactatgtcttagaaaacacatttgtcttacatttatctttttactctgctttatatttttaatagatgtttaaaaagaaaattaaaattattcttcacagtcaccatttttgaaaagacaaaagtagcaaaaagagagataccagctcatgcaaactaaataaaacaaaagtgttcctgtttctccacgtgtgtccatctttatgtactcagtgtcaaatatactggcaggcagacagcagatgttacatatgtactggccaaatgaatgaataataaatcactatgaagtgaatggcttgtgagagcccagccactaggcaagcctggaggatgaccatctatgagggacctcagagaaagaactgctgaaagaagcccatgggcctccttgacttctaagatacatttagacataatactatttaagagagcaagtaagagcaaattttctcccatagttctgattatcattatagtttaagcgttagaccttgttcaaacaagcttggaaaacaagctgtcttgtctgttaaggggagagtaagtgatataaaaatgtaaaggttaagatttctgataagttaaagcttggtaaaatatttccacgtatgtaaatgattatgccaatttaatttgtttccaaaattggaatatcctttagaatagaaataaaatatttaatctgaatggtaatacactgatctccttttgtcgtgaactaccgagtcctttctacagttttggccatacacatgaaaattaaattacagtattttaaaatagtatttgtatattccatttgggatcctaacttacctaagcagctcgaatacattttaaattaaaatcaagtttggatttttttcccagagaggtgacttattgcaaataagtagctccctctatttcatatttgtccatttttattctaaatattttaatactataacttaaatattctattggttttatttttcttaatatgataatatttttataaagtatttaaagtaaacaaaatgtattatagttattgttagataaaggtgatagacttaaataaactaaggcatgagccatatctggggttcatggatattgaaataatttattcttttaaagcacattattgagatgttacacacatttggaaacacaaagggtaataactttagtttctatcgataataaaaattagataacctgaggaatctttagaagagcatagcaatgtaaaaaaaaaaaagaggctaaaataacacacatacgttttaacagtgtttgtcttttgctggtgggactatgaatgatttttctccccactgtctacatttttacaattaacattattttaacaagaaataaaaatggcgtgttactttcttttaaaaaaaattgttaaatgttaagagtaaaataatggcactacactatttcaaaagcaaaatattaatttcatgttgagcataaaattcttattaaggctgagtctctttgtgtcatactaataaaaaattctccaattatatatcttaagggtacctgggcagagcaaccctcaacatcactaggaaatgaatcccttcttggaactaaattctccaaatcagggaagtcactttcttaagcaataaaatatttggaaaattaaacttatttataaagtctgtttttctactaagtcatttagctcctttattgctttctttatgtggctatttttcaacattctcttaatgattcagagatattcttgtgattgttaaagacttcacaattaaatacgcggcacctgttaggatgtagcgggcactagtgactagcaaagctttggttttgagttacagtgtttgttctttatggaatttctgtattttcccctgtagccttcctgttagatattactgctgttactgtatctttctttaaccacctcttctttcctcgtcttctagcttctggcttttaataaatgtgctatggtaaaaaaaaaaaaaaaaaaagaaagaaaaaagttaatattgcttacagctatgtgtaataatattcagtaattttctcaacaacaaatatcttctatggccaggaatagcataaggccattaagttgctgtgagataggagcagagtgcatctgcaggtgtctgaaggaggagagcagaatgagaatgcactcagagagttcacgcagcccctcgttccctcatttttaggccaggaagtggctcatctggcttatgttttaaatatcattatgattggtctatgccaaatagattttagagaaacaagtggtagaagtaaaatcaggatagaaatgacagaggcttggactagggtagcagtggtggatatgatgagaagcagtataatacaatttctgttttgaaaatgttaatacataaaatcttgtcaactttttaaggggctcaatatgggaaaatgggttatagatacgggtaatggcaagagccactgacaagtttaccagtgacaagatgtgccaaaggtttaggtatgggctgagacacagaaagaaataataaaggacacctcccaggttttggcctgagcaactgcctgaaggtgataccacttactgaggggcccagtaagaaaagcaaacttggctggggaagaactagaaaggaaatcgagagttcagacctgccatgttaaatgtgagatgcagccatacaagtggacgtgatgacaccattctgtagttcaagtgaatgttctggctagagatatccatttgggaattttcacagtagatacagaattaaaacctatgcaattagatattatcaaccagagagcaagtaatgatagagaaaaacaaagtataaggaaaacagtaacttgggcagtgcaatatttagatgtcataaagaggaggaagatccatcaacgcagatagagaacacgctaatgggatagagggaaaaagtaacccaatagtacgtggtgtcctggaagccaaataaaggaggaaaagcagctggactgtgtgatatgctattcagagactgagtaggtcaccactgctttgagttccagaatctgagtctagagggtcgcacataagacttaatatttaacgtatgtaatattagttacatgtattttccacctcctaaatttctcccaagcccacccttctttcagttttcctacctgtacaataaatggcccttattaacccattcactcatactgagtccattataaaaacacaatagtccttaactctgaaatatatttcaaatctactcacttctctccgtctctactgccaacctccttgtgcaaaccatgtttgagaacttttgtaactcattttttgagaactattgtaactgctctttaactaattcctcatcatcccttctttccactcttggcttttataatctaacatgcggagctctcaaggtttgctgccatgttaaaaaaacagtagcagagaaaaccagaaaagaaagcggattctaaggttttggtctgagaactccgtgaatggcaatgccatttattaaaacagggagctctaaggaaggtgagtttgatgagggattgagaaacgtggaaatcatgtgtcttattatgtcatttccatttttttttttttttttttaaggcagagtctcgctctgtcactcaggctggagtgcagtggcgggatctcggctcactgcaagctccacctcccgggttcacgccattctcctgcctcagcttcctcagtagctgggactacaggcgcccgccatcacgcctggctaatttttttgtatttttggtagagatggagtttcaccgtgttagccaggatggtctggatctcctgacctcatgatctgcccgcctcagcctcccaaagtgctgggattacaggtatgagccaccacgcccagcctatcatttccatctctttatcagttctaaaaaattatattcacaatagcataaaaagaataaaatatgagggatattttaacaaaagtagtgcagagcttgcacactgaaaaccataaaacatcgctatgaaaaatcagagaagatctaagtgaacagagagatagtccatgtttatggattcaaagactgagtgttgttaagatggcaaattcttaccaaattgatctatagattcaacacaatccctatcaagaattcagcaggcttttctcatttaaaatttttgcagaaattaacaagctggtgctaacatttatataaaaacacaaaggaatcaaattagccacaataattttgaaaaataaaaatgaatttagactacttacacttcctgaatttgaaatttctataaagatacaataatcaagacagtgtggtactgacataagcatggaaatacagatcaataaagtagagtcaggaatccagaaatagctccttacatataaaatcaactaatttttgacaaagctgtcaaggtacttcagtagggaaaggatagtcttttctacaaatgtgttggaacccctggataaattcatgcaaaaagaggaatttaggctgggcacagtggctcatgcctgtaatcccagcactttgagaggattacttgagcccaggaggaggattacttgagcccaggaggtcaagaccagcctgggcaacatggcgagacctcatctctattaaaaatacagaaatttctgggtgcagtggctcatgcctgtaatctcagcactttgggagtccgaggtgagcggatcacgaggtcaggagttctagaccagcctgaccaacatggtaaaaccctgtctctactaaaaatacaaaaattagctgggcatggtggcaggtgcctataatcccagctactcaggagactgaggcaggagaatcgcttgaacccaggaggcagagattgcagtgagccaagatcgtacctgtgcactccaacctgggtgacacagcgagactccgtcctccccaccaaaaaaaaatattagccaggcatggtggcatgcagttatagtcccaactacttgggaggctgaggtgggaggattgcttgagcctagatggcagaggatgcagtgagccgagattctgccactgcacacactagcctgggagacagagcgagactctgtctcaaaaaaaaaaaaaaagagagagagaaatttacacactttactcatataatacacaaaaactaactctagatagatcatagacttaaacgttagagttaatattataaaacatccagaataaaaacatagaagtattttttgcgaacttgtgttagagaagagttcttagacatgacactgaaagctcaattcatgagtaaacaaaaaaagataaattgttcttcatcaaaattaaaaacttcatcatccaaaatataccattaggaaatgaaaagacaagctacacgctggaaaacatatttgcaaatcatatatttgacaaaggacttgtacccagactatgtaaaaggctcctacagctctattagaagacaactcaattaaaaactgagcataatatttgaatagatattcacttaaaaagatatatcaatggctaacaaacatgaaaatattctccatgccattaattaatcagggaaattcaaattaaaacatgcatgagaaactatttcacaatcagtaaaatggtaatatccaaaaaaataaaagataataataatacaccccctaccacatgaatcagcagttctactcagaggaatctactcaggagaaataacacacatagccacacaaggacttgtatgcaagtgttcataccagtaagaaaaggcaaatcttataggggcacagagtagattaaattaatggttgcctagggctggggaaagagtgtggattaataaaaatggacacaagagatcttttgggagtgaaagaaatgttctaaaactgaattgcattaatagtagcataagtctataagtttatacacattgatttgtacactaaatctcagagaattttatggtgtgaaattataactgaatagtattgttaaaaaatgtaacgttctttctgcacaaataaagtcaattaatccttaataaaggagaaaagcaattcaatagacagaaaaaatagtcttttcaacaaatggtactggaataattggacatgcatatgcaaatataaaaagtaaatatattgaacttacacttttcacaaaaactgactcaaaacagatcttcaacctaaatataaaccaaaatattataaaacttctggaataaacaagaggagaaaaattaatgtgattttgagtttggcaatggatttttagatataacatcaaaagacataatcagtgaaagaataaaaatgtcagttttattaaaatttaaaacttctccacaaaagacactatcaagagaatgaaaagacaagccacagaataggagaatatatttgcaaaacagatatttgatagaggacttatattcaaaatctacaaagaactctaagaaactcttaaaactcaacagtaagaaaacaacacaattcaaaactgggcaaaagaactggaaaaagaccaggctgtcaaagatacagagacagcaaacgagcatgtgaggagatgctcagtgtcgcgcgtcatcagggaaatttgattgaaaacagcatgctgataccattatacactcattagaatggttaaaatcaaagaaactcacattaccaaattcctatgaggatacagaccaacaggaactctcattttttgtgggaatgaaaaatggtatagcagctttagaagacaacttggcaaactcttacaaaactaaacataatcttactatacaatccagtaatctcatccatatttgatttgaaaacttatatctacacaaaaacatgtatgaatgtttaagcagctttatatataattgccaaaattgaaaggaaccaagaagtccttctataggtgaatgcataagctagtagatccatataatggaatattattcagtggttaaaaaaaagtgcaatcaagtcacaaagacaaggaggaaactgaaatgcacgttggtaagtgaaaaaagccagtgtgagaggctacatatgatatgatccaattatatgacttgtaaaatgaaaacctgccatctatgaaaacacaaatcctgattgctaggaagtgaagtcagaggggatcaagcactgggcttggggcgatggtgaaaccatcctgtgtgatgctgtaatggtggatgcacgacattatgcatctctgaaaactcatcaaacttcacagcatcaagagtgagccttaaggtatgcacaatttaaaaaataggaggctgggaatcccagaaagatatgcagaatatgacagaggaatgcgactgtatcataaatatatcaaattacctcactgaatagggtcaggagaaaggggctgacctaaataactttggaattgagcaaagtttctaaaaattaaagaacagcaactgcacgtaagcactgtactgtagctggcaaagttgtctcccatgggaatacagcttcacgattcttagccctccccttacttctctgtaaattctcagtctaactgtaagaacctggcttctctcacccaccatcgtttatgtagctgttcagtgatatgacacctttatacaactattcgaatggctgaaatataagcaactcacgtgaccaatgcttatgaggatacagagcaaagggagctctcattcatttttggtgggaacaaaaaagatacagccactttagagtttggcaaactcatacaaagctaaacatgaataggtatataaatgaaggtgggttggaaaagccaggttattttttggttagaatttacagataagagaaggaggctagaatgatgcctttgttagcatatttgaattggagacatcagtataagctcacatttagcttaatatagatacagatggccacctatggaaatatttatagatgtatgtatatacatgcgttaggatacacacatctatttctttgctctatcagctgagaagatctaaaacaaatggcaccctcgtatcaatgaacacacctagatcttgcattgactacctcctccaataaaacaaaccaagtcttcttgtagagagggctgatactaacaccaaggccaggtgtatacaggatgagcctggagcatccagtagtcacagaaagcagggcgtgcaccctcctccccacagaaaacctcacatcatgagggtgtgtgaagggggcacaaagccaactgaaagcgctcccaatggccaaagctggaacgatttgagccacaaaataagtcgtgttggattataatccaaactataaaagaaatatccatggcctggtgcagtggctcacacctgtaatcccaccactttggaaggccaagatgggtggattacaaggtcaggagatcgacaccatcttggccaacatggtgaaaccccatttctactaaaatacaaaaataagctgggcgtggcggcgcgtgcctgtaatcccagctactcaggaggctgaggcaggagaatcgcttgaacccaagagacagaagttgcagtgagcccagatagcaccactgcactacagcctggcaacagagcaagaccctgtctcaaaaaaaaaaaaaaaaatccacgagtctacactgatataaagaatgattgaataaatgaataaatcggggagtcaaatcaaatcccctgccaaatcatttctaataacttatgccactgttttgcctttaaggaagctactccagccttgagggattggagcataactcctaatccctaagtgtgagctacacatacagactcccttccaaggggtagattctggaaagtgcagggcgaggcagcggaggagccactttacagggaagaaaacacgacctcagccaggtgattcaagtcgaagtcagaaccaacagtcacaaatcatgctgacagtgcttgcccacgatatgatgcaatgaaaatggcggcttagctttgtgattttcctctacaaaagacacaaatctagtctaatcatgaggggaaaaaaagtcagaaaatttccaacagagggcaacctacaaaagaggacttctcaaaattgttggggtcatcaaaaacacaggaagtctgagaaactatgacagccaagaggagcctgaggagtcacggccactaaatgtaacatggtgtcccataggattccggaacctaaagctgatgttgggtagaaactaaggaagtctgggccaggcacagtggctcactcctgtaatcccagcactgtgggaggccaaggctggtggatcacctgaggtcaggagttcgagaccagcctggccaacatggtgaaaccccttctctgctaaaaatacaaaaattagccaggtgtagtggtgcatgcctgtaatcccagttactcaggaggctgaggcaggagaatctcttgaacctgggaggtggaggttgcagtgagccaagatcatgccactgcactccagcctggggaactgagtgcgactaagttaaaaacaaaaaaaacctaaggaagtctgaataagctatgggcttcagttcataagatatttataatattagttcattaattatgcaaaggtaccatgctaatataagctgttaatgatagtgggaactggcttgggtgtatgggaactatctgtaccatcttcctaatttttttatgaacctaaaactgttctaaaaactaaagtcagagtcgatgtttctatcagtatccccactctccagccatgtctttgtgttcctcttcctcgcagtgcatgtgaggatttgctccttggcctggaacactgtttctcttgctgtggatcaacataagcctaatccatttaatcatggcgatctcatcatcagctcccacctaaactgctcctcttcacagaagagttttgctgccttcaatctactccattgcactctcactactccctcgagtttttcttcacaggacaagccatatttgtattatctgagtgttattaattagttaaagtctatcacctccagagactataagctccatgaaagcaaggactacatttgctcccaatttcaatactgagagtaacattgaatattcgatcattttaatgaatgaatacacgacagaaaaaatgaatcctgacctctcaaagattatgtacttatttttacttccttcttggcagcatgtaagattacatatattctaaattattgatagtgaacttctgtctaacccacgtggtattctaaaagacattttaactattcagatacagctgaatatttgtatcagggtaatacaggcataaatatccagtggttaaacctccatgaatgtacaatattttagtccatattttacatagtcattaaatgctttattgaagcagagtaaagtctgaaaactaaagccaaatcctttgacactaaaaataaaaaaaaagcgggtgtccaagcaacataacggtcagtgatttgctacttaacaaatgaaaaacaaagaaacaaaatccaaatcaatgtaaacaatatatacctctctgttgacaatgacaacaggtgctatcaacacagaagatgatataaatgtaagtgctttagtcaacattacagccagatgataataagaacatttcactctgcatttataggacccagtagcagtcggctgttaaagaaaagtaacaataatcaaactgggctaagtattttctatgtgaaggtatcatgaaatttatgaagtctgtgtaagaaagataaaggcattcacttttgaaagaataagatagtttaaacctcaacattctctatgcttaaaattgagctaatttgaataaacagaccatgacatggaactgtcactttacaagttcctgctttagtctttaactctcaaactagcattctttaaactgtctaacactgtgaactagttttaatgcctccagctttgtctcctattattatgagcacattatatggagtgaaaaaagaggaatattgttggacttaatagtaaatataatatggaaaataatgcaatgagcacttaaacaaagttataaccatggttaaacaaaagaaagattgtatgtgtcagctgctgaaagacattctaagttatttgtgtgcaatatactgttgtttgacagaactgacacctaaatgtgaatgatggtttgctttcgctaatattagggcatgaatctaggtttaatccagtccagtcaaacctggactatgcctcactttttcttcatagatttgacaatgggtcttcattttaaaatcacttacaaccacgaagagaaaaaaaaaatctcttcactggtccgtttggcaaatgacagtttgcttgagatttccttctgagatcaaagaggaggaaataatgtcacgctgcaggaatttctaatgattaatgttattaccatgaacaccaaaggaagtgataataatttgccaagtgtgctgcccggttttccagtattaactcatcactatttgcttcctcagagtaaggatttctcacaaataaggaaaagggatgaggagatatgtattgcttttgttttccgagaatgccacgcacccacactcagcacaccctagcgagattttagcctatgcatgtgcgtctttcctgcctttgcctgtttctgcctcttgaccagcgtctatcaactatggagctcgactccctgccattaaggagacagacttcctggggtgctctgctcccacctgctcccttttggactaaacaatgtgtgtgctcttctgttacagagtcagttccttccacaaaattaccgtcttgctgtcattggtatggctgccagcaaaccatgccaaggtcttctggtgtgcctacagctaaatacttgaggagaaagaggggaactttgaagctcttgatgccacactcagcatggaacaattttggcaaagcaaccatttgaaatttgcttactcttcaatttagggacggctctgatgatttatgagttcagtgagttgaattcaaagatagaaaagagcatgtttctcctggacaattatggagaaagggagaattagctgttccttattcttcttgttagttaagtcctatttgaactgttcttgcctcatgtgatgggaatgtctaaaaatgccaaaggagccatccatttatttccagaattagcaaaaaccacaaacttcgctgctgaagagcaggctcccacaggaactcatataattctgcagcgtgccattgactttaaatggccccaaatactttcttaaaactctctgatgtgatctatctttgtggtaaccttccacacaaagtgctggaacagtgagaaatagaaatatacatgcttcataatgacttgctagtttaaaatgagtgctttgcacatggcattgggcatatccaggccctctcttgcttgggcataaagccagtctgaaaagtgaatgtataaatcattcagctagatatgtcagcttttagatgtatacgcttcagcttagaggcctaaaatatatcacactgttttcagagttttgtagcttattatcggagcaatagagaaagattttgattgtagaatcagtgtgtctaagtgcatagtatggggcaaatgtgggtatctaatgagttaattcaaaatcataagcagaggcgctattcttgcttcttagtaataaagtgttcctattggagtcatcaatgataatacaactttagtctaaagcaaggatggaatcaaggaattttatttatagtactgtaacctgttaatttgatgggcaaagactgacaaattcaggaatgaaaagaatgtgcttttctttccctttcctctcctctcctcccctcccctctcctctcctctcctcccctctcctctcctcccctcccctctcctctcctcctctcctctcctctcctcccctctcctctccttccctcccctctcctctcctcccctcccctctcctctcctcctctcctctcctcccctcccctctcccccccttcctcccctcccttctcctctcctcccctcccctctcctcctcccctcccctctgctctcctcccctctcctcccctcctctcctctgccctcccctacccttctctcccttccttctcttcttcctcccttccttcctttatccctctctccttcccaccctcttctcttcctcccttccttccttctgtataaagtaagatagaggtaataaactcagtagattcagtataccgatagcatataacactgacaaatcaggtaccagaggcaagttctgcagtagaatctacaagtgaaacttctagaattgtattattaaaccataaaacatgcatccctcccaccctaaagctattttttcttaccacttagatgtaaatcatctgaaataaagttacagattttgagtaacaatattagtatgtgaatatgtgttgctgcttctctaagaacctcctagtatacccagtacacctgttggtaagcccctgtcaacagacagagctggtcatccccagccacttcacaggagttcctgccgtttacagtatttcttcagaagttacgttcaacaattctgctacttatggttttctttttctgtaaatttactaggcaagtcatctctgcctgacttgcaaattcaatgcttgactctcagattactactgctttcatatagatgtggatcttcctttgcaatggttttttttttttttttgaggctggaattcaaacgtattattgaacctctagaataaattaatatttcttttcagggttactatcgatgagactatatctaacatgtctgcctgagtaatttgttttctataattatggattactaaagggtagaatcaaaatatttctgaggttctcatacagtataatgtctagaattcaaaacttttttgttaagtgaaaagacagactgtcttattcaaaaggtgcacattcgctttaataaatgttgacaaagattctgtctttgaaatttagccaggcttctctgagcccattcttaccctggccttggcctcggtctatacagacatgtttgtagtggcctccaaacactaagttcgtttctcacagttgaaagctgcatccccagggacgaccccgaccccggctcggcttcagtgcctgcctgaggacactgcaggctgcccaaggagtctactgtttgctccagccaacccctggagagagggctcccatctcctagcctctgtgggagggtaagggcctcatcttgacaagctccagttaacaaaacaatgtgggtttcacacggaccaatccccgatttcctgctttttgtaattttccacttctctgaccagactgatcccccgtcacccatgctctcttctctcgctcttgctttaaaatgcccagtctcctctgcacaaataaaacttgagttcaattcatgctggactttttcctactacgatggtacgttatggattaaaaaacctgtccttccagctttacctaatggcaggctttgtttctctttggaccatgtgcatggtgtatctttcttctctgctctcagtgtgccagaagtaaaattaagggattgaaccaatggctagaacatctccaaaattcttactcactctgggtatggtctgctatttttgcatttaaaaaaaataacttttactttagacacagggactacatgtgcagatttgttacatgagtatattacacccaggtggtgagcatagtacccaataggcggtttttcagcccttgcctgctctctccctaccacctctagtagtctgcagtgtctccatttttcccatgtttatgtccatatgtggttaatgtttagttcccactggtaagtgagaacatgatgtatttggttttctgtttctgcattaattcaattaggattacggattccagctacatccatgttgctgtgaaggacataattttaccctttttatggctgcatagtgttccatagtgtatatgtaccacatttgctttaaccagtccaccactgatggtcaccttaggttgatttcatgtctttgctatcgtgaacagtgctgcaatgaacatacgcgtgcatatatctttttggtacaataatctattttcctttggatatacacacagtaatgggtttgctgggtcaaatgctaattctgttttaagttttttgagaaatcttcaaacggctttccacaatggctgagctaatttacattcccaccagcagtgtataagcgtccccttttctccgtagcctgaccagcatctgttgtttttttaccttttaataatagccattcctctgatatgatatggtatctcactgaggttttgatttgcatttctctgatgataatgatgttgagcattttttcatgtttgttgcccacgtgtatatcttctttcaagaaatgtctgctcatgtcctttgcccatttttaatggggtcgttcacccttcgcttgttgatttgtttgagtttcttataattctggatattagacctttgttggatgcagagtttgcaaatattttgtaattcccaggctaatcatattatacaaacccaggtctgttagcctgagctgcagtttgagataaataccagtaggtggcagtgcaggtcacatggtggcttattctgcacaaagctgctttcccatgggggtatgcccttgggaagagaggactcaggcaccagtctggacaagcacccttttgttaacgcaaaggaaataagtcaatcaaatcaacaccagtaaagaaaagtatacttagaaataccaaacaacaatattaaaagaaaaacatccttaagagtactgttttcttttctcctcatactatttttgagtttacattgctgctgcattttatgaactctttttgcattgcagccccaggttcaaggcttggtggagtcctgtagtagccacccaagatttcactggtcttcagaaacttggaaataatctctcacaattcgtcttaaaaccactgaatgtatggttcttatggaggagaggctggctaaaggcaaagtaaatgtagatttcgtgtctcatcacagaggttcagcaatcactcgccctgtcctcagtagttccccaatagtcccctcccaggtccccactcactgcctctgggatgcatcccccactccctccccactcccctggggtctgaacaataaatggaaagcaactcggcctcttccctttcaaggtgggcaccgccactctagtttagtgaaaaatctttccctaaaatggtcagattgataaaaggtaggcaacggttcaggaatatttgtgcttccattagtgagatttatgaacttactccaacattctgaaacaatgggggttgatgatacagttccctaaggttctttttataaatttagctccaagatctttatttatctgtaacttctgtgcttctcctgagcctgtggtaacacacacctcttaagcaagggctgctcaattaagaacaccctaggaggcttgcacctgaaggtttggctttatgccagataccatatctgcactaaagagcttgtcttactaaaggggctcactcccattcttttccattttaacaaaggttaacttaacttaaacataaaatatttgaaataattctatagtgactgtcccatagagagagaggaaatgtatttacattgggagctctatggaaatttcataaagtgaatagttctaaaatgaaaagacagaaatctctagcataggttatatgttccagtgttatgaattaagtctcaaagaaattaagttcttcaaaaaagttcctgttataatgacacatgctgaactctttgtgtgtgtgtgtgtgtgtgtgtgtgtgtgtgtgtttgtggggcctctaataccctcatgttttcagtttatattttacagtatccccatttttcagttgaagaatcataaggagatgctttaaatagtttgcccaagaacatcaagtgagtaatttgaccaagccagaaaaattgcaacaaaagctgggtttctgcattgcatcagccagaaccgtgctttctcagaactctaattcagtattataatatttctgctctaacaccttgcagtggggaaaaaattaaaatctgatattatacacacactttggaatcctttaaagtaaatgaaatatttatgattcaacctgggttcaaatgaaggaagtgtaggcatatcagctacagtaaaccaattgatgactcaagatggccaatgatgataaagttgagagtcagctggattttcactggggctggcagcaagacaggcctgatgttgaaaaaagcagacacaacaggtggaagaacggcagagtggctcttgcttttggtctgaacactcccactggctgcagcactgagttctatagaagcatctgctcacctttcctcttggctggaaagacttacatcaaatgattacaggtttaatgagggagaagtgtcaagattagaaagactaagctgtaggtttcatctggtaaacaatacgggaaagaggctgggcacactggctcacgcttataatcccagcactttgggaggccagggtaggagggtcacctgaggccaggagttcaagaccagcctgggcaacacagaaagaccctcatcttgacaaaaaaaaaaaaaaaaaaaaaaaaaacagctggacatggtggcatacacctctattcccagctacttgagaggctgaggcaggacgatcacttgatcccaggagtttgaggctacagtgagccatgagtgcactattgcactccagcctgggtggcagactgagacactgtacagaaaaaaaaaaaagaaaaaaagaaaaaagaaaagaaaaaggaagatatttactcttgcaaagaatatgggaataaaggctatttttaaagatatgtgtgcatttttattttatcttaaacaaagctctctttttacagacctattcaaaaacactgtattatctacatttaaggtttctgaattgttcttgaaaaaggtaagcttagactggtaattgtggctcatgactgtaatcctagcactttgggaggcccaggtgagaggactgcttgaggccaggaattcaagaccagcctggacaacatagtgagatcccacctctacaaaaaaatttaaaaaattagccgggcatggtggcacacgcctgtagtcccagctacagaagaggttgaggcgagaggataacttgagtccaagagttcgtagctgcagtgagctatgatcatgccattgccctccagcctgagtgacagagcaagactctatctctaatgcaaatgaaagccacaatgagataccatctcacaccagttagaatggcgatcattaaaaagtcaggaaacaaccgatgctggagaggatgtggaaaaataggaatgcttttacactgttggtgggagtgtaaatcagttcaaccattgtggaagacagtgtggtgattcctcaaggatctaaaaccagaaataccatttgacacagccatcccattactgggtatatacccaaaggattataaatcattctactggtcgggggcggtggttcacgcctgtaattccagcactttgggagggcgaggtgggcggatcacgaggtcagaagatcaagaccagcctggttaacatggtgaaaccccgtctctactaaaaatacaaaaagtgagccaggtgtggtggctggcacctgtagtcccagctactctggaggctgaggcaggagaatagcatgaacacaggaggcagagctcgcagtgagctgagatcgcgccactgcactccatccagcctgggtgacagagcaagactctgtctcaaaaataaataaataaataaataaataaataaataaataaataattctactataaagacacatgaacacatacgtttactgcagcactattcacaatagcaaagacttggaaccaacccaaatgcccatcaatgatagactggataaagaaaatgtggcacgtatacaccatggaatactatgcagctataaaaaaggatgagttcatgtcctttgcagggacatggatgaagctggaaaccatcattctcagcaaactaacacaggaacagaaaatcaaacaccgcttgttcacactcataagtgggagctgaacaatgagaacacgtggacacagggaggggaacatcatacattggggcctattgggggttggggggttaggggagggagagcattaggagaaatacctaatgtagatgacgggttgatgggtgtatcaaaccaccatggcacgtgtatatatctatgtaacaaacctgcaccttccacatgtatcccagaacttaaagtataataataattttaaaaagactctatctgtaaagaaaaaaaagaaagaaaaagaaaaaggtaaccttgtctgaaaatcttatttatttgtatgagattttcatactatactcaaatattcatccaaacatttgatttaaaaaaaccctctttctcagttttcagttacgtttaaacaagttaggcaaagttactaaatcatgatacaatgaagatcgtattacattttaaaattgctaaaatataaaaaagaacactatatatcttatttttgttacaaactcataatagatcaaactctataatatttagatttgtgacttctttgcatttaagtttgcaaaattccataaaaatacatcccacaattttgtttctagtcttatttcactgaaacaaatttaaacgatttttatgtagattagcaaaataaatgcgatttttatttcagctggaagttgggattattttttgtgagctggaagaagtgataatttactaatcactatactaaggggtcacttttgcaaagaaaatatttcttttacaccccattttaaaaatattattgttttgttgtatatgtaagttttctttggttattatatgtctactcatcttaacagtttttgctttacttatgaataagaatgataaagatcactgtatgcgtaacagctgaactgttgctcattttcctattgaatataacacgaaggaagagtttctaaagcattggaggaagcaggaaggagttgttctaacaaagtgatcatattcacaacgaggaactgttaaaactactgccaaagttcctaactgacatgaaaatctgatggagtcctgggggtagtaattttccctgtgagctctcttcaagaagtccctaaggaaagaatattgcaaaatcagaagttgaagagaaacatacagaaatattcaggttgtgtcttccatgcagaacatatcaaatagctaagagtctgcttaataaaagagaatcagaacaggtagattggaagaaaatctaacaaaagtcgatttgactttttgtttgtttgtttgtttgttttgagacggagtcttgctctgttgcccaggctggagtgcactggcacaatctcagctcactgcaatctccgcctcccgggttcacgccattctcctgcctcagcctcacgagtagctgggactacaggcacctgccaccacacccggctaatattttatatttttagtagagtcggggtttcaccgtgttagccaggatggtctcaatctcctgacctccgcctgcctcggcctcccaaagtgaagccccttggcactgcgcccgaccatttgactttttaaagtgttttaatttaacaacaatgtgtagctggctatatattggtaagggaaattagtgaagtcaaatttgtagttgaggagatcttttcttctgcatttccgcacattgctgtgtaaacatgagtgcaggtgaccgctggtaattctctattggaaacttggtgtcttcattctccatcctccacgtggctccgaagccctgctctgcctcaggtccctgtgtgtccaggccctctatggtcatattctctcacctacacttgggccaatgacatgaacagaattttgacagtttcacaaagcactttcaccttgtgggtgggttcagtttatttccttacaggaggatattaatattgcaggttctaaggcgagaggagctttgtgataagttaagaaataaggaatgaagagaggcaggggaaaagacttctgtgtgaaaatagaagaggcccattttaagcacataattttccttatttcaaagggaatacgcaggcaggttactgtagcagagtcacaaacaagccaatgtgacttaaaagtatgagtcatggggaaatggagtgacacgagatcagctccagggatcacgccttcactttgcctgccttggggactcagagatctgcttgcgggtttcctgactcctacgtgaggtgtcagtgaaagcagcagtgatgttaactttgaggaaatttggttattgtgacaggatagataaatgaaccgtatcggggtttcttcattttcgtaactgtggtgctaatgaggtattcagtatctgtggttgactgatttattccccaccagaaaagatgcttgggctgcagatttcacatttagaaaaaaacatgatcctttggaaaagttgccaccaattactcagtctccagtttcagtccatccacggaatgatctgtctatacctctgtaatgtactgcggccccagtcagccacttggcagctttgcaatcccatgacctttttaaatcctgaaaataaataaaattgtaacattcttgccttgttagctcttaaattttcaaatttctatgtgccaagttgttctgcttaataaatcaccaaggaggtattgtcatgatggattcgtattttatttttattttcagtattgtatgcagtttacttaaaaaagatttgtgaaaaaaagagatagcacttttagctattgctaaatgagatcaggaaattgtcttccaaataggcaagcacaaagctgaaaaaaaatgaacaaaatcatccatttccatactgtagaaattgagcaaaggcttaacacaaatttgagaggcacggatgcttaaaaactgtcgaacttctgggaaaaacgtgggaactatgtcactctggcctgggctgcccaccttgtccagggtgggacgaactgtagagggttttctgctgctggaagggcctctgtggctttggggagacggcagcgccagggcccgcggggcggcaggagggactgggaggcccacagcggtcccgtgggaaagctctgtagggacgggcaggagtgaacatgttgtgttttgtgggctacaaacaggctctatttcctctctgcctcctcctcctgctttttcttccacttttttttaacatttgtttttaaatggaaagtagtttttagctcacaggtcatacaaaagctggcaaacggctggcttcgaaccgtcctggcttcgaaccgtggctgccatgtgcctcccgctgctctactcgcctgaggttgaccctggtaagcggttgccgcctgcagacacggcgcatgcgagggagggtgcaggccgagactccgccccgaagggcgcggcgtgcccgagagatgcgagcgttgaggaaacggaaatccagcgcacacgtgaaaacgccccggactgcggctgcgccgcttacccgcacacagacggttggcagaggaagaaagccttgtcacactaaaggagagacagcggatgttctgaacagtcctgtcgtgaaacgttagacaacgtggacgaaacaggcacattcctaagcatcacacattactgaaactcagtcaagaagaaatagaaaatctgaatacatccatggcaagcacagaaactgaactaggggattcgaaatcttcccacaaagaaaagcctaggcccaactggcctctatggtaagttctatcaaatagtcacagaagaaatcatggcagttcatcacttactgttgatgtttcagaagatagtggactaaggaacaatcccaaatcattttacaaggctagtagtaccctgatagcaaagccaaagatatcacaagaggaaaaacatcacagaccagtatctctcattaacatggttgcaaaattccttaacaaagtattaaaaaagtgaatccagcaaaatataaaaatgattatatactatgacccgatggggtttatccaagaatgctgggttcatttgacatccaaaaaccaatttaatgtaatataccaatcacattcaatttataaaggactaaaatactccgtgattatctcaacagatgtaggaaaataattggacggcatgtaagacctatttatgatttaaaaaaaaaatcttaaaaaactggaaatagaacaaacgctttttaaactgacaaaaagaatttaggaaaacactacaggtaacatcatatctaatggcaaaagactgaaaatccccccttaagaacagtagaaagatgtctacttttattatttgtattcacaattatactggattttctagccattccaagaaaacaaccaaccaatcaatcaatcaactaattaaatgtatccaaagtggaaataaaggagtaaaactgtctttatttaaaaagaaaatgattctatatggagagaatcccaaaaaatccattaaaaaaatctagaactcatcaatgagtttaggaaggccttgggatacaagatcaatatataaaaatcaattgcatttttatatactagaaatacaaaaacacaaaaattaaatgaagaaaatttcattcacacatatgaaaatgtaaactttttggaaattaacaaaagaagatgacatctattgaaaactacaaaatgttgctgagagaaattaaatatgtacataaatagacatttcatattgatggattagaagactcaagatggaaattctctccaaattagtttagaaattcaacacaattcaaaagcccagcaggcttttttttgcaaaaattcataagctgatgctaaaacttatctgcatattccgacaacctgttaaaaacaaaatactgttaaaaacaaagaactacttgatttcaaaaattttgttaaagccacagtaatcaagacaacgtggtgctggcacaagcttagacgcatgcacatcaatggaaaataattgagtccagaaacaaattcctgcctttatggaaaatttacttttcacaaatgttctaaaacaactcaatggggaaactatagggctttcaataaaagcctgcccacacacacacacacacaacaacgtctacccctaacccaccaaacctgtgactatgttaccttaaacatggcaaaggagagtttgcagtgtgattaacggtatagatctagagatgggggggatcatcctggattatctgggggcagaggggccagtctagtgacttgagtcctcaagagaggaagggaaaggcagaagggtgggttaaaaagactcactatgagaagtacttcatccttcatttctagctttgaagatgcaagtggggaccatgagccaagcagtgtgacaggctctaagaagctgggaatgtctgtcagctgacagtcaataagaatttgaggaccttcttcttgcacccacagtaaattcatttctgccaacaaactgaatgagattgtcccctagagcctccagaaaggaacacagcttactgtcatgtttattttagtttggtgaaacccaacccagactttccatctatggacctataattaaaatagtttgggggcattcttagtccacaaatttagtccaaatttaataacaaatttgtgttactttaagcccctgagtttatgattaattcattaagatagcaatagaaatctaatacacaatgggatgaaaaagaaattaaagaattataaaaggatttatgtgaaccatgttaaggaagattatttaaaactaggaaaaaaggcaaaaaaagatgagtagtatgtcctttcaatgtcatattggaacactttatcaatttcaaacaaggattatttaatttcctataataatgcatttttacgttttgctaattggatttgattgacagctcaagttttaggaagtaacatgttaacttgacaggtttcatttcagtagaaaagatatttccaaaagttatggtttcattgccctgtagggtattagccagttttgtactaacctagcaaccctatgacaaaggtctatttttaaaatacctgtaaagactgtgtacttcacagactcttggaaatgctttatattctacctagtttgctcactcttgagctaacaagtctttggtgtatattaattttatgaatcatacttttaacttttttaaagcattatagctggacaaccataatgtattacttttaagaattctggataattttgagacatgccaaattagacccatcagtaaaaaacaagatttaataaatagaaaaataatgaatgaccatatgaataaatagatacagaataaacaaatggtacataaaggttgacaagaaaaagccttgatgattctggaatgttacataataatataggaatcaacttaggctgtcattttcaatatcttcattgctatcaatttatgagggattttgttagcattaatgtgatatacaatggaaatttgaggaaaaaaatgacattgttttaggtgaaaatggaaaatttaacaggaatataaggaaaaaaaatactcctgggaaacagtatttcccatacttaaagcaagaagacattctggtgaccaataggctcacatgctagttttgagagaatttgtgtggaaattgatcagtaaattttttctaaatgtcctagagactttaggtgatactttggatgatgacaggatttttaaattataatatttctgtagctacttctctttttaaagaaaaagatagcaatttttttctatctcctgggtagaattttgtagtttaacacatctctatagccaagagttcatttttttccctcagatcagatccttatgcctgtatctctagctctgatagaacttatgtttcattttaattatatattattacattgtccctcaaatgatggacaatgcattttcctgttaaattttaaaattgccttaattatgtagttgagggccaaggtactttacatacatcacaattataccagagagaaccatgatgcaatagagtgcaattgtgagagctagagtattgcctcattctgctactaaatttaaaatagtctgggggcactcagtccaaaaatttggctcccgtttcccactgttcctaactcagtttcttgtctcattttgtattctctgaccaaagttattcaggctaaatcagtattaggaaacaaagattagcaagtgaattgtacttttaattattcaatatgcttgtctgtaaaataaagctgaacaatggccgacttcaattcgtggttttaaaataagtggctaaggaaaagccaaactgctatgtggatttttttttcctctacccaagtttgtatcaatcccaggcactatcgtagctaccaatctggcacacgtgacacactttggggctgagatcagcattttacataaattttcaacccagccatccaacttgaaagacagaaacttccatctccagagtggttttatcacccatgaggaaagctggccccagagaagttaggccccttgggtctatggtcacacaagctgacattcagacccagttctgcctgaacccgccggctctgtccttcccattaaaatgagggaattgggaaacctgagttctggagctgctttgtgacttagagtcaatcatgttacctctctagatctttgtttctccaacaataagagaatatgacaaggctaagtcaggttgaacatctcttccaaacttaaacgcagatatgacacatagtgcagtgtttactatataaccatgttgtgcttatcctttgaggaaaaataatagaaattctagggccaaacttttcaactttttggcctgggtgacttgttttcctccttaaaaaatccatatcacagagccacctgcttccacagttaccatattaaaatcatcctaggattttaccactgatcttcatacatgtgtatttggactgagtcacattttgttgtaaaaataaatgatgtcagataaaacattgtgtttaaaataagtggtattaataatctctttaaaatgcatgcccatgaaacattaagttgtctgaaagaaatataatctgctttcaatatattttctcatttaagttgagcgttcatgtgttcaattcaccctaaatacaaaataattcttactttcctaagaatttttcatgaaagcatgttaggtaactggtaatgccaaaatgaaactaaggcactaagtaatagattatgataaaaagaaagaattcatgctgagggaaaaaaagaaaaagatgagattggacttaaaataagttacatggacccatttggagctgagtctaacaaaatatgatttatgtgcaaagcattttttgttacataatttatgaagcaaaaacgtggaacatagcatatggtgagttgatttggaagaggggatttaagcataatcattcagcctggggtttatgccgtgtttgaatatctgtcatacctctgcctggctcccatccccacatgtgacctcctgcatggtgagacttacatcacatcccacacactttctggactgttttgattattcactgttaaccttaaaaagtatggcttcctgttaggcacttttatttcatacaacataagttgtatgcagtgtgcttcaaataagtaaacaaccggcaggtcagaatagcttttatttatttgttttgtaaatcccagctttctctgggtcctcataaagaggagtaatagagaaatagtttctggccactctgctttattatttcagacatgcatggcctcctatataatttgcttattgatttcaataataaagaccaggaaattacatcctctcttgtctgtggagctatgaatcacagattgcttaaccactgtcaaattaaacaacttgcctgtgactgagaaaggattcatataaagactaaaatgatcatcagcctcccactaatccagtgtgtcccccatgttaaatgaagtcagcatcactctgggcagctgtgctgcctcctttgaggaaatcagcctccttctcaatcatttgtactgccacacagtttgaatcccggattctggaagattatgccagatacctttctctcctgggagataactgctcaaaaacaaagacacaattaaaataaaaattagacatgagcacagtggctcatgcctataatcccagtgctttgggagacggagtcaggagaatcgcttgaggccaagagtgtgagacaagcctgggcaacatagaggatcccaatctgtacaaaataaaaaaattaaaagaattagctaggcgtggaggctcatgtttgtagtcccagctacctgggaggctgaagcaggaggatcacttgagtccaaaagcttgaggcagtgagctatattcatgccactgcactctagtttgggccacagagtgagattctgtttctacaataagaataaaaataaaaataaaataataataataaaaataaaatcaaacaaaacattgaaagaactctggtttctgattatctaaaagctcccaactgataccggaaatactgttttctaatgctaacatttgaatacccaaggtctctcatagatttattgcatcaaatctctgggttaaatttagaatgaggttgatcttcaggagcagattctcattctaaatcacacaattgtatctagaggctgagtgtttaaagggacaagaccaacagtgggctctgggtgcccagccgagcaacctctagaagtgttttgctttttcagaaagcaatgaaggggcttaaaatcatttgtgaaaatgatttaaatgatttaagggttgaaagcaaaaaacaaacaaacaaacaaaaaaacctcatctgggcccagtattctcattataggtagaataatgatagaaattgcaatgcacaattttactgcaaattttgcttgaaagcagacaaatcatcttggaaaagtagatttgactccctgcactttagtttccttatctaagcctgagggtttgatgatgtcttcgatgtttttaggagttctaactgtatatattttaatgccaaaataatctttgtggccaatcttaattctacaatttgaaaatagttttaagttaaagattttaatgcgcttggataacctgcaaatttacatttaaacctgtttatgtaattattcactcacatttaaatgtggtaacttctgcccatgtgatcttaaattaaaacattctttgaagctagatgaatacttagcatgttaataacatctgatgagacccagatgaaagctggtatgaagtacttcttggtcaagaagttctctctctttgttaatgtaaattttataagtttccattacccaatgaacaaggtatataaattggatgagttcttcttttttgaattatcgtcaggttatacaaagaggaaaggtggaacattaaaaagaatgaaaattcaaaggacttgaatcattggtctgttagtaaatttgcaattttataaaccgcaatgatttataaactattcaaaacattaatatttacaagcaaaattatgcaaagcatacacaacttttgctgtcttgattagactgcatcttttgtctccaggtaaaaataacttttaaagttattttcaaaaaatatttattttttgatgcttaatttttagttgcctagtgaaatgattgctattcatatctaaaaggaaaacgaacctcaggtggtatgtcacagtgagatgtcattaagttattattaaaaatggcttatatgcaatttaaagccagcttccacgaatgactcttgtggtgaacaagaaaccaatatagattatttgtagaaataaatattccttgattcctagactcctataaaaccacctgaataatattgtgcactgactgtggaaggattttgataaaatgtacgtttttcatgtcagaatgaatgaattatgtgcatgatataaagcaatagctcccaaatttcccacaaaggacatcttttgttatcactgttttttttttttcatcagtatcagtggtttaaaagatatttttctattaccacgagatagccagcagtaccatattggctttctacaaggcatttttaggttgtgaggtgcttctgaggctaaagatatattacatttggctttttgaaatagtgaaatataaatctctaatagtctgagaagttgaaattgggaattactagtgtaaagaaaataacttataaacaaggcccttgattcaagtcttttccatgactttggttaactttatctattaaaaaaaaaactaggcaatttttaagtttcccttttaatgctaacatttcatattgtgttttcagcatcccacttgatgaaaattcctgttataataaattagccccttgaggttcctggaaaagcatgaagacttgatatcacctccttcctcccactctccatgtatacaaacactccaattgatactttctcttatattattatttaaactattttctttctgactctgcgttctatcttctgtcttgactttattcacccaagatgaccaaaaagacaaagatttgagctatgaggtaggtgtatgatacataggggaaaaacacatacatatataggttatatgaatatatgtatatctccatatatatatgttatatacccataaaatatgtaccaaattgctccttcaagctatatattagaccataaacacaattaaagtataaaacaaaatgaaaatataataaaggtttttaatatcaatgactggtataaaggcattcataaatagcattttaaagaaaaatacatttaaaataattaaaatataaaataaaaaagtattttgaaacattatctttaatgtttatagcctaaaatatattttttaaataaataaagtacctacattaaaaggtctaagttttttttaacaaaataaacacaggtctaaagaaaaaaggaaaacataaatgtataaaagagaatgtagcaaaataggaaataacaaagaggatcagtaaatataaaagttatttaccttccccccccaaaaaaatgaataaaatatacaagtctttaagccaacttttacagggaggtgctgtggtttgagtatatgtgtcctcccaaaattcatctgttaaaacttaatccccaatgtgataatatcaagagctgtggcctttgggaggtaattacgtcatgagggctccatgtttatgaatggaataacacttttaataagtatccttacttattaaagaaacttaagaggaactctttgcccttctaccatgtaaagatacagcaagaaggtgccatctatgaaggagaagacaagccctcaccagacaccaaatctgctgatgctttgatcttggacttcccagcctccagaactgtgagcaagaaatttctatttctatttcacccagtccaaggtattttgtaatagtagcctgagcaaactaagacaggaagaaaaaaagtatatatagctgtatcagaaattaaaaggggacataactacggtagaatatatacttatatatatatttatatatattttgacaatatatcaaaaatttaagttaatgcatttgaagaagataaaattaatacctttctgaaaatataattttaaagtattccttaaattacaaaatttaaatacaattatagaaattgaatcagtaatttaaattgccacaccccaagttaccacagatgtaattttgcagatgcattttagaaaactttaagataaaaacttttcattttcccttttttatttcaaagaatagaaaaatgttcctcttccattcgtggctaagcaaattcttattgaaccaacccttccacagatagcaactctaaacaaaatgttgaaaaagcaactacctgcaggcactggagagtgaaaataatgtgggagacactggagggaagttatgaataagataacagtagggtgtgactctccacttgttaactgcttttagaatgagagcagtctgcaggtgttgccacacaaagcaactaaaattcatatggaaacccatggacttactgacttgaaaggccaggggcaaagactcgggcaactgcagctgttggtaagtgaaggagcatattacaaagaagaaaggacaatcacagggaaacaattttgcataaaaagcagtctgaatctctagacttcaaaaggccaactaaggttttacccacacaggggagatagaatcagaagttcaagttcagctactgcttaacattttttcaataagaatgaaaatccttcagagtaacataatttagaatttagagtctctacaatgtatcacagtgttcaacaatcttatattacttggtatacaacagaacagaaaataataaacgttctcaagaagaaagaatgtcagagactaaccctgagaccatccagataaagattttgaagtagccattataactgtgcgcaaggatagcaaggaatagattgttaaaacaaatataagatagaaaatctcagcagagaagttaaaactattacaaatgaaaattagaaaactaaaatatatctgaaataaaaattttgctggatgagtttatcagcaaaatagagaagacagaagaattagtgaacttgatgactcctcaatataaaatatccaacctgaataagaaggaagacgattcagaaaaataaataatagaacctcagagaactgtgggacaatatcaaaatgtcaagtgtgtgtgtgtgtgtctctcagaggagaaaaaagagacaataaagcagaaaaaaattttgaagaaataatgtctgaaattacacaattgtgatggaagacataatttacagattcaagaaactcagtgaaccctaacaggataaagttatacatatgtacatactcatgcacacacacagaggccttaatacatcatagacagactactaaaaaccaaagataaagagaacatctagaaaaaagacagaggaaaatgataaattccatataagtgaataatgatttgaataacctcaggcttctcatcagaaatagtgagagccagaaaaaaaaaaaaaacaacttttttaaaatactagaagaaaaaaaatgtcaaccaagaattctatattcaatgaaaatatcctttaagaatgtagataaaatgaagacattttcagaaaaatgaaataaactaatctctactataagaaatgctagagggagttcttcaggctaagataaaactataaagaaacatgaatctactggaagaaataagatgtattgcatttacatgtgttacaatccctgtaatattttaaaattagtattatagggattatagcacatgcaaatacagtacatatgacaactagagaatcaaaactgagggtgtggtgaagtgatcatgcacttgcaggatttgtacactgtatacaaagtggtttagtattaactgtgtaaactatgaggaggtaaagattcattgtaattataggaacaaccactaaaaaagaaaatagctacaaaaataaaaaaattaagtaaaagaaaataaaattcctaaaaaatttatatattccaaaagaatgccaaaaaggagaaagagaagtacaaaaacaaagagacaaatgcaactcataataggaaaatgatagatataaatccaactatatcaagaattacattagatcatcaatcactccaattataaggcagaaatttttgtaagaaataaaaaagcaagattcaactatatgctatctacaagagaaacatattaaaaataaagaaatagaaaggttttggttgacagtaagtatacctaccatgcaaatagtacacataagaaggttggagtgtttatggtaaaatcatatagatttcaagataaggaatattaacagataaaaatgatgaaagttttgtcaggaagacaaaacaatcattaaagtatatttatcaaaggatagaagagaatgaaaaactactcatatccttaaaaagattataaactatactgaaactagtcaattttaagataagaaataagatgacaatctcacatagtatatatacaaaaattttcaataagctatcagcaaattaaaattgtcattataataaaaaattatagcaagaagtgttcatctcagaaatataaagataatacatcacaaaacataatacaacacatttacatattctttttttttttttttttggggacagagtctccctctgtcgcccaggttggagtgtagtggcgtgatctcggctcactgcaagtttcgcctcccaggttcacgccattctcctgcctcagcctcctgagtagctgggactacaggcacctgccaccacgccccactaattttttgtatttttagtagagacgaggtttcaccatgttagccagcaaggtctcaatctaaacaaaatagtatgtttataatggcaaaattaattttaaaaatttaatactgactcatcaagaaaaataacaacaaaagaggccattttcaaagcaggaagagaaaggattttttttccccgagtaagagtttctagtaaaaactttaacatacatcagacttaatggtgacaggttagaaaaagtattcccattaaacatatgaataagaaccaagatgtctgcaatgttccattatgttagacattacattggaggtatgtgtaaagataaagattttatgaggagatattccaaagacagatttgtgattctttggatgtggcactgttgaaggtgaatctaaaagcttttatggagcaatgtcaaatttgtgagccacacggagatggagatgagattataatacacttttatatgtactatcatagatgtaaaactctctatcttaatattaactttgaaaatgttaaattgagaatcctgttaacttacattttatgaattggcatattgtattactgcaagatatatttgattttcagcataatgccaaaacaaaagattttttaaaaaactataaaaatgcatatatttttctaaatttattttgtcttaaagcacactttaaatgtcatttctcattgagcaaaattgtcaaatttctatggaaaattttaagataaaaagaaataggcaaagaattggaaagagacaaaattgacaatatttatatccaatttaatattctaagtatataatccaagaaaccatacagataagttactaaaacttgtaagaagatttgatatagttgccagattactatataattgaataattatatagaaaataagtagcattctaagtgcctttaataatttaagaaggacttctgcttatagccacaacaaaatagccagaactggattaactgtcccagctaaaatcactaaaaaataatcaaaatatatgtttttaaacacagtttcagactttggacaacatgtagcccaggacagtgatccctgagaaaaggaagacaaatgaggtgacactgtgatagacccagatcaacgcctggaaaaagtttcaaagctacaatgtgaggagtggggacaaaacagtctagtggctttgctgagtggagaaggcaagtactggagtccaggcaaagtattggtgaaggtggagccctggagaaaaagaactctagagatctgtaagaggctctccttgaaacttctactgagcacagttctgcacatgcatgtatagaatttactcaagatgaagaaagaaccaacgaaaaaaagcatagtataatgctgagaactcataaaatcgagtaggaaatcttgcctattgaaagagcattgagacagagtcctcagaaggaattttctcagtggtgggaacaaattagctataaacccaagtttgctctgatattgctataacaaagcttaaaagcaactctcaaaaggctcaaactgagtacaaaacatctaattgtaacccagggtacttcccaacagtattcaagggaataaaatattttgtgtatattttgtattacaggaatatattgtattcctttatatagcatattgtatttctttatatatgaaatgatatatcatcctaatttagagcatgaagttacagatgtatattataaactctagaacaaccactaacactattttagaaagctataaatgataagcaaatagagataaaatagaatgataaaatataatcaatccagaatatgggaagaaaaagaaaaagggagcaaaaaaaaatgaaaaaaatgaaacaaattgcaagatgacagatttaaacctaatcatattataaccacattatatataaataggctatatactccaattacaaaacaaagattgttgaataaaaaagtaagacccaactacatactttcagcaagaaacccacttcagatataaagacataaattcagtaaaactcataagtcaatgtcataaatacatatatataatatgctcgcactaattaaaagaaagctggaatgactgcattaatatcagaaaatgtagatttcagagcaaagaatagtaccagggataaagaggctgaattcacatattataggggtaaaatatttgagagaacataagattagtctatgtgtatatctgatagcccagcttcaatatatatgaaagaaaaattagtggaactgagtggctagatatacatatctacaattgtatttgcaaagttcaacaacttattcttaatcattaatagatcaagtagagaaagtaaggatttacaagaattgaaaacatcaccaaccatcttgacatttatcgagcaactccacccaacaagagcaggaggtatattcttttcaatttcccatggaacattgaataagatagatcataaaacaggtctcagtaaatgcaaaaacattaaaaccacacaaaagaacggtccatgtccacaaatgaattaaattagaaatcaatagcagaatattttaaatattcatccatattttcaaaccaaacaatatacttctaaataactcatgggtcataaaagaaatgacgaggcaagtcagaaagtattttgaactgagtggtaatgaagcactacacatcaaaatctgagggacagagataggtaatgtttagagaaaaaatcataaaattaaatgctcatattagaataaaaagtttgtcaaatcaatcattttgaagcctgcatcttaagaaatgttcagtcttcaagatggtggaatagaacctttcagcagttgtcatcaatgtgaacaactatccacacttgaagacacctttgcaagcattaaggaatccaggtgagagactatgacacctgagtgtagtatggaactaagaaatgcactgaagagagtggaaggacagtttcacatgacccatgtcacccttttccatgcccaggcagcacagcacagagatgccctctgggtgggaaagtagagtgatgtcaccacctgactttgtgtggagcccagcaccaggtacaccccagagaaacccagtgctgggctgattccagcagccccaggatccagattagcctctgtagatataggctgcaggcttgcccggcatcaagctggcccctgttgccccagactctcggctggttgcaatggccacatgttcccagctgacccagtccccaggcccatgtcagtgccagagacctagccactgcggacctagccttcaggccagcatccacagatgcagtctcttggccaggctccatgtacccaggctctatgctagccccatagtctcatgtactaggccagcactcatggacacaggcttgagactggcccctgcagacccaggttcccaggcctgtcccaggaccaagacagcccaagctccatgtcagtccccacatccacaggcttcagtggacccaaggtccagtcttgctccagtagattcagagtgcaggctcacctcaaagtcagcagaaggaaggaaataataaatatcagagcagaaataaatgaaatagatagtttaaaaatcagtgtaaatatcaatgaaactaagagatggttttttgaaaagataactaaaattggcaagtccttagctaaagaaagagaaaagactcaaacaactaaaataagaaatgaaagaggaagtattacaactgacaccacagaaatacaaaggattataagagaatacattagccattagccatataacagcctgagccattatacattgccaacaaattggataacacaaaagaaatggataaattcctagaatcatacaacccaccaaggatgattcatgaagaaatagaaaatctaaatagagcaataatgagtaaagagattgaatcagtgatcaaaatatctctcaacaacaacaacaaaaagctcaggtcctgattacttcactggtaaattctagcaaacatttaaggaagaattaatatcaattcttctcaaactctcccaaaaacttgaggggaaagaaatgctatcaaattcaatttacaaaatcagcgttattctaatataaaagccagacagggacactgcaggaaaagaaaattacagaccaatatccctgatgaacatagatgcaaaaatccttaagaaatactagaaatccaaattcagcagcacattacaaagaccattcatttaggtgagatttacccttggatgcaaagatggatcaccatatacaatcaataaatgtgatatactgcattaaccatatgaaagataaaaatcatatggtcatcttaatatatgcagaaaaatcttttgaaaaacatcagcatcttttcatcataaaaactcttaacaaattaggtatagaaagattatacttcaacattatagagatcatgtatgacaagcccacagctaacatactcaatggtgaaaaaggtgaaaaactaaaaatttttcccccaagatagggaacagaacaagggtacatactctcactacatctattcagtatagtacaggaagtcctagccagagtaattaggcaagaaaaagaaataaaaggcatctaaattgaaaagcaagaattataactgtctgtttctgcagatgacattttttatatagagaaaatccctgaagactccccccaaaaactgttagaactaataaacaaattcagtaaagttgcaggatataaaatggacataaaaaatcagtagtaatttatatactaataacaaactatctgaaaaagaaattttaaaaaagatctcatttacaatagcatcaaaaagaataaaatacttaggcatacatttaaccaaggaggtgaaagatctgtatgctgaaaactataaaactttgattcaagaggctgaagaaaacacagataaatgggaagatatcccatttttatggattcgaattgatagtgttaaaatgtccataccaactaaagcaatctacatattcaatgcaacccctatcaaaattccagtggcattttcctcagaaatagaaaaaaaattctaaaatttgtgtgaaaccacaaaaaaaagtcaaagcaacatggaccaagaagaacaaagctggaggcatcacaatacctgatttcaaaagatactacaaagctatagtaactcaaacatcatggtactggataaaaacagacatgtagaacaatgaaacaaaatatagagtccagaaataaatccatgcattttggtcaattaatcttcaacaaagatgccaaaagcatgcaataggaaaaggacagtctctttgatgaatggtgatgggaaaccggatatcatatgcagaagaataaaattggactcatcttacaccatatacaaaatcaactcacaatagattaaaccttaaacttaagacctgaatctttaaatttattagaagaaacaataggaaaaaagcttcttgacatagaactggccaaagatttttttgatatgacctcaaaacacaggcaataaaagcaaacctaaacaaatgggattacatcatactgaagagcttcagcacagctagggcaacagtcaacagagtgaagagacagcctatagaacaggagacaatatttgcaaacatacatctgataaaggattaatatccaaaacatacaaggaactcaaataactcaatagcaagaaaacaaatcactggattaaaaaaaaaatgaacaaaatatttgaactgacatttctcaaaaaaagacaaagggccaataacaatgtgaaaaaaatgcttattatcactaatcatcaggcaaatgcaaattaaaatcacaatgagataataacagcttatatttgtattctgtatatataggccaaacattgtttcaaaagctttatgtaaattaagccatgtaatccctacaacattccaatgaggtaagtgatattactaccattttatagagaagttaaataatttgctgaaattcaaacagcaaatcagttgacagtcaggattttattctaggaagattggtagtcatttcacaaaagagaaaacagaaatggccagtaaacttaaatatatactgtctcaaaaataatatgagaaatacaaaaagtgctgttacaccatgtgctagcaatgatactaagaaatgaaaatgcttacacatggctggtgtgaaaatacattaagatgacaagaaacatagcaaaatgcaataaatttgaacatgatatattttcatccaagcaattttactccaagaagacaagaataaaaacatattgtagcgtttttaacttgtaacaaaatactgcaaataatctaagcaccctggactggacaagtaaatggacaaaaaaaaaaaaacaaaaaaaacaaaactcatggcatattcataaaatggagtaatgtgctaatagagataatatatgaacttgcagtacctgtaccatttcagatatgctcaacaatatactcaagttaaaaacacataaggttgcagaatgatgctaattttgtaaaactaggaaatctcaaagcttattctactgattgattctgaaacaggaagtaaaagtataagaaacattcgtgagaataacagacatcaaaccaaggaatgtggctccctctgaacagggcagatgggaatctctattagagaaaagtcacagtacacttcttcttcatgcactaatgggttgggatttgaggttttaagataataggacttgattctacttgaaggatgaaaattttcttccaataagatgactttaccctatttcttgtgaagtgatctttcttgatctgctttgtattttaaaccaggctcacacccctttattaactgaagctgacttaacccgaactatctgaagctgactcaacccgaactatccgagatcacacgtaaatgttttccttctgatctcaacttttctccttatcgtggggcatggaaaggaggagatcgcagcagggaagtttttgttcttgttcacatgctaacaatggtaagcttcttaaaagtgaatcacagtagcatcacagagtttggacaggtgatgtaactaggagctacgaaaattgagtgccataaaagaatcatctttaaatactgaagtgcttctgtatgcttgaattatacagcatttcctgtttcaaagcagtttcacacaatctcatttaacacttttaaagtcatagtagttgaaccgagtatatcgcacccctgttacggctttttcttgattataggacaaaatgaaaagaacttttatgatctggctccaattatactttcaaggttcaagtcttcccatccggtaagatttttcttctttacaaaatgccccaactgaggcactcatgtactaggcacaggagactacctgtttgaaatatcccttgcttctgctggaaatgctgttcccacactgaactcatgtgccaactctcagctcaaaagtgcatgtttgtctctaccagtggactaaggaccagctcctaggatgggagcagtttcttactcatgtttataaagtgctatgcagaaaatagcagggctatgggaaagaaagagaccaggttagaaaagtcatttgaatcggatctgcatgaaaaaaggcactttagataagacctgatagcaaagggctgtaagaggagaaaagggcaaatcaaaggtaccgacagaacatattaagcatggcctaggctgagcaaagccaaatttaaacataattttgtatgttgaagcacattattttccaatatgttaatgtgtagccattctcacatacataataaagctaatggattatttattcaattgtatgttttgttataggagcctctgtcattaaaaagaaaatttattttcgtatctgggaaaagttgccaaggcaaaaaacacacacctggccatgcatctttagtttgttattgtttttaggtttatttgaaacttacaaagtgaaaaaaatcaatgacttctcagaaaaaggaaaaaaatagatgtaggtggaagagaaagaatacataggattataataggtttggcgaggatctcatgttgctgaagaaaacgagtcttgggattctttgtagtgggtcttcagaacaggcaaagaaatggttacgagtgaggataccagaaggagaagaaaactagaaatttgaatagaaagttgaacaaaatgaactttggataccaataaccttcagtgaatgggtgaagaagaaaaaacctttctctagttctgtttcaaaggcagtaatgaatagaatagcaaaagttaagcatgaatgaaatccatatttatctattttttgaaaggtaatgcatgtcttattttcactgcattatttccagagcataataatttcagcctaagttaactttcaatggtcagtctttgctgtccagcactgcattgctcaggagattcattaatcaatcaatcgatcaatcaatcagttccttctgtttctttcccacctggagctctgctgtcagagttgcacatgtgagtgagatgtagctcacttaggaatccatgcctgcagctaccctgggagctgactgccagtctctgctcagaggcccttgttcccacaggcatttgctctctgctgtgtaatttatagtttaagtcaaatgattccaaacacagtctctaacatttgggtaaaatctgtctagtactttcttgtgacacagaaacatagagggaaaatattgctatatttatgcaaatatagaatctttactctgaggcttttcttaaattcacagtcacccatatgccaagtggatttactgttcattactcagtgtctttactgtttgtaactcagatcacgttttccttcacaaagcctgcttactgaatatttgtgtgatgatttgaactcaattagctacttattgctaggttatattttcccctttgcagcaagcatgtcaaagattatacatttttttaacagattgcttttaattgtattagttgaagagcagtctttatatgtaaaatagtgaattatagttaagggaccaagggccattgtgtcttaagttttaattgttcaatagatcacctaatagtttttaaaatttttataggaatgtctgatcttatccacaaactttaacaaatgggcataaaaatattcctcccttaatttttctgacctgcactttttctgttttgtttttgtattttttattttgttggttactccacgtcattggttacttcatgtcaggattatttgcagcaatcttctgtccttaatatattgatgttttgggggcttctaacctaagctctattctttttccattctttaaattctccaagtaatcatacattcagttggctttgattactatgtatattaataattctggccaggcgtgttggctcacacctgtaatcccagcactttgggaggctgaggtgggtggatcacgaggtcaggagttcgagaccagcctggccaaaatggtgaaaccctgtctctactaaaaaatacaaaaattagctgggcacgatggcgggcgcctgtaatcccagctactcgggaggctgaggcaggagaatcgcttcaacccggcaggcggaggttgcagtgaaccgagatcacaccactgcactccagcctgggtgacacagcaagactccatctcaaaaaaacaataataataataataataataattccaacaccccatctctatgtccacccatttcttttctaaacttcaggctcaactgcttgttcaagctctccattgtttacctcacaggaatctcaaggtaacttgttcaacttgagtgtctctggacctcccctctctactggcttctctgcaaacgtttttcttggtgagtgcatctgctttcccagctgctcaaaccagatttctagggctctccctttgctgtttcccatccgacactccccatcctggaaatcacatagctttgtcaatttcatcactagaaacaccagcccctgcccttctgtcctaccggcatcactgtacagcatgctactctcatctcttgtagcctcattgcagtttacctccctgtttctaactgggccctgctccaatccactttccacactgtatccaagggatctttgtaaaattctaatctgattgtgccattcccttgttaataccaatcaataaattcccaaagttcttaagtaaatctaggtaagttgtttataaattccttcatgttatcatctccatttacttttttatcctcgtttctacccaaccaaaacacctttaagtgcaacagtcccacagttctaaattacattcattttttatggtatgctatttctcactttcagcatttctatttgctgttgattctgcccagaatgccgtggacagtcccctctccttgcctctcatgctcatttttaaccagcttctactcatctttatttttcatatatcgtctcagatatcacttcttctgagacacaatctttagggcctcaaagctgatctaggtgtccctcttatgtactttaatttcttgatcacatcaaatatagtactgaaatattatttttcagtgatgcttaacactggttctatttttctttttcttttttaatacttggaaaactttcactaactaacttactatcattgagtttcttgactggggtcccatactttttttaaaggtggatattagatttggaataacctcatgggtgattccaatacatctttggggcaacatctctgactatacattgagaaacactacttattgcaattcttgtttatttatttatattctacattagcctgtaagctagctctatcagggttgtgcctctatttaaaaatcttactgctgtatcccccgtacttatcaggcactttgcaagtaacaggaattcaacagatgatggagtcattgaatgaacagcttttgtcaatgaatgaaatgttcaggagcactttctttctttctttctttctttttttgacggagtcttgctctgttgctaggctggagtgcagtggcacaatcttggctcactgcaatttccacctcccaagttcaaactattctcctgcctcagcctcctgagtagttgggactacaggtgcatgccaccacacccagctaatttttgtatttttagtagagatggggtttcgccatgttggccaggatggtcttgatctcttgacctcatgatccgcctgccttggccccccaaagtgctgggattacagacgtgagccacagtgctcagctgagaaggagcactttcaagggaaggaaaataaccctagaaatgtcagatttgtgtctacataattaatttctactgttattccaggaatgtgaccaaaatttattagatctgtgcttaagaacagtaaagaacttaaaaattatcaaaagccttaaaatgtgcatacagcaattctaattctgggaatttatactggcaaaacataaaaattagcattagtatttaattaccttgagtttttataatggtaaaaattgtgaatgacctaaatgatcaataatagaggattgatttatgaacttatggtatatttatacaataaactataatttagacattaaatcatatttttaaatgttatgtgtatttttttaaaaactttaagtatattgaaggtttattacataggtaaactcacgacacaggggtttggtatacagataatttaatcgcccaggtactaagccttgtagccaatagttatttttcttaatcccctccgtcctccctcctccctctcttcaccctcaagtaggccccagtgtatgttgttcccctcttcttgtctatgtattctcatcatctagtgcccacttgtaagtgagaacatgtggcatttggttttctgtttctgtgttagtttgctagggatagtggcctccagctccatccatgtttcagcaaaggacatgattgtgctcccttttgtgattgcatagtattccatcgtgtatatgtaccactttttttattcaatctgccattgattccacgtctttgctattgtgaatagtgctgcaatgaacaaacacatccatgtatctttatggtaggataatttatattcctttgggtatatacccaataatgatattgctgggtcaaatggttgttctctttttagctctttgaggaagtgccacactgctttccgcaatggttgaactaatttacattcccaccaatggtataaaagtgttcctttttctccacaacctcaacagcatctgttattttttgacttttagcaatagccattctgactggtgtgagatggtatcacattgttgtttgaatttgtacttctctaatgatcagtgatactgagctttttttcatatgctttttggctgcatgtatgtcttcttttgaaaagtgtctgttcacgtcctttgctcacttttgatgggattgttttctttcttgtaaatttgtttaggtgtcttatagattatgaatattaggcctttaacaggtgcatactttgcaaatattttctcccatcctgcaggctgtttactctattgatagtttttctgtgcagaagatcttaagtttaattagatcccatttgtcaatttttgcttttgctgtaattgcttttggtgtcttcatcatgaaacttttgccatctcctacgaccagaatggttttgcctaggttgtctttcagagttttgacagttttgggttttacatttaagtcttcaatcatcttaagttgatttttgtacatggtataaggaaggggtccaatttcaatcttctgcatattgctagccagttatcccagcaccatttattaaatagggaatcctttccccattgcttgttttttgcagctttgtcaaagatcagatagttgtaggtgtgtggccttatttctgggttctctattctgttccattggtttatgtgtctgtttttgtactagtaccatactatttgggttactgtagctctgtagtctagtttaaagtggggtaacatgattccttttttgtaatagttttagcaggaatagtaccagttcttgtctgtacatctggtagaattcagctgtgaatccatctggtcctgggctttttttggttggtaggatatttattattgtaaaatcatattttagaagtgtatctactgatatgcatttaataatatataatagacaaaaaagattaccaaaaactacacacataatttcatttgttaaatttatattttatacatttaatatattatataagaaacagtgttcactgatatgtacaatcatattcataatttttatcaccctagcataagataattttgtatattctctttctgttttttggttttagtaattattatttttttactctgaaagtgtgtttcacaaattacaaaatgttcctaaatattaaagtatgtggaaactaaagagaagtatttgctcaaatttttactgaaatcttcttcatccatcacttcccactaacccagtgtttttctcaggaggcccacacaattgcctattatcaagaaaagatactttcaaaaaaactgaagggagcggttatatgctgtggcacagcaatttcaatataagttgtggatatttcccaaagaatagtgtcttgttcatggaaatgcactcttgcttaatcagatgatgacctgggatatggtgttaactagattaaaaaaaaggccatctgtgcctgaggctcttctggtaggaaaaacttggagcttaaattgttttcattactagaatttgcatgacagtggtttttagtaacatacaaagaaaaacatggtacttaaaaatactatcaaaatacttttcttactttaaaagaaaaaagttctacttttttttttttttttttttttttttttttgagacggagtctccctctatagcccaggctggagtgcagtggcgcgatctcggctcactgcaagctctgcctcccggattcatgccattctcctgcctcagcctcccgagtagctgggactacaggcacccgccactgcccccagctaattttttgtatttttagtagagacggtgtttcactgtgatctcgatctcctgaactcgtgatccgcccgcctcggcctcccaaagtgttgggattacaggcgtgagccactgcacccggccaaaaagtactattagatagtgttactaaatattaaaaggaacattgtaagaattcttacacatcttatagtgtgaggaaaatatcctcttattcttaattgtgttattttagacttactgcctttacattttaaacctttcctgacacttttttttattatgaatacattagtgttatgtactttaccaaaattattgctttagggtaaaaacactattgaatagtttagactaaggaattttgaaggctcattagttttgttcatataaattgcctatgaaattagggattcctgaaaggatagtggtatcttttgagtcaattgtgttgtcagaaataataataataataataataacttcacaagcccatgcttcggatcctagctctgcagccattctgtgacctcacaggcgttggaccctacagtcactgctatagaagtcacatctgcatcacagaccttagagcaatggttgctccacacaaacccacattctggaccccggttccataacagctctacatgtgccagtgcctacaacacaagagccactactgctttagaagcacccatgccctggaccatacagaaactataggtatccacatgcctttgtttcagaccctggctttccagctgttccataagcatctgttcattgcacattgagaccaacactggagccggggtgcctgcatgttaagcaccagtgccactgccaccatgaacataaccatgaaccaaacccaacaccaagagggatccccttggccatgacttcccacacgggagaacaagaaatcaggagggctcctaccaccttcaccaactcttaacccaacagccctcaccaccactgtggacatctgcagccttggccactgaggacccttgcaatcttcaacggatggaaatacacagagactatgcttttgtatcttcactggagctggaattgctgcatcccacccatcagtaccctcataccacctgtaggtgaaggactttcctcacagaaagtagcctgtaaattctggaataggtgactgccccagcaaatatgcagacatcaatgcaagacaagaaaagcagaaaacatcaagaaaacatgacactaccaaaggaaaaccataatttccagtagccagtcttccataatggagatctacaaattgtcacagaaagatttcaaaataaatgccttaagaaagctcaagctacaagcagactcaatgatatcaagaaaacaatacatgaaaaaaatggggtaaataaagagatataaataattttcaaaaacaataaaacaaattctgaagctgatgaatacaatgaatgaaatgaaaaaaatacaacagtgacaaagcagacttgatcaagcagaaaaaaaatttgcgagctcaaagacaggtaatttgaaattacccagttaaaggaagaaaaagaaaaaaagagtgaaaatgagtgcagaaagcctataggatttatgagataccatcaagcagcccaatttacacattatgataatgtaaggagaagagagagaaaaagaaataatatttaaagaaatagtggctgaaaattcctgaaatctgaggaaatatatatacatcaggatacattaagcgcaaaatttcccaaacaaatttaactcaaagaggtctccactgaggcacattataataaaatttttaagtatcaaagaaagagagattttgaaagcatcaagagaaaagagactcttcacataaaggggaaatttcattagactacagatgatttcttagcagaaacttttcaggccagaagaataggctgataaatcctaagtgctaaaataagaagagaaaaactaccaaacaagaatactttactgagccaatctgtccttaagaaatgaagaagagataaagactttcccagaccaaaaaacaaacaaacaaacaaaaaacaaatgagggagtctgttaccacaagacctgccttacaagaaagttctccatgctgaaatgaaaagactttagtaagatgaaaatataagaaaatataaaaatcattagtaaaaataaatacatagtcaaattgaaaatattcaaatactataatagtgataggtaaatcactcttaactgtggtataatggttaaaagacaaaagtattttttaaaactatagttaatttttcaataaacatacataataaaaatatgtaaactgtgagatcaagaaacataaaatatatttagggggagtggaggaaagaaagggcagagtttttgtatgtgattaaggttaacttgttattagtataaaatagactgttataaatctaatgtgttttgtgttagcctcctggtaattgcacaggaaaaacctatagtagatacagataagataaagagtaaggaatcatcagatatcactacagaaaatcaataacaaaggaagtgtacaagagaggaagaaagaagcaaaagaactacaaaagagacagacacaattgaaaaaaggcaatagtaagtccatgcctatcaatacttactttaaatataaatggattaaattattcaatcagaagacatagagtggataaaaataaacaaatgtgcacatatgcacacacccacacaaaccaaactatatgctgcctacaagagactcacctcagctttaatgacatttataggtcaaaagtgaagggatggaaatggaaatggaaaccaaaacaatggagaggttgctatacttacatcagacaatacagactataagtccaaaactgccacaagagacaaagaaggtcattatagacagacaaaagaatcaacaaatccagagtatataacaattgtaaatacatacgcacacaacattgaggcacctacatatataacataaatattaccagaactaaatggagaaatacacaacactacaacaaatagtaggtaaattcaacaccttcactttcaacaatgaacatactttccagaaacaaaattaataaacacattggatttgaactacactcagaccaactgtcctaacagacatatgcagaacactccatccaacagtaactaaatacacatttttttcaagtgcacattaaacatcctccaggacagatcatagttgaggcaaaaaaaaaaaaaaaaaaaaataggccatagcacaggtaaaaaaattgaaatcatatcaagtatttttccaaccacatgatatgaaactagaaatcaacaataagagaaaaactaaaaatttacaaatatgtgaaaattaaacaacacactcctaaacaacaaatgagtcaaagaagacatcaaaagggaaataaaaagattgtaaaacaaataaaagtaaaacataccaaaacttatgggatgcagcataagcagtacaggaagtttacagtaataaacacctatattaagaaaaaagaaacatctcaaataaataacccaactttacaccttaagaaattagaaagaacaatctatacttaaaatcagcagaagaaaagaaataataaagatcagagcagaaataaatagatacttaaaaaacaatgtaaaggatcatggctaggcacactgactcatgcctgtaatcccagcactttgggaggctgaggtgggtggaggtcaggagttcgtgactaacctgactaacatggagaaacccaatttctactaaaaatacaaaattagccaggcgtgtggtgcatgcctgtaatcccagctacttgggaggttgaggtaggagaatcacttgaacctggaaggcagaggttgtgttgagccgagtttgcaccattgcactccagcttgggcaacaagagagaaactctgctcaaaaaaagaaaaaaaagtgtaaaggattaagaaaactaatacatgttttttgaaaaatttaaaaaattaacaaactttcatttaaattaactgagaaagaaagagagaagacccaaataaataaaagtacacattaaagaggaggcctttaaatgatatcacaaagacacaaattactgaaagagactattatgaacaattatataccaacaaatttgataagctagatgaatttgggtaaatttctagaaacacaaaacctaccaaaactgaatcatgaagaaatagaaaacttggacagactaataataactaaggaaatttaaccaataataaaaaatcgctcaccaaagaaaaacccaggacctgataaaatttactatttggtagacctcactgttgaattcaacagtgaattctactgaacatttaaggagaattaatgtaagtcactttcaaattcatccaaaaaattgaaagataaagaaaattttaaactaaggctaatattaaggtattaaggctaatattaccttaataccaaagccagataaagacacgaaaatataaaattacaggccaatatccctgaggaacacagaggcaaaaatccttaacaaaatattagcaacctgaatttaacagcattaaaaggatcacatacctttatcaagtggtatttatctctgagatgcaaggatggttcaacataccaaaatcaataagtgtgatacacattaaccatatgaaaagtagaaatcatatgattatcttatagatgcagaaaaagtatttaacacaattcaacattgtttcatgataaaagctctcaacaaattggatatagaagaaatgtatctcaacataacacagtttatatgtaacaagctccaaaataaccgtatactcaggagtgaaaaggtggaagtttttcctcaatgatcaagaacaaggttgcccactctcaccacttcaacttaacatagtactagaaggcttagttagggcaattaggcaagaaaacagaaaaaaaaaaaggcatctaaattagaaaggaagatgtaaaatagtctcctgttgcaaatgatatgatctatatatagataatcctgaagactccaccaaaaacactgttaggactaagaaacaatttcattaaggtttcaggatacaaaagcaacatacaagaggtagtaatatttctatacactaactgaaactgcttgaaaaataattttttaaattccatttaaaatagcatcaaaaataatatatttggaaataaatttaaacaagaaggtgaaagatctgtacactgaaaactataaaactttgataaaggaaattgaagaagatgcaaataaataaaaagatattccgtgttcatgatttggaaaaattgatgttgttaaaatatctacactatccaaagcaatctatagactcattgcgttccataccagaatttcaatgacatttttcacagaaatagaaaaacgattctaaaatttttatggaaccacaaaagacccctaatagctaaagcaatcttgagcaagaagaacaaacctggaggtattacactttctgatttccaattatgttacaaagatatagtaatcaaaacagtatggtattgggataaaaattagacatatagatcaatggagcagaatagagagcttagaaataaacccacacatatgtggtcaactaattttccacaaaggtgtccagaaaaaacaatgaagaaaatacagtgttttcaataaattatgttaggaaaactggacatccacatgcaaaagaatgaaattagacacttatcctacaccatatagaaaaatcaactcaaaatggagtaaataattaaacttaagacccaaacccttcaacttctaacagaaaatacaagggaaaaactccttgatattggttctggctatatatgtattttttggttacaacccaaaagtttcaggcaacaaaagcaaatataataagtggtactacaaaacactgaaacatgtttacacagcaaagaaaacaatccagaaaatgaaaaggtgacctacagaatgggggaaaatagttacaaaccaattatctaataaggggttcatattcaacatatgcgatagcccctcaacccccatccatagtttcactttccatggtttcagttacccatggttaactgcagtctgaaaatattaaatgggaaattctcaaaataaacagtttataagttttaaattagcatgatgaaatctcactctgacctgctccattctgtctgggatgtgaatcatctttttgtccaacatatccatgctgtatatgatattcatcttttaatcatccacatggcctgctcctgacatccaaccagtaacattatcatggctcaaagatcaggaacacccacagcagatgatcctccttctgacatatgatcagaagatcaatagtagcctaatgctacatcacaatgcctgcattatttacctcacttcatctcattaggtaagcattttatcatctcacatcatcataaaaagggtgaatgcagcgcaataaaatatgggccaggcatggtagctcacacttgtaatcccagtactttgggaggctgagattggtggatcacttgagcccaggagtactagaccagcctggccaacatggcagaaccctgtctctacagaaaatacaaaaattagccaggcatggaggaacatgcctgtaatgctagcgacctaggaggcaaaggtgggaggatcgcttgaacccagaaggcagaggtttcattgagcccagatcatgccactgccctccagcctgagtgacagagtgagactctgtctaaaaaaaaaaaaaaaaaaaaaaaaaaaatttagagaccatattccatattcccataattttaattacagtatattgttataactgttctactttactgttagctattgttcatctcttactgtccctaatttataaatcaaattgtatggtaagtatgtatgtatagagaaaaaagcatagtgtatacagagtttggtactatctgctgtttcatgtatccactataggtactggaagatatacccccagaaaagtagagactactctataaagaacatatataacccaatagcaaataaagcaaatagcccaataaaaatataggcaaaggagctcaatagacatttttccaaagaaagccatgcagatggccaacaggaatataaaaatgtgctcggtgttactaatcctcaggaaaatgcaaattaaaacaacaatgagatatctcatagcattcaataagacagttattatcaaaagtcaaaagatcacaagtgttgttgagggtatggagaaaagggaccccttgtacactgttggtgggaatttaaattgaaaacagtatggaagtttttcaaaaaattaaaaatgcaattaccatatgattcagcaaccccacttctgggtatatacccaaaggaaataaaacgactatctcaaacagatctatgcactctcatagtcatagcagcattattcatggtcgctaagatacagaaacaatctaactgtccatccacaaatgaatgaataaagaaaatgtagcatatatatatatatatatatatatatatatataatgaaatattatttagtcttacaaaagagggaaatctttacaacacaatggatgaaccaggacatcctgctaatttaaataagccaggcatagaaagacaaataaatattgcatgatctcacatgtgaaatataaaaatgaataattaaataaacttatcacctcacttcattcctatttttctgtatgtggtaaaaacatctcagatctatctattcttttagcaaatttcaagtatacaacaccttattattaatttatagtcatcatgccatacactggtatgcaaaacttatttaccttaaagcttgcatcttttgaccaccatctcacaccacacacagaaaaagtaggtatgaggtgaggtgatggatatgatagttttattgtggtaagaatttcacaatacataagtatatcaaagcattatattgtatatttcaaatatacacaattttgtcaattatacctcaataaagctggaaaaaagaaatctaatagctccacttaaatgatgttcagcttcaacgactttgtttgccaaaaaattttgttaaaaggtgttacagtaataatcatcttctttaaaatgagcactaaaactcagaaaattaatatagatgtacataaaataatgtcaatttcttaaatcctagagcatttggtttttaaaacaagagctgtgatttctattttgattggggctctgataaaagtcagccagattcatttgctgcataaattactcacagatcattaacagaagttttttctgcagctgcaataactcatccaggctgttacagaactatgtaactcactgcaggcagaacttcctaaatgtcaacttaggaaccaaagaggtttcatggatctatatgaagctttagtaccatcctgggttttgaacacagacactccacagacctgtgactgtatttacagtagcataatgattcagttgctatctaacatctaatctccagcctctaaatatgccacaaatgccactgttcactgcttatgtgctagacttgcccaccttgtctcatacctacttttaactactcttctttatgcttctccccataattttatgctaggcagtcacctccattggaaatatttagaaagagccaaaaatatatttaaatgtaagaaactcaaggaggaatgcacaatcaaggaggaattatgaggaaatgagtagggatgcaaataattcacagggtactaaatattcttccatcttccaatttccctttatggtacttttccatattcatcctcaacttgagcttccaagataataatgcaatagcaattcatatccctagattatccacagataaaatagactgtagcagctgctgtcctctgcccaggtcccccttcagtcttcaaggatgtagtccctcagctgcgtagagtgctatggctgacagtcctcaatgatcacctctctcttggaattgcctgttggtggagagagctgcctctcttgatgtcacaatcctttcctaagggaaatctgtttccaatgcctgttgaggaagcttggcccctcactcactcaggtgcagctttcaaagacagctatgagggggaattctctcagtgtgcagggcttcacgcactacacttggtcatcaaattcatgttgaaagagatgcagcctcagcctcagtttggaatatacacagacgggtaggtgctgaagggcacagacagatcatcagaggcctagtgggagagaaattaggagatcatagacaaggatatctggagtagtgttgtgtagatgacactatgggagaagacacaatgtgggaagatctttcagttgcaggttaacacctaccagaaatcatctattttggaagaggcactagacagccaagtagatggactgactcagccacttgatgccagccagtttctgtcattggccattccagtgctgctgaaatgaacacatgaaaagagtagctttagtgtcagagatgttaggttatgctcgggcccaacagcatgggctcccattcatcaaagctggtctagctccaggtgctgccgaacagcaaacttgccagtaacaaagatgacatcttcatccccaatattgcatcatttcttcaggagatcatcccatcactaagcggcaagttcaccacagtctacttctttcatcttgccagggtcagtggttcatttttgacagtaacaaattctgaacatgaatttgctttttctgtccccatggtttcaggcaacactgttatctgaatgcttgcagagtgtcagatccaacaacagcaatttcacttataattatgtcaggcagagggacaaaccttaaaaccaagcaggtccatcagtgggtccataatgacaggatctgctggtcatatcacaagccacaccactctattgcatcaacctgatagagtgctgaaacagcctgttgaaacacaacggaggtgtaggcccagacatgcttccctgtgagaatgagacagcactctccaggacatagcatctatcctgaatcaatgagcattcgcgggctctgggttcccgataaacagaatacatagatgagaaaccaaagtctagaagcaagagtggcctctgttaccaacattcccagtgacccactggagaatttgtgcttcttgttcctgcaactctggggtctgtgggtttaaagatcttggttcccaaaggaagaacatttctgccatgaacacatcatcatttcccttgaatctaagctgtggtagcttcctggacacattaaatttctcatggcaaaggacaaaaggacaagaaaagcagtcaccatcctaacagaggtaatggattctggccctcctttatgccccacctcaggaggaggagctgctgctacagggaggaatatgctggcaatctacctttggaaagtccttgaccaattgtttcggtaaatggacaagtgtagcggccccagcctgaggcaggtatagtgcccagggtttcatgccagtagatgacccatccagaagagcagaggtgatgtctgagggtgagtagaatctaggatggacagtagaagagggagactgtgtactaattgtgggtcttgagacaaaatgcagtggtcaggcctgtaattttccttcaggatgctcactggaatccctggagaggctaccccaacatttaagtaaagaagcagaacaagtacagcagggaatgagctatagtagacatagctgagctgcccagattctcccgcaggattgaagggcctgttcctcccctttctcctcctggcactggtagatatcagcccagagatgtgcagtgtactctgagcacctcgagtttggggcttgacttacagtgccatggtgcttaacacacttgaagagagggtgaacgactgtgtgatagaatgactgttttaattacagcgtagcagggtgttgactcttctcttttggctttgagacaatgttcttgttcaagtcatgaagtcacctgtctttagaatcactaagacttggtccaagataacttagttgactcaaacactacattaatcatgttatgtgacctatgaaatagtctgctggaaagcaaattatgtcatttcattaaatcatcttatcagggatgaccacaaaacccatgaaataagccactttttcttaatttctttcatagatttcatattattcataaacaaatttttaagaaagtaatttaatttgggtacaaaaataattatatattaagatacactggattttatgttatgattggaaagtcatattcatctggacgcatttaggtagcagctgtaggatcttatgtaagtttctgaacttttctgtattttaatttctgggccttgtttgttaaatataccttccttttaaggttgatgtgaaaattatatgagtcagtaaggcacttaaaatgtgcttgacacagagtaagccgtcatgttattattatttttgaatgcctatcgtatgtcagagacaataagaaggtttctcttggataattgcttgtacacacatcatctcatttaatccacacaataaccctaatgtatagctgttcttcatgttacttatgaggaaaatgagggccagaaaaatgaagcaatcggctcaaggtcacacagctagatagtggccatgctaaggcagcaaaggtcaaagctagaagaaacaatcctgtaggtaccttagcaattcttcacagtctttcttttcttggctttattatgactctttccatctggccatgtcatctgtttggcctattctccagaagtcaagagattagatctgaatctcagcagtcttgtccttgatgcaatagagagctgaaatcctctctcagaatacatatcaatataggccgggcacggcggctcaagcctgtaatcccagcacgttgggaggccgaggtgggaggatcacaaggtcaggagatcaagaccatcctggctaacacagtgaaaccctgtctctactaaaaatacaaagaattagctgggcgtggtggtgggcgcctgtagtcccagctacttgggaggctgaggcaggagaatggcttgaacccaggaggtggagcttgcagtgagctgagatcgcgccactgcactccagcctgggcgacagagcgaggctccatctcaaaaaaaaagaaaaaagagaaagaatacataacaatataaagcttgattcttccagcaactctgggaaccaactctaagtttgctgatgaaatacctgttccagcttacctctcaaatattgctctctgaatattttttgttgaattcaaagaagtttgcatgcttttatccattcgagaacaaaattttctgcaaatacacctgagacatacaatatatgcatgtggatttttttactgaaagcaagtttactgctctatccttccgtttttcttcaaagtatcaagttgtactgaagtttgttacctcagtgctgaatgccattttcttttttttttttttttttgagatggagcctcactctgtcgcccaggctggagtgcagtggcacgacctcagctcactgcaacctccacctcttgggttcaagcgagtctcctgcctcaccctcccgagtagctgggactacaggcgctcactgtcatagccggctaatttttgtatttttagtagagacagggtttcatcatattggccaggctggtcttgaactcccgacatgaactgatccacctacctcagcctcccaaagtgctgggattacaggcgtaagcccctgtgcctggcccatttttatatcataaaataaagctacatatttatttacctatacttttcaaagtattgtcacatagttattctatctaaagcaagacttaactttcaatgttcaattaaatcattcactgcattgtgtttatttaacattatatcaccattggttcacattgtatgtcctcctttgaactgagtcaaatattaacagtaaaaagttatctttttgataaaagttttaagcacactaaataggaaatttataatgaatctcagttatagatctgttaaaatatgtttttaaaggtatatttcaagttttctatcagagaatatagcaatctgatgagagatatctagtgcctctttattaatagaaaatgactgaagcttagtctcactcttgataaaatcataaataattttttgaaaaccacatacagataataatgaatgtctacatttataagaagtagaataatgttttgttatatcatcatctattagaaacataaaattttttaaactacaataactgtaggtccatggactgagttgaattatttcattagaaaataattttaaaagaaagccgattcacttatcaacataaagtattgtgaaatggagttaatatcttacttgtaatatttctagactttttaaaagggctaatattaaaagagaaagagagagagagagagagagagaagcttgattagccatcagggaaatgcaaatacaaaccaaaattagataccacttcacaccgagcgtgaagtgaatggctacagtagaaaagacagacaatcacaagtactggtgaggatgtggtgagatcggacccctcatgttctgctggtgtgtatataaaatgtgcaacttctttggaaaacagtctggcagttccccacacagttaaacagagttaccacatgatcaagcaatttcactcctaggtgaatacccaagaaaaatgaaaccatgtgtccacataaaagtctgtacacaaatgtatacagcagcattattcatatagccccaaagtggaatcaacccaagtgtccgtctgatgaagggacaaacaaatgccctcattcatactattaaatggaatactattcagcaataaaaaggaattcagtacagatacttgttacaacgtgaatgaatcttgaaatcatgttaagtgaaagaagatagtcaccaaggatggctgtatgattccacttataacaaatgtacagaataggcaatttataaagacagaagctagataggtgattacccaaggctggtgaaatggggagatttaggagccctgactgagtgcagaatttattttagagatcataaagagtgttttaaaattgactgtgatgatggctgtacaactctgtaaatatgctaaaaataattaaattgtattttataagtgggtaaattttgtggtgtgaagattatatcttaacaaagttgttaaaaaaagagaaacagtgaagtgtgtcatacttaaatgaaaaaaatcttcatttccctccaaatttattttaaaatcttgccaaagtgtagtatatgtaataaattgaacgatgaatagtactggattttaatcacactttactaattcttaatcaaaatatatgctagatgaatactgttcaatttgtaattactttgcataggcttttaaatagtactaaattactctaggtatgaaaagtctttgaaatgaatattccacctatagaaatatatcctttggaaataattaaccacatgtataattatttcacttcaagaatgttcactaataatgtttctgataataaaaatttaagataatcaaaatgcccaacattaagtattagtttagataatttcacattatttaaagattcaatattctccccttttaaaaaagctgtgaacgtacctattgaaatgaaaatgcttataatatggagtttaatgactaaaacagttttaaatgagcatgtaccgtgtgatcatttttcttaaagatatgcatggaaagttatctattaatagtaatggttgtctctgggcagtgtgagcatatgattatggtgtgtctccttttattcatctatacttacaagtctttcctataatgagcatctattgatttggtaacatgtaagatatttttaattttaaaaaataaccaaatcgcattttaatgttaacagcaagcagcacaaagtactatgttgctccctgaatatttcaccagaagggttaacttacattaccctggaaggaagacaataagaaatggtgagcctgatggaatagagagagaggctgaggagtagttctacctgcctgtttttccatggtgacagtggaatattaatcacagatggatgagacttaacattgctcagactatcattagctgttttcatcaatcactgtccagttattgctaatcctctaccattctcatcctgtggggggtggaaaatgacagactgcgtgtatcaagcaaggttcccaggtacaagcaacaagaaaaaaaaaatgaagttggctatgttaagataaatgaatcaactggaagtatgtagagggctcagaaaacaaaggtgatgtaggggaacctgcttaaacaaccagtaagaacaaaagaagttctagaagccaagttgcaacaaattcctagatggaatgccaatacccaggaccactcttaggcccaggcaagaagggccattgccccagctctgggttttaaagaaactctggccctgtggccttgtccctaaggcaagagtctatgaagttgaggatgcatgttacccagatcccaagccctgccttgagaccatgttgggacacgtatgaccccaggattgtttgcacaagtagtccttaactcactcaaagcctatgcagtcctcttcacaggctccacccactcgaacagaaactgcatacaggtggacctaggagtagccaacatgcagctttctgttgggggttatggatgaagcttagatctataggtcaggctgtccacttgtgtaggcacaaatttcttacagagcaaaacacagccaagagcaagaatctaggggaaaagggctcgcatactaagaccaaacactggaggccagtattcccaagcttccagaatccagcatgcaagccccagggagctaagaattctaaactcaaacatggccacctgggtttttatgaaggcacatttttccagggagtagaatagatatacatattatgtatatgattaagcagtttttaagattaacctacaacttttaaatatttagttttatggcatgtggacttccatgtatacagttgggtcttgcaaatgtcatcattgccagacaaacctagcaaagtctaagtatatgctggtcactcctttatctttgcatttcttttccctcaagatacaaagacccagaaaacaaatatattcatcccaggtcataagtcacacccttgctgccaggtcttgagagagggggatatggcctttggcagcctctccagtgggaggcagggccctattgacccacaggaacacacataatggcgatgacctgctcttcttctattaataaggagagagaagtgcatgctggacagccaaacaaggcaaaacccaaagaaatatgcattgtattgggaggaagaaggccatccttactcaactagctatatgaggtcaatgacattaagcctctttttctcccttataaaataaccataaaaatccctacttcattggattgttaacaccattaaaaagataatatgtgtgaaaaaatgctctgcaaactgcaaagtgctatacaaattagcatattagtgttatactcttgggagagctctggcagttgctaatcaagaattaagagaaatatgctaattagaggagacacctgacaatgatgaagataggtggcaggtaagaccccacctgcttcaatgcagccctattcaaatctttacattttgtatgctgctactcagccccacattacaataaatatctcccacataatctgcacaatttccctacaataaattgtcaagcttcatctggtcatccctataaactcaatatactctaagcaggttgttaagtacattcaaggatttcacaatgaacagctgagatccagttatcattaaaatgaagtgctgacactggaataaagccacaagaaagtgtttactgctactgctgctctggaattataatcatttctttgcttggcctttagaggactgaatcatctgatgcatatctatcttgtttagtaataagatttgaaacctaatgttgaaatgtccatatctatgtttattagaactagaaaccaggtccacattaagctcacaaaaccatagcttctttattaattgcctacatttattatctatgctggctgcacacaattttatgaagtgataactattttccagtttaacagagtatgagctgcaaagtggagagtttgggaagaagcttgacatttagtaggaagcaaaagataagagtgaagtgttcctctcccctctccccacggtctccctctccctctctttccacggtctccctctgatgccgagccgaagctggactgtactgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatctgccagcctcggcctcccgaggtgccgggattgcagacggagtctcgttcactcagtgctcaatggtgcccaggctggagtgcagtggcgtgatctcggctcgacacaacctccacctcccagccacctgccttggcctcccaaagtgccgagagtgcagcctctgcccggccgccaccccgtctgggaagtgaggagcgtctctgcctggccgcccatcgtccgagatgtggggagcgcctctgcctggctgcccagtctgggaagtgaagagcgcctcttccaggctgccatcccgtctaggaagtgaggagtgtctctgcccggccacccatcgtctgagatgtggggagcacctctgccccgccgccctgtctgagaagtgaggagcgtctccgcccggcagccgccccgtctgggaagtgaggagctcctccgcccggcagccgccccatctgggaagtgaggagcgtctccgcccggcagccaccccgtccgggagggaggtgggggtcagcccccgcccggccagccgccccgtccgggaggtggggggcgcctctgcccagccgccccttctgggaagtgaggagcccctctgcccggccaccaccccgtctgggaggtgtacccaacagctcattgagaacaggccatgatgacaatggcggttttgtggaatagaaaagggggaaaggtggggaaaagattgagaaatcggatggttgctgtgtctgtgtagaaagaagtagacatgggagacttttctttttgttctgtactaagaaaaattcttctgccttgggatcctgttgatctatgaccttacccccaaccccttgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttacctgctgaccttccctccactattgtcctatgaccctgccaaatccccctctgcgagaaacacccaagaatgatcaattaaaaaaaaaaaaaagaatttgacaaagtaaaaaaaaaaaaaaaaaaaaaaaaaaggagatttactaatgtggaagattaatatggaagattcctgctatatgttctttttttttttttgagacagggtatctctatgtcacccaggttggagtgcctgggtgcaatcatagctcactggctcactgcagcctctacctcctgggctcaagtgatccccactgcctcagcctctcaagtatctgggaccataggcatgtgccaccatgccaggctaatttttaaatttttttgtaaagatagaatcttgccatgttgcccaggctggtcctgaacttttgggctcaagcaatcctcccacctcggcctccaaaagtgctagaattacaggcatgagccatcatgcctggccatgttctctattaaataaaagccttccatctctttcttcatttcagccagttaaattgagatctaaaggcttgaatttactatttaatgctacctaatgacatttcagagactggctataaaaaagcaagtgttgaaaattaacaaaaacgtctctacaaaggaaatgaaaatgttccctcttccttgaaccaacagagagagaaatatcctttcactttataaaatgaattccaagactctgatttgatgcagcgttaaattgaaaacatttaggaaaatatcaatcttgttttctccatttccatttgtgcaaaatggagacttgctgactattcataattatcaacttactctgtactgttttctattaatgtgaattcattggaagtatactttgaaaaggaggtcatgtaaaactcttgtcctgggaaaattactttcaaaattaaaaaaaaaaaaaaaagagtgaagtgttttgatttaggagaagatgtacatccaaagagacttctgtcttaggaaacatgagaattttgctgtaaagctcaacctagatgcaaaggagactaaagacaagcatcccagacaattatagaccaagcattgggaaaggaataagttgggactgactcataagacacttagatgaagctaggacaatggacattacgttagctaaccctgaatttgtgctggaaagatttgacaaaacctaaaccttatctatttcttataagtgcagagaacaaatagttcaaaacacagtatctatagataactctgtaaaacaaaacaaatttgttgtttggttaattctcctcaagacataggttgcaactgatattaaatttcttctcatagactatcgatttacagcaatggattggtcaaggaaggataaagaaacttggaaagaactatcatgatacctgccctgagaagccaaaatttggtttaactttgtgttgtttactgtttggttctataaaagctaagtttataaaatattgtatgacaggtgaatttaaatgttactaaccatcttggatgtcctgctcttctgctgtacagcaataaagtctctctaaatgcaatgtttgggacagagttgctctgggaaatatagtggtttgaaaggtggctattgtacccaagatgaatatgttattatctcattggacatagcatcaaatgttatttatgaaaatgcttatcactgccacaggcttctggtctatacccatgaagacatcgctcaagcatagcacctcaacagagtgaaaagtgcaacccaatgctatagtaaaggcatcacctaaaacttccttgcctcagacacctgaatggcagtgtcttcactcaggtccccactcaaatgtcaccccatcagcaatgtcttcaccaatagcactgtataaaatggcaagtccactctccaaacaagtacttcttctcctttctccacattatttatctccaccccactatggccatctaatgaagtctgcatgtatttgattctacattagttttccctctctccctatatttttgcatgtccagctccatggacccaaaagtacagtctgagcaagatgtttgaaaccacctttgcaaaaattatgacattgaaagtaatcggacatagctgaatccatcttgcttctaacctcacatgctgcccttgttcacttctaggcataggccaagctaactatgggaggaatttggtttatagtttaactttaaacaaagacaaccgtcctttcctgaaactaactcccttcccaatggctcctatagatactactattgtaaaacctaacattggtgtttgagctatttttttgaccctacattctgatggatcagctggcaccacctggcctgataacccataccaagaaactggtttatctggtcttgtgaccctcacccaggaactgactcagcataagaagacagcttccaactccaatgatttcatccctgacccaaccaatcagcatccccattccctacgcctctgcccaccaaactacccttgaaaaaacctagcctctgaattcttgggagggcagatttgagaattatctcccatccttctgcttcgttggccctgtgattatcaaactctttctttgctgcaaaacctgctgttctcagtgaattggcttttctgggcagtgggcaagaagaagtagtcaggctgttacaccttcacagcactcagtgatggttcttagatgaaagtaacaacttataagcacgtggatctggatgagtccagcatgtcccgagatgtgtagcatgtttgcgcagtagaacaaaggcttcagggatgtctggttcacatgtggcagtcaaaaaagtcacaatattaaattataaaccttcttccttccccttcctttttttcctttagattctcaataagattctattttgaaataaaatagaacaaaggctgatgtgctactaacaaaaccttttgaaggaaatttcaaaacaagagcaagttaaggcatgccaatttattatcatactcttggattaaattcccactttttgcctgtattttcacatctgtaatttggaggagtaacttcatgggttgttaaaacagcaattaataactgtgtgttttaagtgttagttttaaatattactttctatgtagcaaaaagatttctgatagtgctataattctccaaagagtagggtcctgagtaaaacagaatgtcactgttactacttgacgattgtcttctgaaataacatattcaaacccatgtactttacttactatgaagcattttatggctttgacgaaaccatttcaaccccattctttcccatgttttaagggtttttttaggtagctcaaactcagcacatccacgaaatatctcatcatctttccccccacactctgtgtctatacctgaattctctttgatgaatagcaaaatttccttcaagttactcttaccaataactttggaaatatagatttgtgaaaggaaaagaaaatctcaggaccccaaactctctgtcaaagggaaagcaagtcacacaaaaaaactgccttcctcttgttcccaagcagacaactgtaatttcacatgtgaaatgtagatttgccaagccaggaaaagacatacttgaccttttccaccactcctctcttttcacatgtcaaacaaagatttttgtgagtgctaatcaaagcctcgcaagaatgtaatgaccacactgcctaagttctacctcccccccacttttttttctttcctccttcccctcctgcctgctctttccccctgtagtattgaagttctcaaaaccttctttggaaaaagcacagtccacattccaggcacatcctcaactgtggcaatatacacctctaaatctgtggcagacacttttggtttacagcatgatgcatcctgatggatgcattctgaagtcagattgagctgcatctaaactctgctttaccaacacctgtgcaatctcagccaagagctcgaaactctcagagcctccagttccttcgtcattgaagtgagtacagagtacccactcataggttccttgtgaagagtaaatgagataatgttcacaaaatacttagcatgctactggcttataatatccattcaattaaaattgatgatgatgattcaggctttaatcatttcttgcactgatggctttcttgtcagtttttctttcaggaacatgcaattcttcctactctggttttgtttctccgcatgtctacagagctgccagagggttacatttaaagtacatgactgttcatgccaatctcctactgtccttcaatggctccccaaggctttctttctaaagtaaaaactcctttcattagcacgcaagtcccttcacggattgagtaccctctgttcctctaacctcatctctaacgctctcaagacttgccatttctgcaacagacagatccaactgctttgagcacttccaatgagtcatgcagatcatgtgtctgtacatcccacccagatatacgaggcactagccactgttccaatttatcaagcaaatgcttactcacactttagggaaacttctttaataatttagaatcacctgtatcttttctcccccagcatatacatactcccccagtgtatgtatatttgttgcaaagcttattacattttggtgtggatgtgatttacttgtttatttctttccaagtaatcaaaccaattcatctttccatctcacaatgttagacaccgtgcttggcacatacagatatataatggatatatattaactaagcagatacatatgttaaaatgagatctgagtcatgaagataatgagcttctctttcccagctcactgcagtactcttcttactgtgcctgactctgatgggctccattttagaattttaaggttgtgaggttgtgttaccagaaaggggtcatgatccagaccccacaagagggtccttggatctctcccacgaaagaatcagggtgagtccccagtgcaaagtaaaagcaagtttattaagaaagtagtgaaagtacagctactccatagactgagtagggcgtttccaaaagtaagaggaggaacatgtccaccctaggtacaatgcttgtatacacggggagatgtgctctgccacaagggtttgtgataaaggattaattttcttaattactgtattttgcaagaatcaatattattatctttaaagcaaaattaggagtgcctttgttctccagatatcgggatatctggacacccccaggtcaggtttgtttaatcaacattattaatctgttcccttaactgtaaacatctagaggcgagaaatgtgtgactttctgggaatgcggcccggcaagtcccagcatcattttcctgcccctcactcaagatggagtcattctggtttcaacacctctgacagttgacagggcattataggtaaagtagtagatctctcatcagaaacaagaatccccactacaaccaggccccaactcaccttatttcagaaatgagtgaaaaagaaaacatcttcaaagaggttatctgtgctcctgtcccttacgagcaagataaaatccactgtacttcacttagtactataatgttaagtgtctgcttcaaggtgaaagatttaactgctattttttacacgtggcactgataaaactcaaaatgggacacaaggcagaatagcatgacaatgacatcagatttagggaggcccaagtacgtctgtctttacaggattatttcttagaagttaactgggctcagagagagtatattcaaggtcttttttttccttttctttttaattagtgtgggtcagaggaattttgggagtggatcaatagattgccaacctcccactacatcaatgtaccttccaagggaaaatagacaatttagttaagctctgcatttcctgaacaacttctggatcaagagttcattatctgctatatttgccaatatgtaaagccttcaggatagttgccataattaaacaaacaaaaccttgtatttgcagacatatgatttgagattcaaaaggatttcttcttttatttttggtgttagctttgacccttattctgcttgtcactttttctttagggagtgtgcaattctaaatgcttctcgcttagacagtagctttgacatccagtacaagtggacccctcaccttttacaaaacagttaagctacttatcagatttcctggtttctcaaaccactcttttctatcaggtggaaaggactattctcttgggagatcgagggccatgagatataattaactttccccatcccttccctcttaggaaatggcttttaaacaacttctatgcatcccaccatggtttatgactacactatattaaacatgatgaagcattttcagagaggagggccatcattatgaagtgagtttaaaaacaaattcccatgagatctgataattatctcatggagcagagattatctgcctactgtaagaggctttattttgttcactgctgtgctcataataatagcttgcagtgtgatataaaaaggagagagtgaagcatacaatctcaggagaccagagacaccacttcagttctataaaggaaatcagacataagaagacaaaaacagtgcaaataacaatcatattctgaaaaagaatttgatcaactctcagtcatctttcttggttcacattgacgcagtttagcagaaacatttattgttcgtattattccatgtctctggctttcattcccacatgcagtctacaaatcaggtggagatatttaaaccaaagtacttcattcccttccccaaatgaggaagtagtgatgagaaaaaccgcagagaaagagagagcaagagcgcgagagaaggagagtaaagataagaaggctagcttactctgacacttgtcaccagcaggagatgtggtctagccattcctcacagagcaggaaaccaggggctgttgcattcagctgtgagcagaagacagagagggagcctgaaggtgggacttcattatattatttaaagcaaatttacaaaatctcctattcatgcgtaagttaaagtacagaatcacatttccaggccaagtataaatgcaatattgtacttagtaccaattcaaataaagacgaatggataattgagacctgtgagcaacacactccttggtaccaattcaaataaagacaaatggataattgaaacccgtgagcaacacactcacaggtgtcaggattggagtaccacagaaactgatcatcgctgcagccctacgagagcatttggttccatcctctcactctgcagatgaatataagccagagagatgaatcaccacactgagacccagactgggtggtctttctccaacgagttatgcaaagattatgtttatgttacatacaagtaagttgtgtgtgtgtgtgtgtgtgtgtgtgtgtgtgtctttttggccattttaagagtatagtatttccagggggctgttgtaagtattatgtgtctcaaaacatcaaaagagtgtagaatcctagtggatggaaataatataataatatttattgcacgcctgctaggtatgcaatgaggtatgttacctatattgtcacattaattctcaaacagccctatgagaaacacctcatcttccaggtgaggggtgctgacactctgagcagttaagtgcctcttgctatgttgacaaagaaatggagaatgagtttaaacctggtcactggtgtcccaaatcccagtctttctgcctcattagactgccttcggcacgtccactagcatggtctcaggaaattctgtttgtgaagttcctgcttgtgttttagcaagcgaacgagtcgttggaaataaataactgtcccgtgactcccactcatgacttttcttgacaacctgatggcagcattgcacaagatggaaaatgctgtgcgatgtctaaggagggtggagcaggctcagctgcaacatgaaacatccatcttcctttagcgtctcctctgcacatcattcacacttacagtgcagcccaacttttctcaagaaaagccatcatgtcccgtgaggctttctgggctctgatcctaaaaggacagtacatttggaagctgcctttgaagcctgttcacacatgtctgctgctgaagttaagtttccagtatgtgaggactctcagcataggggttggataaagtagttgatgaggattcacgtgtaaataatgaaagaagcaagtcgatctttgttgctgttattctgagggagaaaatagatgggctggcctgccactcagaggctgcaaggaataatttatcaggtgatgttatgtttgaaacacaaaaataagagttaggaaatttgaaagttggtcagcattaattttctgctagcaaacaactagagatgttgtcaaaaatgccagctaaggcatttaatgagggggtgtaccatgaaaacaagtagcagacacaagctcattcattatctttgttccttacctgtgaatactgaacaatttgtctttctaaatcagttatgtttatattatgatcattcaacacagaaagaattatccaatctaaaatcacctaatttatctagatcagggtttggcaaatattttctgtaaaaacccagatagtatttctggccaaattagacaaatcctggcctatttttttttttttttttcgtaattgttggcagtagcatgtttaatatgagaaagtcttctttgtttatgttcaaggacaaggagaaagagaatttgggagagatgatttgagtaggccagactggaagcggcagtaggagattacagtacggctgcttccttgctgtgggggatttatctttgtactctttgcttgggagagatagttaatgagtcttaacatcggctcacgacacaggtgatttgccagaaaagagtcctcaagggcgaattaaggaacagcccagaacaacaggatcccaagttattctatcatggtaacttctgtctgttcaagaccacacagcctcatctctcaatagcacttttttccccaaaagaaatgctattttcaacatctgacttaatttcacactgagttcctttgtttttaatttttaatttaattattataggatgtgattattttgtattcaacggggcttactttgctttggatattattatactttatcttagcctttcatcaaataacagtatcctacggtgtaatcaggcatcaagagatagagaaagatcatgcatggttttagggtccaggcacttccacatgcaaagcatctaactatagtttctctctgaaccccaggtggctcatgtatgaaatgaggctgggtgcggtggctcatgcctgtaatcccagcactttgggaggctgaggtgggtggatcacctgaattcaggagttggagatcagccagccaacatggtgaaaccctatctttactaaaaatacaaaaaattggctgggcatggtggcaggtgcttgtaaatccagccactagggaagctgaggcaggagaatcacctgaacccgggaagtggaggttgcagtgagccaagatagtgccattgcactccagcctaggtgacaagagtaagactgtatcaaaaaaaaaaaagagagagagaaagaaagaaggaaagaaagagagagagggaaggaaggaaggaagaggaaggaaggaaggaaaggaaaggaaaggaaaggaataatttctcactcctaaggtcattgtgagaactggagatgacacaggcccagtgcttgtcataatgtctagcccatcctagatactcagtgctggctgttcgtagcctaatatagcaaagtgctgctttcaaagccatgtcactttgtttctctcgtttttttaagcagctgaatataatgtctattacgtgtgggagtctcctttttctctgaagtaaattatgtctaaacaatttatattatgaatcattgggatgggtgtttcactgtctagaactcatattttcctatgacttcccttttgactcattatacttagtgaactaagtttctagtaacagtccaggaggcaggggcctgtttcatgactgacagtggttttgtgctgcgaagagatcaaaaggcttgattttacattgtcataccttatttttcctggactttgcttatgctctgttgatggtgatagcacaaggattcctataagtttgtatataataatgtagttgtttgtagaatttggagcttagaataagtattttttttctttaaaacagaaaattgtaatagtttcccttaaagggctgtcctctcacacagttaaaattagctgtcttactaggtaaaactatattattttgtaatgattaaactagtatggccattcacctcatgtctctcaacagtttcttgtcaaatttgggagaaaaaaaaaagcgaccttataagattactgcattccaaatgctagagtgcattatgcctgggaccaaatgggacaggatatatgctcgcctctacttggctgtgtaaaatttgcttggaaaagagacattctgtcttttgaaagagagcatgactttcccttgcattgtgatctatgagctgtagctaagagcaccctcggcagtgcagaccctaaggcaaacctaccacatgtgtctctccttctcccaaggatgttttctacaggcaaaacccgaatagtagagtgagcataaaggctgtcttgagagagagagaggatccagaaatttttaaagaattgcttaattgacttgtttcatgctctttctattccccctccccctcccacacagaatagatagtgcatcatctccttttatctcttatcttgtttctgtggggtttttttttttaacgtcattcatgctgtaaatcacttttttgtttgtttgtactttgcttctttatttttaatttttccataagttattggagcacaggtggtatttggttatatgagcaagttctttagtggtgattggtgagacactggtgcactcatcacccaagcagtatgcactgcaccatatttgtaggcttttatccctcgccccctcccactctgccccccaagtccccaaagtccattgcatcattcttatgactttgtattctcagagcttagctcccacatatcagtgagaaccatacaatggtttggttttccatttctgaattacttcacttagaataatagtctctaatctcatccaggtcactgcaaatgctgttaattcatttctttttatggctgcatagtattccatcgtatacatataccacagtttctttatccacttgttgattgatgggcatttgggttggttccatgattttgcaattatgaattatgctgctgtaagcatgagtgtgcaagtatctttttcaaatagtgacttcttttcctctgagtagatatccagtagtgggattgttggatccaatggtagttctacttttagttctttaaggaatctccacactgttttccacagtggctgtactagtttacattcccatcagcagtgtagaagtgttccctgatcactgcatccacaccaacatctaccgttttttttgttttttgattatggccattcttgcaggagtaaggtggtatggcatggtggttttgatttgcatttccctgatcattagtgttgttgagcattttttcatgtttgctggtcatttgtatgtcttcttttgagaattgtctattcatttccttagcccactttttgatgagattgtttgtttttttttcttactgatttgcttgagtttgttgtagattctgggtattagtcctttgtcagatgtatagattgtgaagattttctcccactctgtgggttgtctgtttactctgctgacagttccttttgccttgtgaaagcgctttagtttaattaagtctcagctatttatctttgtttatattgcatttgcttttgggttcttggtcatgaaatccttgcctaagccaacgtctagaaggatttttccgatgtttgcttctagaattgttatagtttcaggtcttaggtttaagtccttaatccattttgagttgatttttgcataaggggggagatgaggatccagtttcattctcctacatgtggctagccaattatcccagcatcatttgttgaaaagggtgtcctttccccactttatgtttttgtttgctttgtcaaagatcagttgactgtaagtatttgggattatttctgggttctctattctgttccattggtctatgtgccggttccctccctgattagcttaataactaacctcctgaattctttttcaggtaaatcagggatttcttcttggtttggatccagtgctggtgaatcagtgtgattttgggggggtgttgaagagcctcattttgtcatattaccagggttggttttctggttccttctcatttgagtaggctctctgagagaaggtctagggctgaaggctgtcgttcacattctttcgtcccccaggttgttcccttgatgtagtactctcttccttttcctatggatgtggcttcctgagagccaaactgcagtgatcgttgtctctcttctgggtctagccacccagtgggtctacccggctccgggctggtactggggtttgtctgcaacgtcctgtgatgtgacctatgggtctctcagccatggataccagcgcctgttctggtggaggtggcaatgatgggggtgcaatggactccgtgagggttcttagctttggtggtttaatgctctatttttgtgctgtttggcctcctgccgggagggggcgctttccagagagcatcagctgtggtagtgtggcgaggaaccggcggtgggcggggccctagaactccaagatgatatgccctttgtcttctgctaccagggtgggtagggaaggaccctcaggtgagggtggggtaggcacctctgagctcaggctctccttgggcggtccttgctgcggctgctgtgggggctgggggtgagattcccaggtcactggagttatgtacctaggaggattatgtctgcctctgctgagtcatgcaggttgtcagggaagtgggggaaagccggcagtcacagggctcacccagctcccacccaaaccaaagggccggtctcactcccaccgtgcaccccccaacagcccccagtccgtttccaggcggagagggatacaggcctgaaaacctgccccaggctacccgcctcccagctgcgagagaaaaaggcttggttcttcccccgcctgtggagtcagcaccccggattcgtgccctgccctagttctggccaggaggattctcacccagttcaaactgttacaacgctcagctagagatttccttctccctgtggagttttaccccctcctctcccgatggatccctgtggtgccagcaggaatgggctgctcggggacccagcgagctccgcgggcctttccgctgcttcctctacccctgtacctcactgggctccccagacggactcagctccaggtaaagttggaaattctcccgcaagcagaccttcagcttccccagtgggggtgtgtgtttgggagaggagggtctccctctcccacttctgcagttggggcactcacacttttgcgggggtctcccgggtcctgcaggagcagcccacttccttcagagggtctgcgggtcctctcgggactgctggtttcttcctgcagtccatctggagctaaaagtcacaatgcgagccccgcacgctgccctgtcgggagctgcaatgtagtcctgcctcccgtccgccatgatgatctgttctcctgctgtaaattcattccagatccagattctttctcagcggcccttggtgtgtgtcagaagccataatcggtgtgtgctacccacccctactatgcagggcagcttcatttccatgggttgcattgataattattggcttattattatatttttctatgtcactttacatttcttagtgtttcttacatgcttagcatatttctacacatttttttctaattcccaaatgagaagaaagcaaataccaacagtattttctttctttgatcgtatatccctctgttcctgtgtcaggaaaatgtgaagattcaaaagataattgaaagatgattttaaaaagtatttaacatttattttaaaagcactaaagtttgttagcaaaaggcttctgttaaatgttgggagaaaagaaagacttttggaatttcatggaaatattattcatgtgtatttaccaattggttatatgagacatgaagttttttcctaagagataaattctgatcttatacaaacctgagaatctatagggtaagaggtggagaggagagacgaacatcacatacacatctagcaataatataataatataaattagtaaaacattcttgagtacagttagcaatctgtattgaaagccttaaaatacaaatgtaaaggtgggcgatagacaccttctctttagtaatcagaaaaattaaggcaaagttgccatcagttgagatacccagtaattttttacttgcatgttcctcctggctttgtatataattattgcaaatatagcttatagcctaattcctttcctttatgttttaaaactcctagtgtttctttcatgctgcagtgccttccttcagttcaactaatgttcacagaaaatctgtagaatgagcaggtaaatcctggaacctcagaatgtcaggaagtagagcagagaaggaggggtacgggcaggtgcgcagctcggcctctctcagtgctcgggtgtgtggtacaggtgagtgaacacctgggcttgcttgtgcccatagacacattaaataccagacaattaaagtaggacaaaatcaacactttcctggaacaccgggggcaagatcaatcccaggcaaacagctgccttcgtggctgcccttttgatattctactttctcaaattattcttacattctttcatttattcatcaaatatgttttgctccctacaacatgccatgtactttgctaagattagggtatatagataaataagccatgactgcttctagcacaagaatatgtataaagaaagttgtagatctatatagaagaatagaagcaaaggggcagagtggcacagtgaccaagtgcggacttgcaggtgagttagagtttcagaactcctttgtgtcatttatgtgacttgggtaacttatttaacttccatgagcttcagtttcattatcgtaaaaggggataaaatgcctatgttaggaagttatagtggaaatgaagtcaaaggaaagagtgtggtaaaacagcgagcatgtatttgggacacgatagcagccaaaatattgcttaagcattacacatatgtaacgtatctcctgcttacctagttggttttctttttttttttttttgagacggagtcttgctctgtcaccaggctggagtgcggtggtgcgatcttggctcactgcaagctccgcctcccgggttcaagcgacttttctgcctcagcctccgagtagctgtgactacaggcgcgcgccaccacgcctggctaatttttgtatttttagtagagatgggatttcaccatgttggccaggatcatctcaatctcttgaccttgtcatccacccacctcggcctcccaaagtgctgggactacagacatgagccaccgtgccccgccgctgctcaccctgtttgacgaaaagtttcaagtggctcaggtcctgggtggtcggcggggacagatggggagaggtctaccctcattcctgggccactacacaagctgtaaatgttctgtaagctctgccgcctcacctttggacgagtcattctttctccgcagtgtgcagacacacctgcaggttttggggagcagaaaaatctcattccacaagtcttaacacaaatccttttccctgtcacttaggccagcttctcagagtctctgtcttagctttgcagcggctgccatgctcaggaatgtgatctctagagtatcaggtgtgaacagatgtgggaaatataccaagaacacataaatcaaagttgcatgatacaaccacagaggtgatagaacagaggagtccccaaatccacccccatgaggtcaagaaaaatttctcagagaaagcatcctttgaaatgggctattgtaagaaaataaggaattgcatgggtgggacagatatgggagggtattccaggcagatgaaataaattatgaagtactgaatcccaaattatatatttgtgtataccccgtttgttccctgctagtgagtgcaaataagggcattttaatgccccatcaccatggctcttactagccaaactgaagggcattagccagccctgtcttcaaacatgctccatccactgttctctatcccagaacctgtaggaaaatatcagagatgttgagagagaagcccactcatgttctggtgctccactttccccatggaaagctgctcactggtaagtggcgtgacccatgaaggtcagtgtcaatgccagggggagacagtatatcctgctggatggagatgccggggggagacagtatctcctgctggatggagggcgtgcagttcctccatcacagcttgacactcccaaaaaatagcgacaactttgttcaagtgcaaaaagaacaatcggatttgtattggagaaactttactctggctgctggatggggaccggatttagggagaaccatcaggagcctgtcctcattattcaggtacaaaatgatcatggcatgagttggcagtggcagttgtgatgaaaggaagtggataaacttaagagatatttagaaggagaatcaatagcacttcgtgatcacctggagaccccgagcaacaacagggcaaagtcatgagtaatttagcagattctggattggaaatgggatgcagagtgctgctgggccctccgtgaggctgggagagctgagtgtgtgtgtgtgtgtgtgtgtgtgtgtgtgtgtgtgtgtgtgtgtgtagagctgggtaagtatttgggacagggaagctgggacaataacaaggttgaaactcaacttagagttggaggtgcctgtgggatattcaagcagagggtttccaccaaatgtcacaagcttgtcctatttcttttcttttttttttttatacttgaagttttagggtacatgtgctgaacgtgcaggtttgttacatatgtgtacatgtgccacgttggtgtgctgcaaccattaacttgtcatttagcattaggtatatctcctaatcctatccctcccccctgcccccaccccacgacagtccctggtgtgtgatgttccccttcctgtgtccatgtgttctcattgttcaattcccacctgtgagtgagaacatgcggtgtttggatttttgtccttgtgatagtttgctgagaatgacggtttccagcttcatctatgtccctacaaaggacatgaactcatcattttttatggctgcatagtattccatggtgtatatgtgccaccttttcttaatccagtctatcattgtggacatttgggttggttccaagtctttgctattgtgaatagtgccgcagtaaacatacgtgtgcatgtgtctttatagcagcatgatttataatcctttgggtatataccctatttcttctttgtgcatttccatgggactagaatgagcccctgccctccgtgagccaacgccaactctttgtccacatcctccacaccatccttcccagtggccccaggccacactgagcccctagcaccggaatgcctggagtcccactgtctgtgcagttcacgagctgctcagaagatgctgcctcccctagtaaatcacagcctcccctaaccgagaagagggctgcaaacagtgggaagttaaatatatatatatattttgtttaggttgttggaaaaagccaggaaatgcaaaggttctaaatgatgagaaaccagatgagatgagggtgatctttctttctgaaggacaggagaaattgactctgtgttcacaacatgaacagctaaccattagggaatgctggttgtaagttcggcattgctctacacactttacataccttattactatattcatcacaataaccctatgaagtagaaactattgttatcgttatttctacagatgataaaactgaagctcagagagtttaagtcactttccccaaagtcacacagctaggaagtgctaatcaagtcaggaagtctacatttttgagacagagtctggctctgtcacctgggctgagtgcaatggcacgatcttggctcactgcagcctttgcctctcgggttcaagtgattctcctgcctcagcctcccaaggagctgggattagaggcatgcaccaccatgcccagctaatttttgtatttttagtaaagacggtgttttgccatgttggccaggctggtcttgaactcctgacttcaagcaatccgcccgccttggcctcccaaagttctgggattacagacatgagtcactgcacccagccaggaagccccttctaaatcagaattctaacttggtagtttaggctctgaaccattcaaagaatcttaatttttaaaggaataaacacatataaaggaagactcattcttaaagaagggagttgcctttagaggtgtaagtattttgagtctttgtacatatacgctttctgtgtactctgttcccaaaagaagtaaaagttctaccacctaaaatttttttattggaatttacatctttattgctaggtaaacataagttacaactgaacgacttagtctcctttgatcatattttagtgtcagataccattttttttttgtttttcctaagtaaataattgtcttgtttgtttgcctagttttccatgtaactattagtaactcatcttcaagcttcttttttttattttattttatttttgaggcaggatctcactctgtcacctaagctggagtgcagtggtacagtcatggctcacggcagcctacggccttgaccttccccaggctcaagccatcctcctgcctcagcctctccagtagctgggactacagggcatgcaccaccacacccggctaaattttgtatttttggagagatggtgtttcaccatgttggccaggttggtctcgagctcctgagctcaagcaatccaccctccttggcttcccaaagtgctgagattacaggtgcaagtcgccacacctcaccaatatcctcaaattttctgataaaaaatatgatactcttctcagcctgtctaccacctaacatttagcataaatttattttttaaaagtagccccaatttattaaatacatgctctgtactaggcatagtgctaagtagcttccactatttgtaattttcacaggagttctattcgctaattatgagtcccatattccacctagacacattgagttttgaaggagttaagccatttccacttagcaagtggaagggtagaatgggactcgaatctgtgactgaccaatctcagaatccaaactactttctctaccccttcttaaaacaaaccttggcaactcagggcttacgaaattggcaagtccttgagaacacaactagtgaccatggtaaactacggaagctcttcaagctgcgttcaggctgcacactggaatcccatctgagtttcagaggagggggaagcttcctttctccaagagttgtcaggagtaactcactgttctgggcaatggtggccacagtgctaaatacagacggtaaactacactccttctggaaagaataaaatccagcacatacacgtgaaagatgatagctgctgtgtgggagaatggagtgaacacatgagttttaatattctgaatgtgtaaaaaaggcaatttcttattataagggcgttctgtatattctgtcagcatagaagagacaaaagggactaaaacttttaaaattgaatgtcatctacatttttagcttggatggatggtagaaaattgcttcatgaatcatgtggaatagatggaaagggaaagtggaaaaaatggaacaagtcccagctgtgaaacaaaaggattttgagtccatttcctgagttcagtaaaaagctgtgtgatatttggaggagtctcctaacttcttagcacttcaacttacttgaccataaattatagattataatacctactttataagacaaacaaacaaatacatgcgtgcaaggctaatgtggaaatgcattcactccacaattactgttcttaactcctacttttcatagtgctatacctctaaaatggttttatatgcattatttcatctaaccacacaatactataagacgtttaaagatgtggtgctagaatataaaattcccaattttaacatttgaaaacaggaactataattttaaagcatgtattataagaataatatttctttaagactattcttactattttatatttaaacacattcttttactgttaacttcaaattcactgcattgtattgtgaaagaagaattttaatgatctttctgactgtcagaagttctcttgctcattcttcataggaaataggtgctgttacgttcttgtttattttttctacacatagttatcttattgtgaaaggctgttttgcaagaaataggaaatctgcttaccacaaattctgataattagatggtgaaatgagacccacctaagatgattaaagagttagaaaatatggcctaagtagaagcattaacacagttacgctgtataatttttaatcctttttttaaagaatgggttgatttaacaacaaactgtttcaggtagctgccaataatatttctatctatcttaatttttttttttttttaagtcagagtctcagtctgtcacccaggctggagtacagtggcgctattttggcttgcagcaacttctgcctcctgggttcaagcgactctcttgcctcagcctcctgagtagctgggattacaggcgcgtgccaccatgcctggctgatttttatatttttagtaaagacagggtttcaccatgttggtcaggctggtcttgacctcctgacctcgtgatccacccgcctcagcctcctaaagtgctgggattacaggcgtgagccactgtgctcagcccttcatttcttatagatcaagaaaaactgagtttttattgctgcatgagatcaatagtttaggaataaagggtaatttttgataggatttatgtagtggcaacatgactaagctgaaagagctaggaattggaagacctgtatgaatgacctagctcttctgcttaattggtggcttgatcttggccacgttttcagatgagcctcccttgcttgtttgtaatgggaagaagctgtgcgtgcctcccacctcacctgttgtgaaggtccaaataagaaaatgcataaaaagcactttgtaaactgtaagggccaaacagataaagctgtttttgaatgagggaattggagacagaaatctttttttgctaaaagtcttcaaaagtaagtcagaatctcatttttctgggggtagttctagccagtcttttccacaagtagcaagaaagactaggggagcactgtcaacatttgtcatgagggggtcgggggttttgttctgcttgcatatatagctgaaaacttcaagactctttatgaactgacttgacaagatactccatcaccagccgtgattatctggtataaaagccttatggggatgttgctctttgtcctgaactctctctctcttttttccgactcctgtgtctggcgagtacatactcccttctttgtactatgctggaacaccttgctgtgctgcagtcatcattgttgaatccgacgtggcttccctcattcgtgcaataggaaattcactaattaatgactgtatgccagctgtgcctcccagccgctcttcaccctgccctgttgtacttgcacatccccattccttccctcccactgcctatctccacagcggaagctggacaccctggaacacctacattctaaaactgattttaagtctaacaggatgagaatgtcctactaggctacctgagaacttgatctataaactgtaccggtcacatacccccactctttcagaaattgcttgtattttattgtaaaaattattgttacagggttaagtgctgctaggaaagtcatgccgcaaggagagcaaacagccctcgtgtcctgggcatgtcctgatttcttccgcttcaatcggtgccactattctttttatcaagacctgaaattattctataatttccttccagcaccaaagatgctatattttgaaatatttttatctattaaattgcttttcattcagtaatatttttgtctttattaatcagatctatcaatcaaaattcatgatcagggtgagacaactatttgttaccacacatggctgataaactcgcagccagaagcaaacgattttgcggtttttcttagcctgggctgctttaaggagtgtaaatttatgaatctcaatttcactgtttggaagtatctataagagctctgttatggacggcagattttggttcccccatcctgcccctcttccacatgtcaaagacctgaccctccagtgagatggtgtttggagctagggcccttggggggtaattaagtttagatgagatcatgagggtggacctctcgtgatgggattagtggccttctaaaaataggaagagagagagatctctctccaaacacacgcatcaaggaaaagccacgtaagaacatagcagcaagaaggcagcattctgcaaattaggaagagggcccataccacaacccaacagtgctggcagcctgatctcagccctccagactgcagaactgtgagaaataagtatctgttctttaggccacccagtctatggtattttgttatagcagccctggctcattaagaggagcgctctcaatcctcttgctatctccttgcacccttaggattgagaactttttttttttctttgacggagtctcgcgctgtcgcccaggccggagtgcagtggcgcgatcttgcctcactgcaacctctgcctcccaggttcatgccattctcctgcctcagcctcccaattagctgggactacaggcacccgccaccatgctcggctaattgtttgtatttttagtagaggcggggtttcaccatgttagccaggatggtctcgatctcctgacctcgtgatcctcccacctcagccgcccaaagtgctgggattacaggcgtgagccaccgcacccggccaggattgagaacttccaacatgggaaccactacaacagaacaagacccttgaaacaggtttgtgattgtaattccttaatgctgaccatgatgtgtaaattacaatatgtggctttcattaattcaacattagtttgagccattctattcgattatattatcagtcaccatatattagttattctgtgggctcaggaaaatatgctaagtattttatttgtgtgggaaatatgttttttaagaccaagtatttgtaaatgttctcttttctgtaggattttttttcttttggatacaaatatagttaaagctcattgagaacctgcctgatggatgcttctatgccttgtttctaacagttccccaacactttaagaaactgaatattaaagaagatatttgtccagggccactcaactggctggtggtagagctgagatctgccttctaggttttatgcctccaaagctcctgaacttcaaagtagatttcacagtcactttagcaaatggtctgacccacattcttcccaaaattagatttactgctcaagtcaattggagtctttaaaaagttacttattttcatggcctagactcagacaaatgcattcctagtgaaactgaaggcctgggtcactgaggtattggcctttcagtcagcccaccatcgtggccaccacctaaggtggatgagttgtcatgcaaggagaatgaggagggtgggaagggttcttatgcttacccatgaagaactggggagattctgtctggagaggagagaaaagaacccatgcctttcagcaggaagagatatcttgtcatctgatatttaagtaacatttcatggccgggcaccatggctcaagcctttaatcccagcactttggggggccgaggtgggcagatcacgaggtcaagagatcgagaccagcctggccaatgtggtgaaaccccgtctctactaaaaatataaaaattagctgggcgtggtggcgcgcacttgtaatcccagctactcgggaggctgaggcaggagaatcgcttgaacccaggaggcagaggttgcagtgagccaagatcaggccactgcactccagcctggcaacagagcaagaccccatctaaaaaaaaaaaaaaaaagtaacatttcattaaggttcagcagtgattttactaaccataccctttaaccacacacacacacacacacacacacacacacacaccacacacacatgtaaaagagacttctggctctgccactttctagctgtctgacgtctgtttcagttttcccatctgtaaattggggcttaataattgtacctaatttttagagttcttatagagattagatatcttcatacagataagtcccttagaaagattcctgacacaataatgttggatattatgacagtaattattattttcagactgtatgctctgatgcctataaataaatatgccaatagaaatacatcctcctgacttttatttgacttggcccatgctgcaatatataatgtccatttactgctccattccctttgtaatcaccacttcccaaaataatgattccttctcatttgaggcgtcttgcagaaaacactggaatgagatttgaaatcacaatcaacacatccccaaagacataggttaaaaacttattgatccaatccagtgaacaaaatagagactactcaaatcaaagatggtgcaaagataaatgtgaaggtcatattaacacaaggaaatgttgccaaggtaggaaataaatatcaaccaaaaaatgacaacagcctggaaaaatgcaaactagaaaatctggagggaaggaagtgctgaaatataaaccaggaatatgcttcaaaaaagtctggtataaaatacaaaataagcttgaaataaagcaaaaaatgtatgatcttaagaactacagttaaggagacgtgaatgccttatcttataagcttcttaaaggcattgaatttgcttggtctttaacagatatataaatgtcatataatatcatacttgtttttaactatctggttgaggtatgacagtaggaataagtgttagaatcattaatctgtttttaattctgttttcaaatcttgtgcatgagtgtgcaggttagtgagcagctgggtactggtgtactgaccctaccactttttcctacacattttcatccagttaagcaatagtgggggaatctagcagaattcaaatcatcagctttatgacttgtaaattgaattagagcattcgattttggtctgcagactgcccactccccttttaaattagattcactctcctagtcccaggcacaactgtccatgtactgtctttgcagatggcttccatttcttgggctaagactattgctctaatcctggagtataagaaacatagtaaaacatgtcaatataggaaaacatagtaagcagatcatggatcttggaagtcagacagaccagaattcatatctggctttgctacttatcagttttatcatcctgaggaagttatttaaattcttcagacatcctattactcttctctagtatgcttgctccagatggaaatgtcagaatccaaaatccacaatgtaagcatataaattttttatttaactagatcaatttctgatgttaaacttttgtttggagaatgcatcttcactttgaactggaggcaaactattcactggaatagtctctttcctccaaattacttttcagagaacttttgttcttcctctcctccttccttcctttctttccttccttctttttctttctttatcccttccttttttcccttcttactctctttctttctttccttcctccctccctctctctttccttcctccctccctctctccttccttcctttcttcctttggaaaaaaaaaaaaagaaagaaaattcttgttttacaatactggtagaacacaggcttcgtcaggttgagggcttctacccaccatgcagtggtgttacagaccgtttctacatcttaaagttgtcaagggtgtcggggtggagaggagggacgcttgcctgagtcctcagtatccatgttatgggtgagtcaggtgttgactcatctcacacggccccatcctggtccacggctttggcagattctctgctacaatggggacaagatctttttgaaattgcccctacttccctctgccagctgctctttgaatccacactcacctggaggctcacagcctccaggaagcaatgccagaaatctggggctgggtttcccctgatgcaggacctcaaaatatatattcttcttttctgttccccttcaaccattgaagacattttttttttctaatttgtggtggggaaacagctcctttctcctatttgcagctccaagatgatactcctttggtgagctaattctcttgtacatttcttctgcttcgtctgaaaagtctttgatttcttcaaagaacttagacttttcttcctgctccctcctaagacattgtggtatcttcttgactgaaagaaacagacaggttaaaatgtgtgcatgggggtaggggttggaggaggagaacaaaacaaagcaaaacttacacacacaagttaatatctgagtacagcacccagttatagcacctgcgtgctattgattggagataaatgtgccctgtctataggacattagtaacataaggtatattctattagaaataatgcatgtaagtgatggatcatttttgttgaataatgtgaaaatcattacagtgaaaagagaagacttcagacctacaactgtgtttgtgtatgtgtatccctcgtgtctgtatatatatttagaatacttaaaacacattcaatttactaatggtttactgcttcccatgccctgtttgctgtacagctagtattgtgctaaatataatggtagatatgaagtaagcttcacacatgtaaaattctttcggagttatatggaacgactaggaaattatttgtcagagcagctttgacttcactctttaaaaaagtctctctgaaaagttgacacttttgtcaaaaagattcccacataatatgacaacataagagtaaacttgcactgatacagagtcaaaaataagaagtccttctacatgacttcaagctcccagtcagatttccttgtagatgactgactactccagaagaactttaaagaattctggcatgcccagtaatgaaggggacccgtccagcactgaaggaacaagaggatttctaaaaagggacacttttctaatgcgattcactgatctatttagaaaccatggcacaaatgaaaacatcaagtgtttgtgttagaaaactgatgaaccctgatgaacacaaataagtgatgttttcatgttttttttttttgctaagaaaaaagattatagaaaaatagcaggcaacccttatttgccaattagacacaaaatgaaatcaaaacccaacatttatagaaagaacaattaagaaacttttggccaactacaagttcaaagaaaataacaatagtaggcgacaaagtagaaataagtcgttttgctctgaaaggttatagttgaaagaaggtgactatctagcctagagatttcgtagaaattgtggcatagtaaactcacctaaaaagtgttacagtatttcaaattagctgctcacaaaagcgaaagccaagtctcatttttataaactccagtccttctgtccaagttcttttgtgttaactggattctacagtctttttttaaaagaaaacaacaacaacaacaaaacaaaaaaaacacttaatggattaaggttgcatcttgggatttagtcattttaatatgtggaacttctctcataattcttgatgaatgttctttcaaattttacctgcgtcatatttcacaaatattgattgcagacagcaaatgttgctcacttcttcaccaattgttttctcagactcaatcctcgttttagttgccactgacagactttgtactcacccaagaacattttagaggagacctagagcttttagttggacattttcttggaagcatctatctcttatgtaattcaagccttgcttgaaactaaatgtggagaaaacaaattacaaaaattcagaaagcattataattacaatgctgggggcattttattcccattaggaggaccatggatctctccttcctaactataacacctgcagatcatttctctgtgtggacttaccagagtccagtttctaacccgtagggtggagaataaggtacttcattacaaacctcaaatgcagtgtcaacatgctgagaccatttccctgagcacttgttccctacagcatgagagaaaatgaccctttaatgtgtattcagtcaaaaaaaatatatttgtattaggaatatttctctgagacttctgtgctgggaattaaagctatatctatatacgtaaaataaacaaactgccccgtggctggtctgctcatttcagctgtcttcatgatcaatgtggattgttgcacaatcgattcaaccacagcaatcagtattattcatgcactctaggaaacttggtgcaagtaaaatggctgggatgttggaaagtgtactcacttgttagatatttgatttaaggaattttgaaaaaatcgcattttatttttttaaactctcaatttaatcttttctgagtcaaaatgttggatccctagaataaaacctgaagtttgagataatcttttcaacatctcattaatgataatttctgtaaaatcttaataatttatcgtgagtcttctagtgctaaatatacacttaaaactcagagaaaaattgccatcataatttccaggacagtaaagcttgaatgtctagaaaaacagtgtgtggttcacagaaacttagattaaagtccagttggttaaaaaaaatactctttgcaaaattttctctagcatgtatcatacgcaaaaatgcccaatttggcagcttttctaggtagctttccaatcatcagtccggcagcaacctacaaggatttaataattcttatatctaggcttttcaaagactctttgtaagaaattttgattttttctatattgtaaatatcaaagagattaacttcccaagaagtcactttgtttagtaaaagccaactacaaacaagaggccgcaaatcaaagtatgttgtacagacatcattattggccacatagtgaaattctacaatatcaaatgccccaaagtaaattggattccaggtgaatttctgtgataatattgaatgcatctgccattgaaaagagacatctgtaggtcttcaggtgaaattgtttactaacttaggtcaatataatttgactaccaattgacaaaattgttctattggatatataaaggctatcctccaggaaagttaaatatctgctaaaattgcgaagattctgatatccaaaaataccatgaataccatgtgagaagcagagtctactatgaagaccacagaatatctgtgttgtcagttcatttcgactagaaatcagttgtattcctcgtggaatataaggaatatattccttcaaggcagcagatgttaaacttcttggtctcaggataccttttcactttaaaaaatattgagggcttcaggagtttatatatatgttgactatctctgtcaatatatagcatattaaaatttaaactgagaaattttttaaacacaagaatacacaggcacacgttccattggctgtcagagtgatcgcatagtcactcttcgtgaaacctctggagaacactgcgtgcccacgggagaatgagagcaacaatggcaaacaacgtctccttattaaaatgctttgacctcaccaaggccttgaaacagtattggggacccctaaacacgtctcagggacctgtttcacacatcatgagaaatgctgttccaaagactttttctcacttgtagaagctggataataataatcacaaagatttgtttgttacatatatgttgtgtaaatataaatgatcattactgagcaaacttcctaacctctccaagcatgagttccatcagctgttaaatggatataacaataccagtcttgagggatagcattaggagatatacttaatgttaaatgacgagttaatgggtgcagcacaccaacatggcacatgtatatatatgtaacaaacctgcacattgtgcacatgtaccctaaaacttaaagtataataaaaaaataataataatagtacctccaaaaaaaaaaaaaaaaaccagtcttgcacggtggttgtgaaaattagcattgatgtgtgtctaacccaaagtaggcacttacacattacaaaatttatctaatttgtttaacttctttctaactattaattaattatgaagcaaagctatgaaaaatgtataatctaggaaaggtttttcttcttatgcaataatgaccaaatgaagggaacacgtcaagaactatcctctggctattgttattctgatgcaaaatgtgctgctgaatgtttcttactagatacttacagaagcatgaagaacatttgtcaaacttagtcctgaaaaggtatggaatttgtggggcataattaaacatgaatataacatttcacacaaagtgataacactggaatgaaaaaagaactggggcttcatggagcatggagcatttgtggtgtatttgaagggagaggaggtatttgacgataagacactggtaggagttgagtgaagcacatttttttattattattattattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgtggtgtttggttttttgtccttgcgatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtatttgctattgtgaatagtgccgcaataaacatacatgtgcatgtgtctttatggcagcatgatttatagtcctttggaagcacattttaagagaaagaaatcttcaaagcttgactgttggtcacaagtcaaggttggaggcacctccaagccctccaaatactagataaggatgagctgacagcaataggattgcatagaagttgtgttaggctcccaagtactctccctgattccatgcagtcatgggaaattgcttctcctcatcctggcagaagcaaggtttgctttctgcagacactcattcagagaagctgtgtgtaggtgtaaggcactgccccaggggagtgtcaggtgctgctgaacacagagggatgaaactggtgtctccatcctgaagagtgacagccctgtcccttgcacttgaaccctgaacactggcaccctagataatatcattcagggaaaagaataactcaaaaggaatgaaatttggatattgattttgggaatctaccaagaaaatgactggctccttaatcagtgtatagtgaggcccatcagtcaacaagctcacccaggtacagggagtttctgagaagttgtctgcatcttgttcttaaattttactagtgacctaagaaataaggattactatacatttgagaatagcttgtcatatgtaagatagggagcaaacctccccatactctgatagccagctgggtagctagctagaagactgatgataggtaggtaggtaggtaggtaggtagatagacagatacatacatacatacagatagatacatacataagtagatacatagattagatgataggtagatacatacatacagatagatatatacatacataaaaagatacatagattagatgatagaagatagatagatagatagatagatagatagatagatagatagatagacagatagaccgaccaatagataaaagagctctgaagtcagactgcttgggttgaaacattgtccctgccccctttgctaatcgaatgaccttgaataagtcacttaaatcctgaagcctcaattttccttatctgtgacatgaggataataatagttcctacctaataaaggtgaagattacatgaaataaagtatgacgtgcagactaagcatctaatacatattttcaacataattggcaaaaagtgcagggtatgcttgaaaaactccgtttttcggcttagttgaattactctgaacataaagtagaaagcgaagatagagccagatggtattttattttgactattacatactaatataacttaggctatgtgagagaattatttacagggaaaagtttactaaccttttcttcacctaagaaagttcccacgaggcactgcctcacaccttctgcccccaacaagaaacagtgcgtgactcttgagtacacagggtgtgaaaagctcataataccctaatatgtctctctaagtacaattggttgttcatgttaaattggaaacacttaataactgcaaagttaatatgtgattaaataacaacagcaaaaaacctcttctccctcttgcccaaataggggctcatagctctttcagtgtacccggggcccctttctcagcttcagaaggctggatattgtggcaattaattgtttaaacacactacgaaggattatgatgagaggaaaacataaaacataataaacacttggtaaccagtttatttcaatagcagctcctctgccaagccagcagatttttctaggacagagctcccttccataggcagctaatctaggacagagctcccttccataggcagctaatctaggacagagctcccttccataggcagctaatctaggaagagctcccttccataggcagctaatctaggacagagctcccttccataggcagctaatctaggaagagctcccttccatacacagctaagaaagatcaggggaatggccttcaatggaccccgctcatcattccctacacagtcgcaaaaggctcaccacctccttcccatggcccggctaaaagaaaaggtgttatgtttctttaactctttggagcataaaggagctgttttttttttttagtaagaataacattataatcaggtgttgtttaaaaatagcaacaaggcacaaagaaaacaggcattgacaccaagaaaaattagctgacaccacgtaataggagagatttattcatgaatgacggaaagttatagaacttcttttctttccttagcagcatgtcatcattgcaacaaagtcatggcaagagcacgtgcaacattaggttcaattgatctcagatccttcctcaccagtgtcgcagcaaattcattcttcaccaatagcttaagtctttctaggttcctagactcctatgtctcaggtggggttttttaatttatttttgtttttgttttaccccccaacattaatgttcctgagaggtgtgtttgttttgttttgttttgttttgttttgtttgagatagagtctcgctctgttgcccaggctggagtgcggtggcgcgatctcggctcactgcaagctctgcctcccgggttcacgccattctcctgcctcagcctcccgagtagctgggactacaggctcccgccaccacgcccggctaattttttgtatttttagtagagacagggtttcaccatgttagccaggatggtctcgatctcctgaccttgtgatccacccgcctcggccttccaaagtgctgggattacaggcgtgagccaccgcgcccggccgagaggtggttttttaattggtgagagggctggggggatcaggcaggggaggttgcagtggcattggagaagacaatgcctaggggttgattagttaccactactaagggcctacagattcatttgggaaaaattctatggaaaatcaactggaggaaggtttcttccttggggagggtaatgcagggtgcccatgtggacatgcatgtgagcatgtgcgtgctgtgtgtaggctccaattacccttcaaatgctaatcttctatgattttacacattgataccatgaccaaaacatgttaattacacatgtgcacagatcactggaaaatgtatatcgctgaagacttagtttcttccatgtctagagctcagtttattaatatgttgttccatataacaagttcattaatgttgctgatttttaacatttagaatattaatagttctgagcatgatattttgatctttcctcagagtgatttttgaaaatatgaaaaatgagaagagaagtagttacctattaacttgctgaagtctgacaggaacagttgaccagagtcccctgcaagggctcttgggagcactgggtaccgagcagagccttcatccttgttaattaaccgtccaacattgagacaggacttctgcttagaataaatggcttgttagaaaacagagctacacacatacacagaatcttttcattcacggataactgagtgttttagaaaatccagacttttctaagactttccaagttttaatttcaaatatattttccatgtttacattataactgaccatgtgtctaaatatagctagtctatactatatgtattctaattgcttgatatggagcctgcagctgagtacttgaatccagcattcacagagtgatacagtgtatgaaaaccttttacaatattttcaaacaaatgtaatgaataataatgatttaaaggtcataactcttagctattcttatattttatgacattcctctgcaaggcaatatgcattaaacaatggctaaacattaaaaatatgttttagaagattttaaaaataagaggcatttcagatctgcagaaaatcctcatgtgtcatattattttaaagaaatgctggaatgcaaatatgaattgacctatacttgattatctgttttgatttcattattcaatgtcttcacatggaagatcttgacagtccaacaattcgttttctgttctcttttcagatttttttttaatttggaaaaagaaaatggcattttatttcctgcttttatggactccaaagtcataaaattgtaaagaggagaaaaactgtcaattttttaaaggttaaatgcaagaaaattagagtgcctagaagagcagactctggattcagtgctgaaaggtagatagcgctggaaggcaaactcaaggctgagtattgaacaaaaagattgagcaagggtaaatatgcagaagcagccccggtgaaccattccagtgatttcctttgcccatgtagttgcattgagttgcactgaatgtgtgcagcctttttactgcatagtagaagaatggcaattgtgtttttaagctgaccattaactttagagggaaagctgccgaaaggcaaaattttccttcccttctgccctcaatttttcctctcaaggtgtaggatggaagctttgtagttaagaaaaatctcagtaggcctgtcagaaaaactagattctaattgctgagtgtagcagagctagcacagtttttaatgtttgcacagtagaattagttaaagcaagctctgcagatacaggtttccatgtggggaacacatgatgttctgaccgacaagttgggtgtttttagttccagacattgcttgaaacaatagacaccatgggtgaaagaaagaaagggggacttatcactgcagaacctggcacgcatgaagaggatttcccccggcccagtgaaaacatgggcctatgaatattttcaagaaaagattttcacttaactctctctgtaaaacacagttgttggggtgtggtatggtttggctgtgtccccacccaaatctcatcttgaattgtagctcccataattcccatgtgtcctgggagggacccagtgggaggtaatcgaatcatgggggtgggcctttcctgtgctgttctcatgatggtggataagtctcatgagacctgatggttttataaagggcagttcccttgcacaagctctcttgcctgctgccagtaagacatgccttcgcgtctcctttgccttctgccatgtgtgaggcctccccagccatgtggagctgtgagtccattaaacctgtttcctttataaattacccagactcaggtatgtctttattagcagtgtgagaatggactaatacagaaaattcatactgggtagtggggtgctgctgtaaagatacccaaaaatgtggaagcaactttggaactgggtaacaggcagaggttggaacagtttggagggatcagaagacaggaagatgtgggaaagtttggaacttcctagagacttgttgaatggctttgaccaaaatgctgatagtgatatggacaataaagtcctgaggtggtctcatatggagatgaggaacttgttgggaactggagcaaaggcaactcttgttatgttttagcaaagagactggcagcattttctccctgccctatagatctgtggaactttgaacttagagatgattcacagaatctggcagaagaatttaagcagcaaagcattcaacaggtgatttggtgctggtaaaagcattcaattttatgtattcacgaagatatggtttagaattggaacttatgtttaaaagggaagcagagcataaaagtttgaaaaatttgcagcttaacaatgtgatagaaaagaaaaacccaggctgggcacagtggctcatgcctgtaatctcaacactttgggaggctgaggcaggcagatcacgaggtcaggagttcgagaccagcctggccaacatggtgaaacccagtctctacgaaaagtacaaaaaaactagctgggtgaggtggtgcacgcctgtagtcccagctactcgggaggctgaggcaggagaattgtttgaacccaggaggcagaggttgcagtgagctgagattgagccactgcactccagcctgggcaatagagggagactccatctcaaaaaacaacaaaaaagaaaaacccattttctgaggagaaactcaagcctgctgcataaatttgcataagtaatgagaagccaaatatttatcaccaggacaacggagaaaatgtctccaagacatgttagaggtcttcatggcagcccctcccatcacaggcctggaggcctaggaggagaaaaaatggtttaacaggctgagctcagggcctggctgctttgtgcagtctcaggacttggtggctggcatcccagccatggccaaaaggggccaacgtacaactcagaccattgcttcagagggtgcaagccctaagccttggcatcctacctgcagtgttgggccttcaggggcacagaagtcaagaactgagctttgggaacctcagcctagatttcaaaggatgtacggaaattcctcaatgtccaggcagaggtgcactgcaggagcagagccctcatggagaaccactgctagggcagcacagaaggaaaatgtagtgtgggaggtcccacacagagtccccactggggcactgcctggtggagctgtgagaaaagggccaccatcctccagaccccagaatggtagatccaccaacagcttgcacggtgcacatggaaaagccacagacacgcaatgccagcctgggaaagcagccaggagtggggctgtaccctgtaaagccacaggggcagagatgttcaaggctgtgggagcccaccaggtcatcagcatgacctggatgtgagacatagagtcaaaggagatcattttagagctttaagatttgactgccctgctggatttcagacttgcatggtacctgtattccctttgttttggccaatttctcccatttggaatggctgtatttacccaatggctatacccccattgtatctaggaagtaaccaacgtatttacccaatggctgtacccccattgtatctaggaagtaaccaacttgcttttgattttacaggctgataggtggcaaggactagccttgtttcagatgagaccttggactgtggacttttgagttaatgctgaaatgagttaagacttcaggggactgttgggaaggcatgattggttttgaaatgtaaggacatgagaattgggagggctcagggacagaattatatagtttggctgtgttcccacccatatctcatcttgaattgtagctctcacaatgcccacatatgtagtgggaaacacccggtgagaggtaatggaatcacgggggcgggtctttcccacgccgttctcatgatagtgcatgagtctcacaagatctgatggttttttaaagggcagctgccctgcacatgctctcttgcttgctgccgtgtaagacatgactttgcttctcctttgccttccaccatgattgtgaggcttctccagccatgtggaactgtgtgtgcattaaacctctttcctttataaattactcagtttggggtatatctttattagcagcatgagaatagacaaatacaggctgtttcagagcttagtgtgtcctgctgatgcttgcacagtcctttggaaccatctgtgccctgcagtgagtcctgttccttttttcatattagctctgaaaccaccctttacaagtattttcaaactatctgaaaaacagcacttgattttcctcagtgttacagatgcaggaagccatcaaagtattatttgtttcaaagctctatgaatttttaggcaaatgtcactctatgaatttttaggcaaattcaggcaaaaaacaagtaaattctcatttaatatgccatatgtttctggtgcctaaactcctcttggagaataaaaggaacctttagaacactgtgtggcctcccacactcttcaaggcacttaccttactctcgaggaataacagagacatctaggtaatcttaattaattactactgacaggatgggagagaagtgtgtctaaggcacttatcagtatcatcaacagaattacatttagaaaatctgctctgtataggaaattgtgctccatagtgccctggggaaaataacaataacatatgacacactgcctgccttcaaggaaattattatctgggtgaaaataagatagacacctgtgaaggtaaatagcaaaacgggtggtatcagttacctgcaaaatgagaggtacgaggaagtaatccagaaaatcagagtagtatatcaccccagcattggaaaagacattaaaagtcttctagttcagtaatttactgatgcttgagttcacttgcaacataagagttcacatttattgagtattattattgcagacattgttcaaagtattatgaaaatacatattgaaaatatatgttcattgtttcacataacattttcatgagctgggattgtttacaaaggagagaattaaaaatcagaaaacgtgaataatttgtccaaagtcccatagtcactaaatgatagggcagtggttcaaactcaggtcttccctacctagagccagtgcccttcatcagtgtaagatagtcatgctggcctctccagtcatggaggcccagacaattcccagtggctcattccatcacagggagatggggagaatagtaagggtttcatagacttgaatgttccagaaagaaggaagtcaaaaagttaaaattaaagaaatactaattaatattttaaaaggcaaattccaaaccacacatgtaatctgtagaatgcagatttgtacacctttgagggaactcaactttcaactatcagaatcagtcctgggtagctaggatgatggtttgagaatagtgttatttttcaagatctttgcttctgtgaaattttaaaaggtaattgaaatattgagaagcctatgaagaggtgaatttaatataatccacagaatgacaaatgtacatttagaggatttaaatttaggaatgatgggcaactgatgcaatggttactattggccgtttgataaaagttctttggttttggaatttatttagtatccaacaacatcttttgctaaatctatagctctcccttgagttttatcttttctcttgttcattggtttatttaatttcaaagacaattacacacgccaaagtaatgatcctacagatgtataagtgtatcctgagatgaataaattatggacattttggtaattagcaaatggaaggggagcagctggatgcttaacacagatgggtttattggttaaaataaacttcagtttgcctttttttcaaattaagcaatattagccccttttgttgctttgtgaacaatcaaccaaacagcataattctagatggattgctctttgattgccattgctaaatctaattctaatgatttaattgtttttaatttctctgtggcctatatgtgtgggctgtgtccctgtctgtgaggcttaaaatctgaggaaaaacatgcttcatattctcatgagcaaagtattcatatgtgatctggattgtagctttgtgccaagcttcttctacaaatgagaatgaaaggaaaatttgtcgaatacaattttaccctcttaggtttttctttataagaaataacagttcagtgtgattatgtaaaatcattgggaatggggtgatccagtgttttaagaatacgtgtgtaaatataaaagatagaattattgattaaaatatccttacaaaataatcatgtcacttcactgcaccaaatggcgatggatcacccccttctataaaagaaaaaacaaaacttccttgacagcgcattaaatgtcttgcataatccgaccacagtcacactgacttggactagatattggggaccccaagtgatacaatgcatgcaaagattgttgaaggagccctttggatctgggttaaactgtgacccagcacatgctagttgagcagcctcaaacacgtgaattaaactgtctaaatgtggttttcctcactgaggggggataataatgctacctttcctacaaggtcgtaagactagatgaaatgataaaaagggcttagcacagtgcttggctttatgctccatgcgtgatctacttacctttcgtttctgtattgttgctgctgttgtaacttttattatctgacctctcatgcgtatttgcacctgaagatctgtctagagtgctcttttgtcatctgaatgatcaaattccataaatctttcaggactcagctcatcggccatctcttccactacattttgccagtcttccctagctaaaagctaattcttcttctataaaagcattgcaattcttattgtcagtgacagtcatttgtacttaatccttacaggcttctttaggtatttatctcttcatgtacttctcagtgagatagcagactccttaaaagcaggaactgaggcaatttctacatatcttttgcagtttctggcagaattgcaagcaatgaatatttgttgttttattattttttatccttcatggttgggaattatatgttgttttaatcaacactcaacaaatccagaatgcctcatcattagatgaaatggccagagttaaatggcaacctaatctgatagctcacatttattaaacattactgctaatgttttttatgtcccagacactggttctaagcacttcataagttttattttctttaatcctcttgcagacactatgaggtctgtattattttaattattttagatcagaagataataaagcacagaaggttcaaaaaaatttttccaaggttatatagtcagcttgagattgagccagggtttaaatccaggcagactaagtccagacagagaccatgctcttaacctctattcaattctatctatccattaatatattcagtcatcttcttaggttcttttcaactgggcaaaacccataaagctgagaaataactatggcagatgtcatttttcatccttttagggggcatattatgtaaatatgcctatttacataataaaaaatcaagtctatagataatgagacaaaatattttaaattaagactgccttggcaaaaatctgggtacaagatgaaaataaaaataggtaacacattttgaggtatcaggtattaggctgataaagtgaattttcatattttggttattactgctgagaaagagaaaaacagcctctggcagctgggagctagcttggcattatgagctgggccttgatgttctcctgtgcacataaactatttcacagagcatcagcgttagcatcagctaggaccactctctgaccaggatggatccaggcaaaaacatcaccactccagaggcatgtctgaacccagacagaaacaagaacattttccaaaccacaaaattcaccaaacatcctcttatcctggctaaagtgagaggctgctgctgctttaccagtgatagctttagccttctctgttcctcctgtcttctggatgagaattattaagatactgagtcacaaaaatgccactgctcctgaaaagcatcccatccagaacaaagctttccttctttgagccttttcctaaatcacttaggataaaccccaattctgccagttctttctaatattctcttactgatgtggcccccagatccccatgatgtgagttgccccgcactggaacatttcaataaaccagttctccaactacaagtttcctggtgctgtgaatctggagagcattaacactattattatccttatctcagcaatgaaggaacactgagtaaggtcaaaactactgtttgattctatatttaaacccagtttgtctctattgctgtcattatttttgtttttgtttgtttttattacgtaggctccggaaactgctctcttaaccactacgttatacagctcccttatggttactgcaaacacagataaataataagatgagaggaagtgaccgtctactgcattactatcacgtgctacctaaattgatatgtttttctaatttaaatctcacaaccctttcaagcaacaatccttcttttacagaagctcatttcagctattaaagaagtccatatttaaaaatatgaagtaatttccctttataacagaagtctcatgactagcaagttttgaattttaattccactgtctcaggtaatatactcacatgcttacaccacattggaatagttattatctggaaaggagctgaagcaagcactgtcttagagcatcgtctggtctggtattgctccttatttcttggtaaggtccagcaagaaacacatgatcagaatgcaccttctttatatttccaactgctgtttgttctttatcacaaatattagaattggggatgccttatctccttctttattatctattgagattgactcgattttgagagtaggtcaattatcacgatagaacttttaatcttatacatataatggctctgactttaaagtttctaaaagaaaattgagaaaatataattaaatgtatgtttcagggaatggggcctgtctaacttatgatatcaataaatgctataataaattatccttattctaaacaattgctgccagtcctctgaactatggcatgacgataactggagtatcttgggatcctggggtgcttctatcccaagagtatgtgaagtcctgtttcatttattttatatttttctataccaaaatcattttccgaaagactacaagaagaagaaaggaaaacaggaagacctaccatctcagactcctcatttttatgtgataccaactttcaaaataagttctatttaggtgatagattgtttggtgaaaaactacttaaaactgtatttgagcaggaattctttgtgataccaaggaggactagatagatatcaagtaaactcctgatttagagatgagaactagatagatattattaagtcaactcctgatttcagagatgagaactccatagatattattaagtcaactcctggtttcagagatgagaactccatagatatcattaagtcaactcctgatttcagagatgagaactcaatagatagcgttaagtcaactcctgatttcagagatgagaactcgatagatagcgttaagtcaactcctgatttcagagatgagaactcgatagatagcgttaagtgaactcctgatttcttacagtctctgctaatctgctcactagcatggctaaaggaaatgttgaaattttaactagaaagaaagtatttgactatttgaattttcatactcttgtttaaaatgaaatagtagtaaaacatttgggaaatgtaattaaaattctggttctaaacatcttcatgaagatgacatcattagttatgccagaattcctggactgatttttcagattaagtgttgtcattaatgggcatcaatctgtattgaggaggttttttttcctgaaaatataaacattacatacattatgagtgacaacaaatcttcatgtcatatagagaaccatttacacttcatatctgtgaacattcatgtatatattgaacaatgtaattcttaatgaaatattgatttctaagtgccatttacttataaaacttgagtcatgatttcagtttaagttggacaacaaactccaaaagaaaccctgcagccagtgtgtctcatgttttaggaagtgcccaggcagctatgtggtattttttccaacacagagcactcaagatccaggtcctgcagatgaaatttgtagccttaataaacatatagggttgttgaacagtaaaggggtttatttgtacttttatgagtacatttttctcttttgtttactaatgaactaaaatttttctgcatgaaaaagctcaatatagatgtagaaatcttttagagacatgacaaaatgtactacgtcagagccaccagtactcacgttaagtagacagatcacacagacagcgatcagatttcacgttcaagagttcatcttgagttaccgttctatagactcagaatgaagatcacctcgcttattaaaggcaataaaagataaagaaaataggaaataagaaagacttgattaaatggccatttcactgaattcagcatgagtcctgcacaaattagacatttagattaacagcttctttgattattagaaagcctggaaaatggggtctgacaggattatagcataagctcatttataatgattcattttttggaatgtagctttttcataagccaaatagaaattacacatacaaattcatatttggaattttgttcttatttttgaattttgcctatcttttcaggtgtctgtgaactcaagagaagcctttcattctagacatagtagttattttctaaatcatctttaaacttatttgctggaatattgtgggggtaaagtgcaaacttccccttcaccatctgaaggtttgctaaaaatcaacaggcagaaggcgaattaacaggagaaatggcatgccaatttgtttgatcacagttttacatgaagaatgaagacccaaagacacatgagaaattgtccatttttatgcaacaccagaccaggcgatgctctaagacaggtacaacaaagtatggacatgcgtgtagaaatacgagtcaactaaagggtgtgatctactgctaataggctgagtggggacacccagactcttcctggcccctgtgagcagcttcctttccttctggtgtggggcaggaacttctctggaatggggatcttctgacccacagtcaaacaaggtaggtcacagtttctttatggccagttcttacacagaatggtgggggaaagttagaataatattcttaggttttatggctgtctttgggagaaggggttttggtttctctgacgcaccttagggaaagaaaatttctagtttctctgtctagcctcaagagagaatgaggctcagagacataagggcagaagaaagtcagggagggttttttgccactgagcttgcttctgaggccatctctgaggccttcactttggggtgtcattttatgagccccagcaatatctttctaaaaaatatggaaaaggcttaaaagactcaggccattttagagctatataaacttgtataactaagaatggagaattgttactgaaagatactaggtctctttttatactaaatttataatacagtgtagctccctcagaaagaaaaagtgaggttcattcattcatttattcacttactcattcacaaatgtttgttaatcacactagtctcctctcaagtaagtgaaagataacatataatatacataacaggccgggcgcggtggctcacgcctgtaatcccaccactttgggaggccaaggcgggcggattacctgaggtcaggagtctgagaccagcctgcccaacaaggcgaaaccccgtctggacaaaaaatacaaaaaattagccgggcgtggttgtggcgggtgcctgtagtcccagctactcggaaagctgaggcaggagaattgcttgaacccgaaagattgcagtgagccgagatcgcgccactgcactccagcctgggagacaagagtgaaactccgtctcaaaataacaacaacaacagcaataataataatatacacaacaaacatattttgaaggtgataagtgcaacaagagaaaagagtcgaacaaggggaatggagactgcagggagtaggggagggatagtatgagtagaagttcattggtgtagacaggataagcctccttgagaaggcaacactaaaacactttttttttttttaaaaaaaaaagagaaatttctgtggggacatgaaaggtattaaacttgtacatagaggcagcagccagtgcaaaaactctgtaggaggaatgtgatcactccaggaataagaggggtccatgctctgtgacaggacaagaagagggcaggaagaaattaactggagtgatagagcaaggctgaccgtgcaggatcttgcaaaccactgtgatgcgaagtcttgagcttttaattgaagagaaataggaacccactggaagtttaagctgagaagtgacgtgatcgctgctgaatttttggaggattattctggttttgtgttgaaacttcagtagatcaaggctggaagtactggagaactgttgagaggccactgaaataatccaggtgagatacaagggtggctgcaccaaggttgtaactgtggagggactgatatgtaccaggtcttggatacatttaaaaggtaaaagcatataggttttcctaaaaaactggatatagaagaggtaagaaagatggaggagtccatcatttggcttcaggaacaagaagaatggatttgccattaactgcgatgggtaaaactgtgaaggaaagcaaaatatttcacccaaaatatatttctttggcatgcttcaagatggctattcagagaagctgcaaaccacaggaacagatttggaaagttgtcttttttatggaacgtttgcacatgtagagaaaaatctacagcaaagtaaatagcagatacaaaaagtctttttctaagcccacccttgtccaaatgtaggaaaaatacacaggagagaccaaaagtctaatatttttaagagtctgatgacaggcccccatctattctttttttttttttctttttttttaaagattgcattttgctatgttgcccaggcttgtctcaaactcttgggcctccagtgatcctcccaccccagcctcctgagtatctgagactatagccttgcatctgttctttttgagagctagtgcttcatttgcataacaagatcagctctgattgacaacatttcctcccctcattctcccatagcctgtgaggctacctccctggagctcacagaaactttgtcctaggccgttgttctttgggctcattcatttcccctgaaaattatttacttctgcattccccatctctgtcctccccagtgaagagggcatttaagccagacaaggacaaaataaaaaaataataatggccagtcacagtggctcacacctgtaatcccagcactttgggaggccaaggtgggcagatcacgaggtcaggagtttgagaccatactggccaacatggtgaaaccccgtctctactaaaaatacaaaaaattagccaggcatagtggcaggtatctgtagtctcagctactcaggaggttgaggcaggagaattgtttgaaaccagaagctggaggttgcagtgagctgagattgcaccactgcactccagcctgggccacagagtgagactctgtctcaaaaaaataaaataaaaaataaaaaaaatcacaagccaatatcattgatgaacttagatgcaaaaaccctcaactagttagctgaagtcaacaacacattaaaaagatcattcaccatgattaagtgggattcagcctaggaatgcaaggatggttcaacatatgcaaatcaataaacaggatacatcatattaacagaaccagaagcaaaaactgtatgattatttcaatagatgctgaaaaaatattcagtaaaattcaacaattctttattataaaaaccctcaataatctggatagaaggaacacatcccgaaatgataaagactatatctgacaaacccacagctaacatcatactgaatgggaaaaatttgaaggcctttccccagagatctggaacaagacaagaaggtccactttcatcatttttattcaatgtaatactgcaagtctgagccagggcaattaagcaagaaaaagaaatgaagggcatccaaattggaaaggaagaagtcaaattagacttgtttgcagatggcacaatgttatacttagaaaaacctaaagactccagcaaaatcagttagaactgataaatgtattcagtaaagttgcagaataaaaaatcagcatacaaatatcagtaacttttttatttttctgaggcagggttttacaaatgtcacccaggctggagtgcaatgatgtgatctcagctcactgcaaccttcacctactgggatcaggcaattctcctgcctcagcctcctgagtacctgggactacaggcacacgccactgcatccagctaatttttgtatttttttgtagagacagggttttgccatgttgtccaggctggtttcaaactcctgagctcaggtgatttactgcctcgcaaagtgctgggactacaggagtgagccactgcatctggtcaaatatcagtaacagttttatatgccaatagcaagcaatctgaaaaagaaatcaagaacacaatctcatttacaacagcttcaaagaatataaaacacctaagaattaatttaagtaaaaaagtgaaagatccacacaaggaaaactatgaaatactgatgaaaaaaattgaagaggacacgaaaatatggaaggatatacagtgctcttggattgaaagaagtagtattgctaaaatgaacatactcaaagtaatttacagattcagtgcaatctctatcaaaatatcaataacagtctttacagaaacaggaaaaaaaatcctaaaatgtatatggaactacaaacacaccaagtagccatggcaatactgagcaaaggaacaaaactggaggcatcacattccctgactccaaaatatactacaatgctatagtaaccaaatcaacatggtactggcataaaaactcatgcatgcactgatggaacagaatagagaacccagatatcaacccacacatttacaaccaactcattttttacaaagtcaccaaaaatatacaatgggtaaaacagagtcttttcaaaaatgatggtaggaaaactggataaccatgtacagaatcatgaaactagacccctgtctctcactatatacaaaaaccaaatcaaaatggattaaatacttaaatctaagacttgaaactataaaactaccggaagaaaacaatggagaaatgctccaggacattggtcagggcaaatattttttgtgtaagatctcaaaagcacaggcaacccaagcacagttagagatacagaattacatcaaactaaaaagcttctgcacagcaaaggaaacaatcaacaaagtgaagagacaatctaaaaaataattaaaaaaaaaaaatttgaggccaggcacggtggctcacgcctataatcccagcactttgggaggccgcggcgggcggatcaagaggtcaggagatcgagaccatcctggctaacatggtgaaaccctgtctttactaaaaatacaaaaaaaaaattagccaggtgtggtgatgggcacctgtagtcccagctactcaggaggctgaggcaggagaatggtgtgaacctgggaggcagagcttgcagtgagctgagataatgccactgcattccagcctgggcgacagagagagactctgtctaaaaaactaaaaaaaaaaaaaatttgcaaactacccatgtgacaatattaataactagaatatataagtaactcaaacaactcaacagcaaaaaaaaaaaaaccacaataatccagtttaaaaatgggcaaaacatcttatcagttagttcttaagagaaaacagataaatggccaacaggtatatgaaaaaaatgttcagcatcactaatcatcagagaaatgtgatctaaaactgagacatactctcatcccagttaaaatggcttttatcaaaaagacaggcaataatgcatagtggtaacgatttagagaaaagggaaaccttcgtacattgttggtgggaatatcaactagtaccgccactacagacaacagtatggaggttcctcattaaaaacctaaaaactgagctaccatatgatccagctccattgtactgctgggtatttatccaaaagaaaggaaattagtatattgatgacatctgcatgcccatcttgattacaacactattcacaaagccaatcaacctatgtgtctatcaatagatgaatggataacaaaaatgtagtacatatacataattaaataccattcagtcataaaaaagaattctgtcatttgcagcaacatggatgaaactggaggtcattatatcaaatgaaataagccaggcatagaaagacaaatatctcatgttctcatgcatctgtgggggttcaaaaggtaaatctcatgaagacaaagagtgtattggtggttaccagggcccaggaaaggtagtggggagggaagtatgaagagaggttgataaatgggtacaaatatacattctgacagaagaagtaagacccagtatttgacagagcagtagggtgactatagtttacaataatctaatgtatacttcaaaatagaagaaaataatttgaatatttctaaaataaagacaaatatttaaggtgatggatagttcaattatattgagttgatctttacaaattttatcaatgtattaaattatcacgtgtcctgaaaatatgtacatctattatgtatcaatacaaaaatttttaaaaaactattctgtacaggacaatggtctaaacacttggaatacaggattgacaaagccttctgaaatttacttcagaggaggaaatatatagtaaacaaataaacagcaaaatgaaaacctagagaccatgtgataaacagtatgaggaaaataaaactgagtcttatgatagcttctaatggagcgtcattgagtggggtgttattttaggttgagtgatgagcaaaggccctcaaaagatcacattgaactgaaacaatattgtcctaaaaaagagtaagccatggcaaattctagagaaaaagatttccaagcagagaaaatagctagtgcaatggtctggaggaagcaagaagctcagtatatttgagaaaaggggaggccaactgagctctggcacagagaatggaggagggtgataggagatgaatttagggaggcaagaaagcacccaactctgcagtggcctgtgggctgtacaagcattttagatgccagtccttggaggagtttccaggctgtgataagaccttatttgtgtttttgacagaattggacagaagtcacatcagggagaccagagactagagtattgcatcatagaggaaagacactgatgacaagacctcaggggagcagtggaactggaggcctgggagcttgggacgtgttctccgggtgaagttggctggccagctgatgacctacaccagtgccattcactcctcatgtgtcccccgggaattcatagtgtgtgtcatcaggtaaaagcaacactactttcagatgttttctgatctctttgagatctggacaacactactgtgtacatatggccagcaacaaattacactcaatgaatattttagagagcagcaaagtaatcaattaaaatgtgggtaaacaaaaatcactgtgatcacagctctgtctacatggttctttggtaaaaaattagaatcctggggattagtctgaggataaatattatttaaaaagcattttggttaaatagtaattagtaaattttgctctgccgaaaaatcatatatattgacaataaattttgtcaaatttattaataaccagtctgaaactctataaagatgaatcctcaaaatatggatataaaagaagggtttagttttgttttattttcagacagctatttttaaaaaaatagtaaaaatgtcaaaacaatctggttttattttattataaattacaaagaaaaaaatacttccctttttgttgttgagcttatctattcacaaacacagaaagtagcaaaagaggtttttgatagcacgccatcccccatttaaaatacatttaaagacatccaataatcatcatcatttagaaggaatccatcaaaacgtttcctattaatactcattttattagttcagctgaatggaaacagtagcatgcttacatttaagaaagttcattatgggttcgttttctttttaacaagaaaggggaaacaaaataatgcccaaacacacagtgttgctggagtcaaaacaaagaaaattcatcaaagcatctatgagagctatcctgggataatctattctagagaagacaatacaaattggctgcaattgacaggtcgtaagttcctgggggaaagtcattataagcacatcatagcacatttggccgattgctcagtgttccacacactgacatcaagaacacatttccaatccatattctgattggttaaatgtggtttaggcagcctttcagctttcagagaaatggtcaaattctttcttttcaaaattcccaggccaagtcataataatgtactgatctcatggaagtattcctgcagtaatcacttcgagttccttcgttgtgcctccactgctctttcattcagcaattgccgttttgtgtgttatcatagaagaataacaaagaattagactcatgactctgaacagaggcttgctttttacatgagtattattatttcatccttggaaatcctggaaaacttcttactattttggatactaggtccagagtctgtttgtttacagcatggatgctgactggttgcagtcagagggtgatatgccagtgcgtgaaggaaatagggcaaaatgtaaacattgtacgtttagtagtgctctttctgcaggcaaggagagattgattgatttctcaagtgcaacttgtctgggggaacatgggattttattctattttatttcatttcatttcatttcatttatgtttgagacagactcttgctgtgttccccaggctggagtacaatggcgtgatgtcggcccactgcaacctccgcctcctgggttcaagcaattctcctgcctcagcctcctgggtagctgggattataggcgcacaccatcatgcctagctaatttttgtattttcgtagagacgaggtttctccatgttggtcaggctggtcttgaactcctgacctcaggtgatctgcccgcctcggcctcccaaagtgctgggattacagatataagcctctgtgcccggccaagcatgggattttacaatagcatcgtaagaaattctatctttttccctgagtattcaatttacacccatgtttcgaatgagcagtgagcaccagcacggagatcggagccccgtgttacttgtacgtgaaggtgtcagtgcctgagtgtgctagtgctgctgatactcacaccaaatagcaaacaagagccggcaatctaacctgttaaaaataataggcaaatgggaagagaggactgaggaatctccttgaagtttcccttcactgatgggtgctaaagatgtatgccttggggttttttagatgacatcgatgtaatccccttcaaaaatagtgacggaagaacagacttcttcaccttattaatttcctgcggcatcaaagtccctttgagagtctttctgttccaatttttcctcaagttcacaaaatgttggctgtcagcgttattgtgggttaagacagaaggtcctcctttcctgaccccagagatcccagatcatcccagtgtttgtttattttctaaaatgtccattttgcttagaaataaacacaaattggtgacatttattccttgcactatcttctaacaatttattctaggtttactaattctcatgatgttctgctagagaaatatgaagaggcaatttacttgtgtagaaatgtgagtcaaatcaagtgaatattatcattgtcagattcagcatttatcagtcttccctcacaagattcagagagttctttttctgttcagtttggtaataagagaagttataatcaatttggtcataaaaattgtgcaaaattagatttttttattccactttctgctatgaaatattcttttgtttgttagtttgcttgagaccgtgtctaattctgtcacccaggctggagtgcagtaatgtgttctcagctcactgcaacctccgcctcccgggctcaagtgattctcccaccttggcctcccgagtagctggggctacaggtgtgcaccatacgcctggctaatttttgtatttttttttttttagagacagactttaaccatgttgcagaggctggtctcaatttcctgggctcaagtgatcctcctgccttggcctcccaaagtgctgggattataggcgtgagccaccacgcctggcctaaatattctttaaatatgtgtgactttggaggaaagggaatcggatgggttaaaatatgtgaagttcattgtcaactgttatccttgagaaatatttaagcttcccttaatgttgtgtcttaaatgacacataataatccaggaagggatttttatgaccataatgggtttttagcttaattttaggtagcaaagagaaacatctgctatggaaaaagcttaattgatttttatctgatgtcacgaagctgctacgaggcaccatcaccagcaggtgggtgctgattacgccctgtgccgaggactccgttttatgaaaaacatcaatcctgccatctaagaggagaagacatgctcaataagtttatctctgcctccctacccatgttcaacaaggtatcccagaagaacttaaaagctatttactctggattataatagatcctcttgacattctgtaactggtgaagccatgggagagtcctggcttaattataaacaaccacaaagttatcatcagtgctacctggctacaaattgtttcttgcagagaaaatttttagctatttaagtcccacgaaagtaaatttgggggctgaaaatttttaataagtatttaaacagcagaccttcaatttctctagacccagtgaaaacagaaaacaggatggagtatttgcttgccatgaacctttcctcccacaacaactgtgcattttaggaagtcagtagtaactagcttataaaatacagagctctggaaatcatatgcctcatcagactgtagctaatggggaagacacactacttcctgtatttcaaacaataaaaaccatgatgtaataaagagcaagtttatcctgaggatagaaagtagcccttacataaatgagtaaatcagtaaaataaaacaaaaagtacccctcaacaaataaaatacttttctttaaacttataatttgggaaattatcttaatgttaatcactgcttaataatttttaattagcatctgcaaaaatgtaatttaattttaagttagagatttcttggtactttaaaactaattaaatatttaattatgttgtttgatacccacatattacataagaaatgtcagtttatttgttaaatgtctcacactgaaaatctcggttagcacattcttttgagttttatgtttttaaagcaatatttgcaaaagaatttctcaaaagaagtcagtactgtttctggacagttcatgaatcatctaatggaagatcttagagctgatatttgtaccagaaaagatgttacacctaaaggtgctcattactttattcaatggacaagagaaataaatattatcttacaggtattatagaaatctttatctatttcactttctctccctgtcctagataaacccacacacacacacactagcaatgtaaaatccaaatatatttttattcaaacacgttaaatcaagcaacagaattctagtacagttttgctgtattggtcatgtctggcatacaaaaaatgtttaagtcttcaaaattattctggtatcatatctgtgatcccaatactcaactgggtttctataaatataccagtaaatattcgttggctactaactaggtgtctttttttgtgctaagatttgtgaaggatgagaaagtattctggagaggcatactaaacattataaacacttcctgataataatttctaaagcacgatcagagctgtccgtcatcatataaagatggttaaaaaaaaaaatccgccaggcacggtggcttactcctgtaatcccagcactttgggaggccgaggcgggtggatcacgaggtcagaagatcaagaccatcctggctaacatggtgaaaccccgtctctactaaaatataaaaaattagccgggcgtggtggcgggcgcctttagtcccagctactcgggaggctgaggcgggagaatggtgggaacccgggaggcggagcttgcagtgagccgagatcgcgccactgcactccagcctgggcgacagagcgagactccgtcttggaaaaaaaaaaacaaaaacaaacaacagcaacaacaacaacaacaaaaatcaccccataacaatatgctacaccatatccaggtgagaaaaatcaacaatgaaactgattttgcaaaattccactgtgccttctatagtcatcttcaaggtctggggttattgacatgctgggagaatgaacctgatattctgtttaatgactcagatattgtagacatatttcagacacagaaaaactactataccaatacatttaaaaaaaaataaactgtattcaggatttgtgatttttttaggcccatcaagagcaaattataaatttatttcaataaggattgcatgaactttgtggttttaaaattaagcttttatagacctgcttattaagataagcatattcatccaagattaaacataatatttccagtagaatctttgctccatctgaataatgagttaaactcagaattatagcaactttctgtagcatttctgatcttaacgcatgcaagtagatatctctaaaatatatttgaaatgggttagggacctttcattatggaatggctaggcagaaaaggactatttttgttacataccatttcctccctaacataatggtgaaatacaaactttaccaggtcgatttttgttatgcgggaaaccagtgtttctgcaagataaaaatgaggaactaattgtttatattagagccttaagactgatgctattttatatgcaaatttactagagcaatttgttttacatgtgtattacgtcaaatgaatcaaattgtctgaatgggtgaaactacgaatatagaccatttcattctatttgaaaataatttgcaattccgcattttatacaaatctaattgaaatataatcatgcctccgtaaaacagtgataaacttaatatatgagaacagttgttatgtgccaataaaatatcaaaaccaagcaaattatagaatagttatcaggatgactgtaaaataacataactagctctaaagctgagtcaaaaataattatttccgctgtaagaagggccatctagtagaacaaactacattttctgactgcagattgtttctttataaaatgacaatagcagattgtatcgagttggaccgtgcatttagagttcagaaggctcatgattacctgagccagtgccagcctcaattctcaggcccacgtgcaggactaaatggtttatggcctgcaacaaaaaggcctatggccatttaggaagtgaggtgttcggttatcgttgcagtaaaagaggtaaaataatcttttttgaatgataaagtcacaagtcattgaaaactgtgtgcctagttattatcagctgtttttctttcctcctttgactctttgtggtcagtgctaatgtaagtctttgcttgaacaagcctgcagtgcaaaaatggtttccagcagtgactggcagaaccaggaccctagacagttgcattgcaggaggaatgagaaggcatcacaaaatagaaagttctaacaccctagatggcattttgtgtcatcgttttctgtaagtgcctcttaatactcttggttttgttttgtgttttttttttttttcactataatctgttctttttcctttttttttcaattgaatctaacctaaatatctctatgagaaacttttgactcattaacaagataattaaatgatggagcagagtgaatacttttcactgggtgtcctatagtttgtaaatgcttgccctttcagtgagctttgaaatatttttaagtgtaacagtccttggtaatagctttacaatggggtgcaaatacagaagtcagtttacaagaaatttctgttctctttatattcacgcatctgagtccagaattctaaaagactgctcatcatcctacctataatacaaacaaggtgccctccatgttaactgcagaatcctgcagttacagtctagacacacgaaccttgcagaagggtgcatcggttactttacatactttgcataaacgaggtactaaaatcctcataattatccacctttcagaacatgtccgactcaaaatattggaagaacatttgagaagaatctacaggctagaatctttttgaatcttttcttttgcttgtttgttgtttgtttgtttgtttgttttcagttatttgggactttaatgttcctgagacaagaaaaggaaacatggaagcacgcacacttagaaatgagtctcagaaacggaaaatccaaccagctaaatcatcacagcactcctggcaaaattctctaatgataaaagttgtttgttttgttttgtttttctgatttttcttttcagacacattaataatctcttgactaggaaaggggaacccacaaaataagtccttcttcattcttgtgtgcagttaattttgtttctacatgtgtctgcaaaaggcaaagatgacctccaaagcagattctagctctatttggatgagtctgtgagttttggtcaatgaaaatgggcagaaatcctgtcacaggagagagctaagtagacaacctcattggaagttaaaaatgtatattgtcatgtcaacgcaaggaagcaattataggcctcatgccaactgcacatcgtctgtgtgagtccacgtctccaggattccgagtctgtgtgagtaagtgctgttcccacttcaggaggagcagtggagacaattagtaggaatgaagtctccttggtgtcagtaatatgaaaaaatataccatgatcaaataagcatgtaggaaaacacctacattttcaaattcaaaaactattggaaaacattaaactgagctttatgtctttacaatttcttttcatagcaatgcccagttaatgcgccattccacactttctgatttatcttcagataaatgagcttcttcagccgtttgcctcatgtgtcctccttgcccttagtagagagcagcacataggatgttttgatagactttgtttgtggacaaatacaagcaaagcagcaagctgaggaaagccatcattgcttttaatattttgtaaacaataggacttgcttttatagtcatattaataaaagcaaactattcttacagttcagttaggctaggattagaccaaaacaccaaacaaaacagctgaccttgcaatgaaaatgtaggcgaaaatcacgaatttgagaagagatgtttaagaaatatttttaaaataaaattgaaaaaatggaagagtaacttgtagcaagtgctctagtaaaaacttcctctgtatacacgtttgaagtatacagatgaacccagtagaaagagagcttggaggtgacgggagaaacctgattattacgataataataaggtcctaatgagacaggaagggaaagatcgaggggctgattgagcaggctgttggtttaattcttgcttctgcagccattcccatcttctggaaggaggcaaagaggttggttgtacatattacagtccataaaccagaatctatctgagagctgtcagccaatagcccattggaaccctaaagacccctaagtcctagagctagatataaatcctttagaactatatcagaaaaaaaaaactttcttatacattttctccatgtgagaaaaacattattatgtttgtgttttagcattggtttcacatctcaaaactttttgctaacatatggagtttgctttagttaataaaattaagtgttttttttacattaccagatgatataaaattcagcaaatacttttttatatagaaatggaaattatgctgtgttactatgtgaaatattaactgctcctttagctattcatctactggctcgggatgactcttattttaaatgctaatttttcagaatctttttgaagggtgttatatatgttattttatcacatggtcctgtgagatttgtatagtgtccataaaattgtgaagtgggcataggtttttttaagtatgacatataattaggattaaatattcacatgattatagggctattcttgcagatataaagccaggcaaattcccaatggataatacttcaagaaatatttgcatccttaacattaaatctgtcttactaagttaactttaaaattgctctcatgaccaattttgcatcctaaaggtaaataaataaataaatcaaaacatgacctaaaacataactaattgaacaagagaaaaaagtgtagaacacaaattattgatttcattttcatattttaactagttgttctttcattaataagtataatgtatatacaattttcccactgtttaattattcaaagattttaaaactgaattgaatacttcatgaactaaaaattataaaatctttattcctgaatagctggaaaacaaaacaaggaactttgtcttttttaatggcatagttctgtattaccttggtgactctaaactctatgctttattcaatttttttaattgttggagacaaggagaatcataatctcaacctgcatttacatagtgctggaagaaaagaccgaccgggaatgtgtgatctgtcacttggctttggaaacacttgaagaagttgcactaatgtaaaaaagaaacagaaagatttaaatctatagaatatactcattgcataaagatgaattcagcaaatatattgttgtgagcatcttctatggtgcagcgccaggtcctttatttatttatttattttatttatttatttttttgagatggagtctcactctgtcgcccaggctggagtgcagtggcgtgatctcggctcactgcaagctccacctcccgggttcatgccattctcctgcctcagcctcccgagtagctgggactacaggtgcccaccaccatgcccagctaatttttttgtatttttagtaaagacagggattcaccgggattcaccgtgttagccaggatggtctcgatctcctgacctcatgatccgccctcctcggcttcccaaagtgctgggattacaggcgtgagccactgcgcccggcctatttatttattttcaagacaaagtctccctttgttgcccaggccggagtgcagtggctcgatcttggctcactgcaacctttgcctcctgggttccaagaattcttgcgcctcagcctctcgagtagctgggattacaagtgtgcaccaccatgtctggctaattttttgtatttttagtggagacagcatttcgccatgttggtcaggctggtctcaaactcctggcctcaagtgacccacctgcctcagcctcccaaagtgctgggattacaggcgtgagccaccatcccaggcctagcaccatctccttcggaagatggaactccagtggagctcttactagccaggagcttagagcatgcatgcactttagaaaggaggtgtctatgtttctttcaaaattgttttccctcagacaattttatatcagagtgcttaagattttatgtaaactccatgagtgtaatgtcttttctttttaagaatagtaggaataacaaagatatagaatcaacccaaatgcccatcaatgatagactggataaagaaaatatgctacatatacaccatggtatatatacaccatggaatactacgcagggacatggatgaagctggaagccatcatcctcagcaaactaacatacgaacagaaaaacaagcatcacatgttctcgcttataaatgagagctgaacaatgaaaacacacggacacagggaagggaatgacacacacttggggctgttcctcatctagcacatccagtacaaagtatggaacacattttcaatatacgttttttggttttttggttttatttttatttttctgagatggagtcttgctctgtagcccaggctggagtgcagtggtgtgatctcagctcactgcaacctccgcctcctggattccagtacaaagtacgtaacacattttcaatacatgttttttggttttttgttttcatttttatttttctgagatggagtcttgctctgtcgcccacgctggagtgcagtggtgtgatctcagctcaccgcaacctccgcctcctggattccagtacaaagtatgtaacacattttcaatacatgttttttggttttttggttttatttttatttttctgagatggagtcttgctctgtcgcccaggctggagtgcagtggtgtgatctcagctcactgcaacctccgcctcctggattccagtacaaagtatggaacacattttcaatatatgctttttggttttttgtttttatttttatttttctgagatggagtcttgctctgtcgcccaggctggagtacagtggcatgatctcagctcactgcaacctccacctcctggattcaagcaattctcctgcctcagcctcccgagtagctgggattacaggtgcacaccaccacacctggctaattttttgtatttttagtagagacgaggtttcaccgtgttacccaggatggtctcgatctcctgacctcatgatccacctacctcagcctcccaaagtgccaggattacaggtgtgagccaccacacccagcctaataaatattttttgtaatgaaaacatagataagtaaatgagaagtgagataaaaataaaatgaaatgaggcataaatgcgtatggagtggagagggaaaaaggtcaggtagcagagggccagagatgagaggcttaggaacaccagaattgtatatggatacaactggggttcagccagctcctgggtcaggtgactgtgcagggagctgcttataaaagaggaggcaatagttctgttgcttttcttcatctcagaagaacagtcttgatacttaggtatgtttttggtagaattgttgtgttaataactcttctttaagggaaaagtatctttaaattattgccacattgccacgtgattgtgattaggagttttagcaatttcctaaaaaggtctactttcaaatgaaacatttggagaagtttttgttttcttttgtttctattgaaggaaataaagcgttgactagttattttcaagtttggggaaccataagtgcatatatttcctaaatgacataagagctcatttactgaaagaattaaccaaataaaattaataatccaaagaattgtcacttaatatctataatatcctgatacaactacattgcaaaattcaaaggctattttttacaactactttagtgagattctactttctgaataagttaaattaatgaatataatcttataatttagaaaacaaaacaaaaatgttctcttttcccaagaaatatacctgatttaatattttgcctctattgtacaaaaagtacaagtgtacttttgtaccatctttactcttaagggatatctggaaaaatattttaacaatcccaagagaaggctgattgcaaaaacagaacttatttctgcaaattctaaggtcctctctgtttgaattagaagtcctgcagccagccaaagcaattccttatagtctacattttctgttcacagatttcatttcccacgtttcctgtcttcaaatgaagcaatatagaacggggtaattgaacaggctttaggatcttccagtttgagttcagaccctgtctcattgcttaccgggatatgggaacttggcacctcactggacttcaggaagcctcagctttcctatctggtgtgtggcaaatgtccaaccacgaaggcagcacttcactcagcatccagtacagaggaaggatgtcagcagtgctgtagattgtcattacatgtttgctcaaccaagaatgtttccactgagtgaggctgattgggaaaaaatattatagggcggttcactcaacataacttctcaaatctttctgcttattgaattatattaaaaattcattttcactagtaatttgagtctcaaaatctgaagggctgggtgcagtggctcatgcctgtaatcccagcactttgggaagctgaggcgggcagatcatggggtcaggagtttgagaacagcctggccaatatgataaaaccccgtctctactaaaaatacaaaaactagccaggcgtggtgacgtgcacctgtagtcccagctactcgggaggctgaggcagaagaatcgcttgaacccaggaggcggaggttgcagtgagctgagatcacgccactgcactccagcctgggcgacagagcgatattccatcaaacaaaacaaaacaaaacaaaacaaaatctgagtcttctatgcctctcaaagaaatagcattcaagcttaacatagaaaacaaactcattgagggtgcataagcagacctgtatactcaggtctgaaaaagtcatctttctcttaagatgcttgcactttcttgcctgatttaagttatgttgaataatctcaaataatataagaaaaataactatttaaaaagtagagttatgagcagcggggtacaggagcaggaatcggcttggtgcttaaagaaatatataatctaattccttaactcctgtaaaataaaaccaaaatgtaggtactaagttcagttatatttcggaggctaacattagcctaacgtactgtgctgtaagacctggttcctaccaccacagaacaacgtgcagttagaatccagcctcgttttccctctctctctgccccatgagctccacctgactttttgaaaggccccctccctttgagcagaacttggttcctcattcaatccaattcccatttctttatccttcctcctgagctccgttttcgaaatccgtttttccaccctcccttgtaggtctaatgcctgttcctgtctctctacactgcttccattatggtaacctgcacagtcttaacttgaatttctttcagaaatataataattctgccaccgcatcacttctgtttgtttgccctaatcaaggttaggcatttggggacacctagattcaagggatgctgggaaatacgcataactgaaagacgcccagcaccgtcttgagaggatttgttcttaaaggaaaaggcacacatgtaacctgttagataaagagctgcctccaacaaagcagggaagaagagaagacaccgtgaggccatcttgctgtggcctaggatcggggtccccaggctgggtgtgagtcttccaggcctgaggactcaccttggttctcagggccagcctctgcggaggcacaagtcctgatagatctccttttgcttctggcacggatttctctgcaggccccttgcctgcgtccctggtccctcctttccagtctccttccttgctccctcccatcctatgggaagtcggtatcttagcagatgccacatacttgcctcctaacacatctgtgataccaaatgccaactttctggagcgcctatcttaaaaaaaaaatttcaatttttattaatttgtaggtttttttcatacagtaaagttaacttctcttctgtgtgcagttctatgagctacagaacagctcctgggcaatccctcatactgtccctcatgctctccctgacatcacctcctggtgacattgatgttctccacccctatcggtttgccttttctagaatctcatatgaatgggatcgtccagcgtgtacctttctctgtgcatcaatacagcaggagttggctcctctccctgagtgcacgtcagtttcacttctgctgttgcacctgtcaattgttcgtcctactcatgccactgcggggctccaccatggcttatttattcattcaccagctaaagggcatttgggtttccagtgtttggtaattacaaataaagctattacaaacattcatggatagttttttgtgggaatgtaggttatttcactggggtcaatgcctaggagtaggacttctaggttttttggtacatacgtatttaactttgcagtaaactgccaagttgtttttcaaagtaactgtaccattttgcatgtccaccattagtgtatgacatgcaaaatgctgtggctggagaacctttgcatctacattttctcctctctcaatggtccatcttgccctatcagcctgtctgttaacactacactcacatctctggtttgaaacttcatatctattatttaagttagcaaacattattcaggaccagctatgtgttaggttactcttcctggtgttataattcagtgatgaatttgagatttaaattccataaactttatagattgacattctggtaacacatgcatgcataattaaatggatagacagatctataaatttaaaaataaatttattttagaatctgcagcatccaacatagtagccctcagccacatgtggccattgctccgtgaactgtggccaatatggacgcaatgagctgtaagtgtaaaatgctcacgaactgctgaagacttaatataaaatgacttatgatttttacattgattacatgttgaaatgacaatagtttaggcatacagagttaaataacagtaaaattaattttactgtttcttttttaaaaatataactatgaaaacatttaaaataacatatatggtttgtattttatccatatttctatcgctatgcaccatttttcatagtgaggtgtaataccaaaaactcaaaaaagcatgctattacagagcggctgatgttacagccagataatacttttaatacaagagtcaggaaaagttttccgagaccctggcatgtgcagtccaatctggatgatgggaaagaggcaggcatgtgacggtccgagggaaatgtgtccagctgaagaaacaggacaagcttggtcctgaaagagcaatgaactctgggtgtttgaagagtcaaagaagccagtggggttgaagtggagtggtgaagagaagaccggtgggagggagcgcagagtggtctgcagaattcagagcctcagaaaacgtggtaggaaacatggattggtaccgagccaccactcttcccagggaactcttgcaatgtctcctaatccaacaacactccctttattcattgccgccctcaaatatgaagcatgactaccatttactaagctcctactaagtgccaggtgctgaccacactcggcactctgtggcttgctccagttggaattcaggcttcctttgccattggcagaggttctctcctgttagcatcgtttcttcacttgccctctgggatctgcattctcctggccctgtgtcatccattatctccctgtctagcaagttagggccaggtcaagaaaacctgtatctctcaccttcatagatttttgccttcacctttaccctggttgatatacgagatggatgcactttagatttttaatctaatctattgatgttggagctgtcaaaagacccaagtttcatgtttttagatacacatatttttcccagtagaacctctttgtaatcaagatgcttcttaaaatcagcagctgtcaagagagagttgtgaaactgttgcctttgtcagcacttgagcaagtgtgatcacaggttcattttctcagtacgtgagcaagtgtgatcccaggggttcatttctcagcacgtgagcaagtgtgatcacaggttcatttctcagcatgtgagcaagtgtgatcacgggttcatttctcagcacgtgagcaagtgtgatcccaggggttcatttgtcatgacttcaagtgagttgtgcatgttgcgtgttgtgatccatatgtggagttttgatacttaacatatctgcaaatagattgcactataatttgtctttgaaataagttattgtgtttacagaaagacagggacataaaactataatccataaagcacacagcaattttatattatataaaatataacagttgatattagtaaaaaagacactagccattagagaaataaccataatttgatattttcttataaatcatcaacagagagttttatataagacatctacaagtaaatgaagatatgctgcatttgactactgctatgcaggtaaaactactacctatagtgtgccaaaaaaaatagaactggaggcagggaatattgctcagtcccaagagagcaccctcttgatggcatatactaagcaaaagacacagccaccaagtcacaatgttttcttataaaattcacaatcaatatgaagatttaggcatacatttccagtgtttttggcttatagcattgtttatattccacaaaaataccatatgattttaaaaatccttatctaagtttagaggagctctttcataagtataaaattttaaaactggaagtgattaaaaaaagcatgtataaatgaattagcagcattatctctgctagtagtacagaaataagggtgtacctttcactatacagttgatccttgaacaacacaggtttcaactgcatggttccacttataggcagatttttaaaaataaatgtattggaaatatctttagatatttgtgacaattttcaaaaaacttgaagatgagctatgtatcttagaattatcaaaaaatgtaagaaatgatatgtcatgaatgcctaaaatatatgtagatactagtctattttataatttgccaccataaaatatatatgaatctattattaaaaagttaacacttagagaccatacacgaagccattcacatttgagagaaatgtaaacaaataggaagatgcagcattagattataacttactatattcgttactgaattcgtctgttttcattgctataaggaagtacctgagattgggtaattaactaaaagaggtttattttggctcacaagcgtcagcatctgctcctgatgaggccccaggaagcttccaatcatggtggaaggtgcaggggcagcaggcgtgtcacacagcgagagagggagcaagagagagagtggggaggtgccaggctcccttcaaaataaccagagctcacatgaactcacagagtgagagaataactcatcaacatgagggcagcaccaagccattcacgagatcatccccaccacctcccactgagggctcacctccagtatttgggcatccggaacctctggtgaggcccgcaggaagtttccaatcatggtggaaggtgaagggggagcaggcatgtcacatgcagaaagagggagcaagagagagaaggagaggtgatacaggttgcatgtttgttctctccaaatctcatggtgacatgtgattctcagtatagaaggtgaggcctggagggtggagactagatcacgagagaagatgcctcataaacagtttagttccatcccctcggtggtaagagagttctcgctcagttaattcatgtgatatttggctgtttaaaagggtctggggcctcccccttctccgtgtcactcgttctcttgccatacctcatgcctgcccctgcttcaccttctgccatgattggaagcctcctgaggcctcaccagaagccaagcagaagccagcatcatgcttcctgtacagcctgcagaaccatgagccaattcaacctcttttctttataaattacccagcctcaggtatttctttatagcaacacaagaacagcctaacacaggaggcgctaggctcctttttaaaacaaccagattacacatgaactcagagagagagaaattccctatttacggtgaggacagcaccaagccaggcatgagggatctgtccccgtcacccaaacacctcccacgaggcccgcctccaacatcggaggtcacatttcaacatgagatttggaaggggcaagccattcaaaccatatcagatacctactgtactgctgcaataatattattgtcgtctcccattgctactataatgagctcaaatatccacctacaacactgcgtgatgctaatcatctctgcttgaggaatttgtctttccagtaaattctgtggtgtagtgaaaagtgatttctcaaggttcttgtgtatttttcatcatgtttagtgcaatatcataaaccttgaataacaccatgtggcccttatgaagtgccacttgtaacgctggaagtggtcccaagaagcagagaaaactcatgacattacaataaaaagttgaattgcttgatatgcaccatcaattgcgctctgcagctgcggcgacaccattttaagatgaatgaatctggtgttagggctcctgtaaataaagaaaaggaaatttgtgaagctgtcactgcagctaaccaggaggtgtgaaaatcttgcacaaaaggtattttgtaaaatacctttttaatctcactttgaaatatagcatttatgagggtgcagaatggctatacaaaaggcatgtctatagattctaatatgatttgagaaaaagcaaagtcattgtgtgacaacttaaagcaaaaagaaggtgaaggatctaaaactggagattttaacgctagcaaaggatggtttgataattctagaaaaaaaggttggctttcaaaaatgtccagataacaagagaagcagtttctgccaaccaagagccagcagataagttcccagatgccattaagaaaatcattgaggagaaaggacatctgcctgaacaggcttttaatgcagacgaaagtgccctattctgggagagaatgccgcaaaggaaatttattagtaaggacgagatgagtgctgctgagccagtgccagacgatgaggaaggagatgtaggaaaagcagtcctggaaaacaaattggcatcagacagtctggcagagggttctgatgattcgaaagagcttttgtcttctttcactctatgggcactcctatgggctctgaaactacaaaaatcagtggaagaaggattgatacaataaagacacttttttagagaaatgaagaagaaaagagtcaggcagaaattacaacatagctccataaagttacatggagtgtgcctgcctctcctgtctcccctcccacctcctccacttcttccacctctgccaccccgagacagaaagaccagcccctccccgtcctcctcctccccctcagcctactcaatgtgaaggtgaggatgaaggtgattatgatgatccacttccacttaataaatattaaatgtattttctcttccttatgattaataatattttctttctctagcttacttcattgtaagaatacagtataacatacataaaacataaaaaatacggttaatcgactgttcatgttattggtaaggcttcctagcaacagcaggctaacagtagttaagttttggggagtcaaaagttatacatggatttttgactacatgggcgttggcacccttcaccctcacgttgttcaagtattagactccttgatgccaagatgtcaaatgagtctagagccatatggaaattttctatgatcaagagtgaacacttgtgtctctcaccttaaacattctctggccagcaggccagtaaggcagtggaaagatcaaaaggaggatttcccattggcacccgctcaccttacgctctcatcctaaggtcaaaaatcatccagtgattttcaacagcagtaatcatgccctcatgcccaggagccacggaaacaggggaaggaaggaagttggggtcacaaggacttgggcagcagaagatatttgttgataaagctgataaatgttttgaaatcccaaggacagttctgcataatgaagaattgtcccagccaaaatgtgagtaatgtcctgttgagaaacctggatattatgtgtggcttgagcttactttatagatgcagtcctcttacttatcaggaaatgctcaagatgcctgtgctaggcctgacctagctgagctgttgacttgaatgtgcagaaggaagtcctaatggtacatgagcacctctcacaccattcagagatttcctcagattggatcactctgtctagtttctgtcatttctaaatacttcaaaaagttacaagtaccaaaggcaggggagcatcggcagagatggggtcacagtgggtattctttataaaaattttgtctaatctgtaccacagacttggaagaaaggctttgttggacattaaggtgagcagggctcatgcccatacaggtggctagctaaggaaaacgatgcttcacagtgtcctgcctgtgagtcagcagggctggactctacacagcaatgtacactcggatccctgactttgttagcacattgaaaataatttagtctctcaggagtggatcacacaaatcatgatcactgacactcattgcacttcactttcagattgtccttgccaacagagaactgcattcccttcatggaggcaacctaagtgtaaagtcaccttattagaattaacttgacatccttcaccccactttgaacattcaaagatcaatataatttcgtaggataatcccactcctaggaatgcatttctctttattttgcctcatgaaaatcccatgcaatacttccttcaaagcaaaatgcaaaggctattcttttgaagctcattttattacttgatttgcttcaccctgaacacctaatgctcgtcaatagttccattcctgtgtcacttagcatggactatattccattctagtcatttaagaatatctcattttctctactcaattgtaatctttttgaaggcaacagccataatcataaattaatttttacaaagaacctagggtagcaggtatcaaaaaatggctatcaaattatgagaatctttgccttagaagatgaaaaatacttgggagatgaaataataagtttgagtcaaattaggtggactattaaatggtaacattaaaagtgaagtctgacttggactctcagtcttaactctagattagtggttctccaccagggctgttttgcttctcaggggacatttggtaatgtctggagatattttcgtttgtggtagagagatcaagagtacttctaaatagcttataatgcagaggacagcccattacacacacacacacacacacacacacacacacacacacacacacatacacacacttctgacccaaaatgttaatagcatcaagatggaaaatatctgttctagatctaccaaattaatttcttttttcttgttttcatgggctagctaagtttaaggacctatggagtccactgaggatattctttttaggtaatctcaatgttgcagaaagcgtcattattatctttaccatcattatcatcataaccatcgtcagcttcaacagcagcaacacttcatcaaaattaaatattgtgatagtttgagaaattttagggaaactagagcataatcttcacaattctgaaactcagggatgaaaactgtgtgtgcagtaatcttagaactattgaatactagattagggggaaactgagagggcagctgtcattatttctgtcatttcaaacattggcatcactagtacatctagcaccttccattcaaagatgagattagaggaaaaactattttagagtcaaagatttttccttgtaggtacatattttgtagagaacaaagttctctatctttcctgtatcatgatctatgcatcttaaaaagtgtcaagaaatttctttctatttaattcagtttttttctggttggatcccaaagcattttttttttggtttgctcctctatgaagcttttctctgcctattctgtataacaactgtttacaggtttagaaatgcatgagcaaatgtttttgcaaccttctcttcctgaggaaaaataatcaagtgaccttatcacagcctcctggtatccatccttattttgtccctgtcagtttattcatctgtcccctctcttaatttcttggttcctttaacctatgtatctgtagtctgcaacacacacagatacacacacacacacacacacacacacacacacatccctctacaggacagttatacaaaaatgcaaaatgaaagaagtggagaatagagtatttacgcaatgaaaaaaagctgaatcctagaataatgaataaagagaattgtgggttcagattttcaaagtatacttagcttagtgacagtgaatggaaacaactgctatgttgaatgacagaatgattcaatgaacttgagttctttcactctgggccgcctcaatttctgcctctgtttctgtctcttgagcaagaatggtgtaggtttcataataagcatggattactgaatagatgtcaggaagagaatatttgtcctctaaatcaagtattcaattgactttctatagatctggcatgaactatgatgtagtccaagaattaaaaacttttaaagtagttgtagaaaatggtttctcagtcgtccagtttttcaggtttgccagtcccaagtgtattagcaaaattctgtaaatgcgaattatagagttaaaaacactagaagaggaggaaaaaataggtagtggtggatgaaaattttgtgcaattgataagaaaaatttttatctaggctctccaggaaccagctaactgacttgggctgctcactagccctgtctgggtcttaatgtctttgtccttaaaagggaatatatggtgttcatctgctgccagtagtatcatatgtcattaatcttttgggttcccatatggctctagatatgatgcattttgatgtcctataaaatgggacatgttaaaagttatatatgaaagcacaaattactaacatcaacaacgaaagagggaccattactacaaaccccatggacactaaaaggatagtaaagggatattgtaaaaaattctatgcccacaaatttgataacttagatgaaatggaccaattctttgaaaaatacaatctaccaaaactcacacaagaagaaataaacaagctgaataagttcagaaattgaattaaattacaaaagaaattgaatcaataattaatcatctaaaacagaaaacaccaggtccagatggatttactggacaattctgctaaacatttaagaaataaattttaccaattctctacaatctcttctagatgccaaaagcagatggaatactttctcgcttactctataaaggcagcattactctaataccataccagacagacctttggaaatgtaagaaaagaaaatgtaagaaagtgccaatatctgtcatgagcacagctgctaaggtcctcagtaaaatactagaaaatttcatccagcaatgtataaaaagaatcatacaccacagaaaatggatttatcccaggtactcaaggcttgcttaacatttgcaaaccaatcagtgtattccatcacaatcaacaggccaaagaaataaaaatcacatgaacatatcaatagatacagaaaacacatttgacaaggtccaacacaaatttataatgaaaatctctcagtaaactagaatagataaagaatttcttcaactttataaagaatatctacaaaaaaaaactacagctaacaacacttaatggtgagaaacccaaagcttttccgaaaatattgaaaataaggaaacaaggcaaggatgtatgctcttactactgcttttcaatattttactagaagtctttgctcatgtaataaggcaaaaaaaaagaaaaaaagaaaaaaagaaaatgtgtacagattgggaaagaagaaataaaactgcctttgcagataatatgattgtctatgtagaaaatccaaaaaaaatggacaaaaaaaattcctggaactaataagcaattacaacaatattgcagaatacatggttaatatgcaaaagtcaatgaacaagtggaatataaactttaaaacaataacatttacattagcatcctcaagaaagaaatacttaggcgtaagtctaacaatttatatacaagatcaatatgaggaaaactacaaaactttgataaatgaagttaaagaataaataaatacatacatcaataaataattagggaaatattccattttcataaatagccccaatattgtcaagatgccagcttatctcaacttgacctatagatttaatataatcccaatctaaatcccaagtagtttggatatatctataaactgattctaaaggttatatggagagagaaaagagccagaatagttaacagattattgaaggagaagaacaaggttggacaggcactagtcgactacaacctactataaatctgcagtaatcaatacagtgtgatattggtgaaggagtagtcaactagatcagtggaacagaacagagagaccagaaataggttcacataaatatagtcaagtaatctttgacaaaggaaacaggcaatacgatgaagaaaatatagtcttttcaataaatggtgctggaacaactgatcatccatgtgcaaacaaataaataaataaatcatgacacaggccatacacacttcacaaaaattaactcagtgtggattatagacatgaatgtaaactgcaaaattataaaactcctacatataacatagaaaacaatctagatgatcctgggtttggtaatgactttttaggtgtaacactaagggtgcaatacatgaaaaaaagaattgatgaagtgtccctttgagaaagatgttgttttttagtgtgcttcagccatttgaaaatagcaagatagtgcatacagatcaactctgtgagctttagttaaagaagaaaaatgagaatccactggaataatgaaagacacttcagatcccagggagaagaacgttggcaaacagcccccttgatgttgtccagctgataaaaatgagtgaaaccccagtatatgagagaggtagagagcctccccctggctcacctttccactggggagctgagcaacccaggccaagggaggccacattatttctctgaagccctggagctaacttgaggagaggcttagagatgctgtgagggaaagacactgaggaaagcttcagacattttcccaaacccaggactgagaacaagataccatttttaatccaggagcatacatggtcagctattcttaggtgatctggcagcatggtcatgcaggcatttaagtttccggccagatactggaacatttgctctggagtagggtagggacttccacaaccagaactgtggaaagtttgtcagcagtaggcactggaattatgctttctctcgtctcaaccttggggtaggaaaagagctgccacagctgcaatatctcttgggcagcaagacttacagccagggccagcttggtgaccagaaactggtctctgtgtgtgtcatttctggatgccccagactgctctcctgagatcatggtgtagtgaagccctcactgctccatgcccaggcagattgccaggcattcggagcacccactcacctggttcagcaacctgagccccccacccatagtgtgcacctttcctctgctacatgcccaaacacatctccaggtatctggagcatccacttttctggattaggagtttaagctgactctcacccctgtgcagagaacttgaggccaaggagttttatcagctccacacctaggcacacctctgggtacttggtggccgcccactggattctccctcagtgttggtgcttttgtgtgccgtttgggaatgtgcaggtagggcctgcctggtctggcaccacccatctggccactagcccccagggatgagcagggagctcaaaccactgtgcattccatgaatcagttcattgtctgaggtgccagagagcttctgcaagtaaaaaaggatcaagtatatgcccagcctcattggccacagcctgctcttacctacgagtaccatctactggcttgtaggttgagctacacggtgcaacataaaacctaattaaagaactgcacggggctagagaagcaaaagccaaaagcattctttagcatcatacctctaggaaggctgggaaaaagaaagagaataaaataataaattattgttatatagaaaaaaataaaaagtaaaaattctacccacacaaaaataattacaaaaaattgtaagtgccggtgtcttcaaataagaagaaggagaacaaaaattgtgacgccataaaaaatctgaatgtagtgataccaccaaaggattgcattagctcttcagcaatgctccctaactaaaatagaaactcagaaatgacagaaaaagaattcaaagcatggattgcaaaggatctcaacaagatccaagacaaggttgaaaattaacacaaagaaacttcttaaacaatccaggaaataaaaaagataaatatctttaaaaaaaaaacagagctgctggaattgaaaaaaaaatcacttaaatttcaaaatataattgaaagctttatcaataagttggaccaagcagcagaaaaaagttcagagcttaagaccagtctttctaactaacccagtcagacaaaaataaagaaaaagtaatttttaataaagtctttgagaaatatgggattatgtaatgcaacaaaacctatgaattattggcatgtctgagagggaaggagaaaaagcaaataacctggaaaacatatttgagggaataatccaagaaaatacctctaatcttgctagagaggtcgatatcctgatatgagaaatccaaggaacacctgcaagatactacatgaaacaaacatcaccaaggcatatagtcaccagactatccaaagtcaatgcaaaagaaaaaatcttaaagacagttacagaaaaaactctgatcacatacaaagacaatgtcttaaggctaagaggggacttcttagcggaaaccttacaagtcaggagagattacaggcctattttcagcatccttgaagaaaataaattccaaccaagaatttcatatgctgccaaaccaagctttacaagcaaaggaagaataaaatactttccagacaagcaagcactaagggaatttgttaccactggaccagccttacaagagattcttaagggagttctaaacatgggaacaaaataataatacttgctaccacaaaacacacagcacatagctcacagaccctataagtcaaccacacaatataaactacaaagcaaccaattaacaacttcacaataaaatcaaaacttcacatatcactcttaacctcaaatatggatggcctaaatgccctacctaaaaagcacagagcagcaagttggattttaaataagacccataagccttctgttttcaacagacccacatcacatgtaatgacaccaatagtttcaaagtaaagggctgaagaaagaccaaataagcaaatggaaaacaaacaaacaaaaaagatcagggagcgctattcttatatcagataaaacagactttaaaccaacaacagtaaaatagggaaaacaagggcattacatcatgataaaggattcaattcaacaagaggagtttaacaatcctgcccccagtattgcagcacccagaattatgaaacaggtacttctagacacataaaaggacttagaaagccacacaattgtagtaggggacctcaacaccccactgtcagcattagacatatcatcaaggcagaaaactaacaaagaaattctgaacttaaactaaacacttgatcaattggacctaataaacatctacagaagattctactcaccaatcacagaatatatgatacattcttttcacttgcacatgaaacatacccttttttcaccactgagtatgatgttagctattggcttgtcatataaggcctttattatgttgagatacattccatctatacttaatttgttaagagtttttattataaaaggatgttgagttttgtcaaatgtcttgtctgcatccattgagataatcatatgatttttatcctccatctgtttatatgttgtatctacctttttgatttgcatattttgaatcatacttgcatcccagggaaaaattacacttgatcatggtgtatgatccttttaacacactattaaatttgttttgctagtattttgttaaggatttttcacccacatttatcagagatattggcttgtaatttttttttcttgtagtatcctcttctggctttggtgtcagaccaatgctcattgtaaaatgggtttgaaattattttttactcttcaattttttaaaaagagtttgagaagaattgttattaattttacttaagtgtttgatagagttaccagcaaagccattggatcctgagatttttgtgtcattttggggagtttttctattactgattcaatctccttacctgttattgggctatttaggttttctatttctatgtgtttatccttttctttacagtcatcaattttttggtgtataaatgctcatagaggccagttttgattctttgtatttatctggaatcaatcgtaaagtctcctctttcattttgaatcaaaattcacaaatatgtaaaaattaaacaataaactttggaacaaccactaggtcaaagaagaagtaaaagaaaattaggaaatatattaagacaaaccaaaataaaaaccgcataccccaaacttatgggatgtggcaaaaggcatacaaagcagggcattcatagcattaaacatctacattaaaaaaaaaaaaagatccccaaaaaactctaaatttccaccttaaggaactagaaagacaagaataatttaatccgaaatttagccaaaggaaggaaataacaaaggctagatgagccaaatatatagaaaaattttttaaatagaaaaaaagtaataaaatgaagcattgtttttgaaaagataaagaatatttaaaaactcttagttaaactaagaaaaaagtgagagagatctaaaataaataaagccagaaatagagaagaaggcaatatatcagctgttgatgataaaaaaattataagggactattatgaataattgtacacaaataaattagatatcagaataaatggataacttgaaagacacaacgtgctaagactgaatcacgaaaaattggaaactctgaatatatcaataacaaataaggagacttaatgaataataaaaaatcttacatcaaagaaaggcctaggaccaattagcttcactggtgaattctaccaaacacttaataatgaacacctgtacttctcaaatgaaatacttccaaactgactttatgaggccagcatcaccccaataccaaagctacacaaagctaccacaaggaaagagaactataggccaatatctttgatgaacttaggtgccaaatcctcaataaaatactagcaatttgaattcatcagtatattaaaaggatcatacaccctgacaaagtgtgaattctccctgagattcagggatggttcaacagatgcaaatcaatcaacatttacaccacattaacagaataaaagataaaatttgcatgatcatcttcaaagatacagaaaatgacatctgacaaaattcaagagtatttcctgataaaaagtctcaacataataaaagtcatgtatgataagctcacagttaacattcttggtgatagcaaattgaaacttttttctctaagatcaggaacaaggcaaggaggtccaccgtcatcactactattcaacatagtactggaagtcctagccagagcaataagataaaaagaaatgaaggccattcaaactggaaagcaaaaagtcaaattaacgctttttcttcagaagacataactatatgatctacagatatatgtgaaaaatcctaacaatcccacgaaagtgttaaaactaagaagtgaatttctcaccgactcaaggggactaagcacaatttctgaacaaatataagttatttaaaagcaacgctgaatatgtagaaagagatggaaattatatcaaacaaccaaatggaaatttctgaagtgaaaagtataattatcaaaatgaaacatttcacagagaggataataaaaagatttgaactggcagaagaaagaataagcaaatttaaggcagattattaagaaagatagaatctgaagaagagaaagaaagaaaagaaaaattaaaggtgcctctgggaaatacgtgacccactctgaaccagttgttaaatctttccttccttttaaagcaattgacaacaaacagctcggactattcctgctattcaagtgtcatttattttctccaggactcccatattagggatgttagacttcttatactgttcagacacctcatccctaagttttaagtttgtcttctgtgtgcttcagtgtaggaatcttgcccttgacctattttccagttaagcaattctgtaatctgaactgtccaatctactgttaaatgcatctactgaattcttaaatcatatttagttctgaaatatccgtttgaaaatttccagcttacgcaggatattttacattgtttgatatactgtgtgcatttttccttctaatttaaagcatggtaattatagtcattttaaaaatattctcccctatgtatgtgctcccctgtctggatcatcttgacactacttagagtgtctccttctgcttctttcttttccttttttcattctctgataagaggtcatacttgttttactcataacctacatagaaatgagttactttgtcaggtaactgattacaaagcaagcacagatgctccgggtacctccattgaagatgttcccctcttttttctgttagactggggagccaattaattccctgagtcagtcatgaattgagctaggtctgaagtaagtgagttttccatgtatcttggactaattctctctctctcatgttgctgaggtctgggcctgctagactttcacttgggtatctgtgtggctctatttcctcagctctgaaacaatataaggattcatctctattacacaaaggttcacagcccagctctccagtctcttgctacaagcaagccccaaattaggtaagtgtcttaacagacagacaatccctgtttaactatgcttcgtgtccaaaatatcacatcagtttaggaaactgtatcctttgataacattgaggctagcttatcaacatcccacaaagccttaacattcatcatatgtgacctggggagaaatgattcagaattgaaggctccagaacatctgatctgtgaatctagtcctgagtagcaatgaagagggttggtggtttccctttctctcagcacacggtctctaactaggtcaaacgtaatcctcaattcacatccagcatctgtaagtgctcccaaaaaaatgaatgactgcaatattcaactcatttcagaactgttttccatgcctaaagttttagttcattaagtacttcttgcttgcacaacttctgatgcccttaaaatatggtttttggccgggcgcggtggctcacgcctgtaatcccagcacgttgggaggccgaggccggcggatcacgaggtcaggagatcgagaccatcccggctaaaacggtgaaaccccatctctactaaaaatacaaaaaattagccgggcgtggtggcgggcgcctgtagtcccagctactcgggaggctgaggcaggagaatggcgtgaacccgggaggcggagcttgccgtgagccgagatcgcgcccctgcagtccagcctgggcgacagagcgagactccgtctcaagaaaaaaaaaaaaaaatatggtttttgaagtttaattgggatttctggtgttttcccagagaaaacatggctttctaagacttattctatcctacatagaattcgttcttctttatcctattttattaccaaaattacagaggggttgattggcaagtgctattctctttatcagattttgaaaacagtgtttctaagtttcagtcttttccccaagatgggaaaaggcaatgaggagaaaattccaacgcttccgatgtctgcttccttcccgtgttttccaccgtagcaaggtaaggactgcgtcacttagacttcaatcacaaaatgagaaaccacaccctgggctaaccatgagtcactaacaggaagatgtagcgatcactactaggactggagatcaaagggaaaggagtggggttaatggaacccgcaagcttggaatagatcccctggttccaggacttcaacctcttaggagagggtagagccaacctaccgctgaaacctctggaattcgtagaggatccaaagaccctctgaggcgactaagacctctgaaggtaagatggatgtttgatggctgtgctggtatccctggggctgacaatgctattggacctgggagttatggaatatatgtaggcaaaacgtgcaggcacaaagctactgctgctgccaaggcggaagctgtgtgttactcaggtaacattgacataaacagctatcagacacttctgtcaggtttccggtctctctagttcccccaacggcaaatactaacagagaggatgggcaaagaggaaatggagtgtgtaggttcccgttctccctgtgacaaagcgcaaggataaagagtaaaaaggggaaggaggcttggaattgaaagacagcgaattaaaacacacagaacccattcgtgagctgtgtctttgctcaagaaacccaagtctaattttataacaaataaaacactaaaattgctttaaaataatgaaaaagcaggaataagctggcattaccttattcaatagccaacatttatgattctaaactataaaagaccttggggatttctgtcagtggtctcaggcatatgcaataaaatttctcctgacagcacacacaaaattaatacgtgagaaatttcatgaatgattaagcttcttttctgaagttttaatttgttttcaagttttttgtaggtgaagtttgaacattttgcttttctttcttaggtgacatttgaacatgttgctttactttttcaggtaaagtttgagcatttggctcttctttgtttttctgtgcgtgatcaacaacaacataaacagaaagcaaagcaaaagcaaaaagggaatccataaatatggtgttacaccccttgcttgcacacctcattttctccctttttcctgggggtggtggtgccactatcaacactaccctcagtgccttctctcaggcagtcaggaggcttccactctcggcagcaatggcagtgatgtttattgttgcagacaggtctcatattacaggtcacgggcaaacaggtactgttcaaaagtgacatagtgacacatttcctgtgcatacagacgtgttctgaaccacactcggtagcatctttcacgtcaccaatatcaggagtgcttatccccattcgatagccggtatcccagcaggtgacaccaatgaagtgagtccggtgcagagtagaatgatctctcaaaagggggatttcttgcatgttctcacactcaactctcccacacaagatatctgtgacctcacatcttacctatttggtgccattgaaaccacagtgaccaaaatgatcacctcggatgttcatattactgcagcaactctgatttgcactgttggctacctggccaaaaatttgtctacactgttcatcacagttattacatctcttttcgtagcagtggccactgcccttgcaggggatcccgtcctgcaaacacacatcttctgcacactcatgcgaagtcccgttgaaccactctggaagatcccattcgctggactcttgtctgcacacttcgaccgatggcatgatctggcagtttttgcagcaaagccccaaaacacaagcagccccaggtttgaaagtgcaatttgcaaagcaacatggctcttttcacacgatggtaagtttccgcggtcatactcttcttctaccgcaccattcccacagcacctctgtgtcatgattctatctcgatttggtgaagcatgcatgcagatcgttgttacagtggtttgaaaaaatctagcattaactacagttgctgaatctttttgtggaagttgccgttggaaacattatacacttttttgcccacaggaacatgtttttgtatcatgagtcatacccaaattatgaccaagctcaggtgctgctacgagtgcaaaagatcccactctgttatgtccaaaactgttaattgcataattactttctctataacatactgttccaacattggctaagccaagagtaataccataggagcgttttacaataagatgtgcaacatcatgaggaatgcaagaattaaagctagtttgtttccatttgcaaatttctttcaggccaacacctgcagtgtccattgtaatgaagttttcttgagtccagatctcaagtcccactacagtgacaattggcacccagtggaatataaaatgcatcagctttttgatacagcatgagtacttcctcctgcacatttgaggtatgactttccagataaaggaatcattcatcatctaccactactgccagttcaacaaacaatttatgggtccaccagccctcaaagccactttgcattagagtagaaggatcttgaaacttcaattgtcttgctatttcttcctctatcaacccacatctcatgggtgggaattgtgtctcctcattgtccatcttatatatcagatgttcaaatgtggctgaaacccttttgggcttgatttcctaagcagtgtcatttatctgtggtattccttgaaagccccccaaacagctgctaagagcaaccagggattctgggtccccttccacataactgtgatagtagcagtcatcctggacaaaagttggtcctcaaaaatagcaccctggtctgagtaggtgaacacagagaaggatttggatatcaaaaatatcaaaagcttattgaccttcatgtggacaatgtacctttggctgccaacttgcaggccataggacagccagccttgagtgtccgtgcctctgtcagcaccagttatcctcaggggtatcaccacttctgggaggctttggtgttgacagagcccaatctggagccatccagaaaagaacagaaacactcccagccagagcagcagatggatgaacctcacatggaccagggcctcgctcactgccctcatggagccactgtgatggagctatgggtgagagcaaaggaggggaggcaggaggcacagctggtctgtctcctcctctgagttgcttttgtttgatgttgagcttaatggtctttctgctggcagagtcagtctatcagagcagcacagctaaaagataaagtgaaaagaatggcagagatggggtggtgtgagcagaacagagtggaaaagagagagctgggtgtgggtaaaatggagtcatatttggctcaggacgtaactcattatactgcattggatttgcttctgcatattggcaaggcagagtgagactgtgggtgtaaaaaagaatgacagttggctgcaggttgataattactgaacctagatgaaggacacatgggttcattacactgttgtctaaatacacgtatgtgtgtgaacatttctgcaacaaatacctaaaacagaagagtcttaatggaaaggggaacgtatatctcattttgatgagagaaccttgatttatgcatatagacttggaataagtgtagatatttcttatcaatttcaaatgataaattattcagtcaccttactcagaagagagacataaaaatattcacacatcttactttcttatcatggtcctcaatatatacttctctgcaaaatattacttgtcctatcttcatctaatactgtcaaactgcgtagtgtcaaaatatcaattatccttcaaaaacgttagcgtctattttaatggatcccaaattcaatataataataaaccattgtggaattaaaagaggatataccttgggttgacagacgttcccgaaagatgatcatatttgcttatactcttatgaaaagtaacatttgtcaaagcctctaacaaaataaaatggaaaggaaatcaaactagctggaaaagcaacagttggaagtgggaagacatggaagggaaagcaaagtaccttcagaaataaatagaaaatcaatgagctccaaaaccaggaaggaaagctttggaggaaggtaggatttttgtccttgagcaaagatatcaaaatccatggcatttttagggttataaggtgaccactcctgagatccacccttgaaggtatttatgggataaataaaaatacctattccatcaaaaaaataaaatacaaaaaaggtctcaataatacaaatgtatcatcagatatttatgaaaatgagagatctggtactagcacggtgcctggctgccaatactgatttattgctgttcttgaataaaatattaataaaaccacctgatatacagacattatgctgcaaattttagaatataaatgaatgatactggcctaaataatttagtagtctggagcaaacatttagggagaatgtttggggcaaaaacacactttaggaatctgcataattacattcaatattttacatgtaaaatgcctaatgttgtttagctagtgagagtaaccacagtctttatcagacaagtaaagtaatgagattaagaattattagtcaagttgagaaaaaaaaagacctgaggaaattgaaatctgctttgagtgacctaaaacagagtgatcaaattccacttttcatagtaggtattataaaaacaaaagacgccagattcagcacctaacatctcttggacttggacccatttttctttaaaatttccttaatttttcttttatcttgattctaagtgtttgatctctctgcaatcattttcttgtcactcatggaatcttcctttcatgaaaagcaacaagaatcttttctctattcacaaggttttatggtgagcttcttattcatactaggttttacaaaaatgtatatctcaacaatgtgaatcccagcagaaaggaggctttgtcatatgccctgcagaacatatgtagagatatggttttgccatgttggccaggctggtctcaaactcctgagctgaagtgttctgcccaccccagcctcccagagtactgggattacaggaatgagccactgagcctggcccaataatagttttgagtaaaaatattgcattaatgtttaagctatagttatctagaaaatattaagttttatattgcttataattagtaagtttcccattaatccttttgcttcttactttaccatctagaaaccaaggctactaatactatgaggaacttgttgggaattggagaaaaggtgactttcattatgctttagcaaagagactggcagcattttgccttttctcttcagatctatggaacattgaacttgagagaaatgatttagagtatctggtggaagaaatttctaagcagcaaagcattcaagatatgatgtgggtgctgttaaagacattcggttttatgtattcacaaagatatggtttggaattggaacttatgtttaaaagagaagcagagcatgaaagtttgaaaaatttgcagtctgacaatgcaatagaaaagaaaaactcattttctgaggagaaattcaagctggctgtagaaatttgcataagtaatgaggacccaaatgttaattgccaagacaatggggaaaatgtctccaggacatgtcagaggtcttcatggcagcccctcccatcacaggcctagaggcctaggagggaaaaatggtttcatgggccaagcccagggccttgctgctttgtgcagtctcgggacatggcaccctgtatcccagccatggctaaaagggcccaatgtacagctcaagccattgcttcagagggttcaagctccaagccttggcagcttatatgtgtgttgggcatgcaggtgtacagaagtcaagaattaagatttggaaacctctgcctagatttcagaggatgcatggaaatgcctggatgtccaagcagagttgtgcttcaggggaggagccctcatgaagaacctctgatagggaaatgcagaagggaaatgtggggtcagagcccccacacagagtccccaggagggcactgcctagtagagctgtgaaaagagggccaccatcctccagaccacagaatgatagatccactgacagcttgcaccatgtgcctggaaaagctgcagacactcaataccagcctgtgaaagcagctgggtgggggtggggatgggggtgctgtaccctacaaacccacaggggcagagctgcccaagaccataggaactgacctctagcatcaatgtgacctggatgtgagacataaagtaaaaggagatcattttatgtcttgactgtcctgacagatttcggacttgcatggggcctacagcccccttcattttggccagtttctcccatttggaatgagtgtatttaccctgtgcctgtacccccattgtatctaggaagtaactagctctttcttactagacataaaattaactgagacagttttaatttcattttgatttttttctttagcaaagggaaggttcaaggcccccccaaatcagtatcaagcagaagcattttttcaacaaaacgcttttcataatcagatacaatccacattgattccctcagagatatactacagaggttctctttcttgaaatgtttatatgttaaagtagaactggagactcccttgtctctggatgggtaaacaaaaagaagatgaccacgggcaaagttactgagcacaggttacttactgttatgtaacaaattaatctagtggcttaaaaattcattttataatttattattatttattatattatttatgtgtagggcaggaattcaggcagggtatggctggacaattttcgctccacgtgatgtcaatcagtgttcatctggtggcagacagctggtggtttgactggtcttgagggtctgaggtacatttactcattgtctattccttgacagagatggcccagaaggctgagcttggtacagtctgttccttagagagcctacataatacctctgctgcatgaatttcttcttacactacagtgctccaagaacaatcattccaggaggtacaggcagaaactaacaaggcttcttaggatttagcttcagaagtctcagtacataacttgccacattacattagtcaagcaaaaagtaaggctaggtgagattcaagtgaatttggaaggttttaaaaggaggaagagattccatttcacatttaaaaaaatggcatgtgtcttcagcaaaggaatatatagctgaaacacatcacaggcacaaggtacttcagtttatactctagctccacaatttaatttgggtgattatttttaatagactattttttagagcaattttaggttccaagcaaaactgagtggaaggtacagagatatctcaaatggctcctacccctatgtaagcatggcttccctcattattatcaaccctctccaaagtggtacatttgttacaactgatgaacttatattgacacatcattgtcacctgaaatccatagttaacattaggttttacttttagtgttatactctctatgggtttgacaaatggataatgacatgtattccacatagtatcatacagagcactttcactgccctcataatcttggcacttagacttttcatccctcctttcccctaagccctaagaaaaaccatatcttttaacactcttcatagttttgccattttcagatgtcatattgttgcaataacatggtatgtagtcttttcaaattgggtttcttcacttagcaataggcgtttaagtttcctccatgtcttttcatggctcgctagtgcatttctttaagtgctgaataatattttattgcctggctatatcccaacttatttatccattcatgtacttaagggcattttggttgcttccaagttttgacaattatgaagaaaatgatataaacatccacatgcaggttttgtttgaacataagttttaaattcttttgtgtaaattcctaaggactgcaattgttgaccatatggaggggtgtgtttattttatttatttatttatttatttgagatggcgtcttgctgtcacccagactggagtgcagtggtgcgatctcagctcactgcaagctctgcctcccgggttcacgccattttcctgcctcagcctcctcagtagctgggaccacaggcacctgccaccactcgcggctaatttttttgtttttagtagagacggggtttcagtgtgttagccaggatggtctcaatctcctgacctcatgatccacccgcctcgtcctcccaaagtgctgggattacaggcgtgagccactgcgcctggccggggtgtgtttatttttaagaatacaaggtatattacaaagtagctgaactattatgaattcccacaagcaatgaatgagagttcttgtggctcatcatcctcgccagcatttgatgtcattagtattttggattttggctcttccaatgtgtgtatagtggtattttgttgttttaatttgtacggtcctgatgatggattatgtggagcatcttttcatatgcttatttgccatctgcataacttcttcagatgtctgttagtctttgatccaattttttaaatcagttgtttccttactgctcatttttaagagctctttctctattttgaataattatttatcagaaaagtattttaaaaatgtttttctcccagtctgtatctttacttttcattcccttgacagtgtcttttttctttctttctttcttttatttttcaacttttattttagattcaggggatacatgtgtaggtttgttatatgggtatattgcatgatgctgaggtttggagtataaatgatcccatcacccaggtagtgagcacagtaccaaatagatttttaacccatgcccttttctcccttccctctccaatagtcctcagtttctgctgttgccatctttatgtccatgagtacctaatgtttagctctcacttatgagtatgaacatatggtattggtgttctgtttctgtgctaattcacttagggtaatggcctacagctgcatccatgttgctgcacgtagacatgtttctattctttcttatggctgtgtagtattccatggtgtatatgtaccacatttgctttatcccatctgtcaccgatgggctcctaggttgattccatgtctttgctattgtgaatcgtgctgtgatgaacaggcaagtgcatgtgtctttttggtgaaatgatttgttttcttttggatgtatatctagtaatgggactactgagtcaaatggtagttctgttttaagttctttgaaaaatcttcaaactgctttccacagtggctgaactcatttgcattcccaccaacagcgtataagtgttcccttttctctgcagcctcaccagcatctgttgttttctttgactttttaataatagccattctgactggtgtgaaatggtatctcattgtggtttggatttgcatatttctgacaattagtaatgttcagcattttttcatatgtttgttgccttaccgtgtgtctttagaagtgtctgtttatgtcctttgcccactttttaatggggttgttttttgcttgttgatgtaagtttcctatagattctggatattagacctttgttggatacatagtttgtgaacattttctcccattttgtagggtgtctgtttactctgatgatttattttgctgcacagaagctctttagtttaattaggtcccacctgtcaatttttgtttttattgtgattgcttttggagtcttagccataaattatttgccaaggccggtgtctagagtggtaattcctaggtttccttctaggattcttatagttttgagttttgcatttaaatctttaattcatcttgggttaatttttctatatggtaaaatggagtgatccagttttaatcttctgcatatggctagtcacctatctcagtgttatttattgaatagggagtcctttccccattgcttatttttgttgacttttgttgaagaccagatggctgtaggtgtgcagctttatttctgagttctctattctggtccattggtctatgcatctatttatgtaccagtaccatgctgttttggctactacagccttatagtacagtttgaggtcagttaatgtgatgcttctggctttgttctttttgcttaggattgcagtgtctattcaggctgctgcttttttggttatacataaattttagaatggtttttcctacttctgtgaaaaatggcattggtgattttataggaatagtgttgaatctgtagattgctttgggcagtatggccattttaacaatgttgattcttcctatatatgagcatggaaagtttttttatttgtttgtgtcatctatgatatttttcaacaatgtttggtagttctccttatagagatctttcaccttcttggtttggtgtgttcttaggtattttatttttgtgtggctattgtaaatgggattgttttcttgtattgtaaatggaaatgttattggtttatagaaatgctactgatttttgtacattaatttgtatcctaaaactttactgaagtcatttatcagttccaggagccttttggcagagtctaggattttctagatatagaagtatataatcagcaaagagagatcatttgactcttttttctatttggattccttttatttatttttcttttataattgctctggctagcacttccaatactatgttgagtaggagtggttagcatgagcatccttgtcttgttacagctctcaaaggtggggatggttccagttttgtccattcagtataatgtgggctgtggttttgccattgatggttcttattattttgagatatgtttcttcactgcctagtttcttgagcatttttttataaagggatgttggattttatggaaagatttttctgcatctattgaaatatcatatggtttttgtttttaattttgcttatgtggtgaatcacatttattcatttatgtatgttgaaccaaccttgcatttcaggaatgaaactatctgtattgcagtgaattaactttttggtgtgctattggatttagtttgcaagtattttgttgaggatttttgcatatctatgttcatcaggaattttggcctgtagttttcttttttcattgtatctttgccaggaatttgtatcagggtgatgctggctttgtaaaatgaatcagggaggagtctcttctcaatttatttgaatagtttcaaataaatagcttttttttttttgtatatctggtagacttcaaatgttaatccttctagtccatggatttttttttttggttggtaggttttttattattggttcaatattataactcaatattggtctgttcagtgttcaatttcttcctgattcaatcttgggaaattgagtatttctaggaatttaacaattttgtctagattgtctagtttatgtgcatagagctgttcacaatactgcctgagtatcttttgtatttctgtgaaaacggtgggaaagtcatctttgttgtttctgcttctgcttatgtgaatcttcctttctttcattctttctttctttctttctttctttgttaatctagctagtagtctattgatcttgtttatcctttcaaataaccaacttttggttttgttgatactttgtatgggttttttgtacctcaattttgttcagttctgctctgatttacttcttttcttctgctagctttgaggttagtttgtttttgtttttctagttcctctaagtgttatgttcgatcatgaattttagacctttctgtgtttttgaggtaggtgagtagtgctataaattttcctcctaacactgcttttgctgcatcccagatattttagcacagtgtgtctctattttcatttatttcaaataatatttttaatttctgctttaattttgttgtttccccaaaagtcattctgaagcaaattgtttaatttccgtgtaattgtgtggttttgagagatcttgctcatattgatttctttttttattccactgcagtctgtgagtatggttggtataattttaacatccttgaatccattgagacttgctttagggttgagcatctgttcaatcttggagtatgttcccaagatgaattattcgtagagctataatatatagcataggtaatatcgttaataataatgtattgcatactaggaatttgctatgggaatagaagttatgttctcactacatcagaaaaaggagtatgtcaggtgatgaatatattaatttgcttaattgtaagaatcattacataaagtatatttatatcaaaataccatgttatacttcttaaatatatacaatttctacatgtcaattatatctcaataagactgggaaaataaaagtaaaagtataatattctaaatgtagccataaatctctcaattaccaaaaatgaacttgaaagctctatctacctcaataggcggagagtttctgctttaagactcatttttcaaaatcttgtgctaaaagaggccatttatttactcctgtacattttccatagtcttctattcttccccattttcttctttcttgagtgtataatgtacttccgactactgggaaaactgtctcaaatactactgattgaactataattggctttttaaaagccacatggagaaaaaactactaagatagtcatcaattttgcagaaaatacaaccacctcttattttccaagctgtgtctacacattggcagagacaggctacgagaactttttcttcaaatttgcattgtgggttcatcattactggcaaaaataatttttcacagattctttataagttaaacataagcttaaataatgctcttcaaaccttggccctaatgcacatccttttattttataaaatataactagccccatttagagttagaaggaaaaaggcagagcagtaattgagattatttcaatttgctataataagttgagattatttgtaataattgagattatttcaatttgctatatatcttccaagtcttcaggttccaaaactgtattgctacagaagcatcagaaaactctcagctttaactcaactcccatttaacttataaaacatatctgaaaaagtaattctttttccatttgatgcatgtcttttatgatttttttggttagaaacataaaatttagaaactcatttttgcttcaaggcaaaagtatatgcccactgaaaacatcctaggaacaagttgtttttcactgaagccactcgaatgaaaacatcacaaaccaaaatgtttgtcagggatccattgagtgttagaaacagtagagaagagacataccaaacctgggagcaggttcctggaagcttatcatgtagttaagatgagaagttatgtaacaataacaacaaaacaacttttatataatatcacgcttcaatataatataacataatatagtatataaatgaattatatgatgacaaccatgtgtcaggcacctgcctaagcactttacctatattaactcatttaatacttacagtggccttacaggatgcttataattactatgattattcacattttacagataagaaaaaagacaaagagcaaagcaattttagagttagatcattaacccagcccatgtatctcccatgtccgttttcttatttgctagatgctgctgcttctcttattatatcatgtcttacaagggcagaggcaccaaatgggtgcaacagaactgcagagaatggaaggaagtcattgtggcttgaagaatttgaagaataaaagaggcatggggctaggtcttatgtgaacaggaaaaagctactttaagctcataagtgcaggcaaaaaacctagagatcatctttgtccttccctttcattaccacttcccacacattccatcacacaattatctccttctttcttctaactggctttctcattattctacttctcttcattgctactgtcattatagctttctgtcatggattttgcttgaactaatgctatagtctcctgactcacccccctgcccttgatattttttcaattcattctccacattgtagttagagtaatgtttctacaaaacaaatctgattgtattattctcttgctcaaaattattcattagctcccaattttccttaggaaaaaatatgagttccttagcatggcttagaatgcccttcatggactaaccattgcataattctgtaatctcagcctcagagcaaaccctctcaccatcaccactaccaccaccacagctcgtggcagcatacctttttccactaatgaatttctttgaattcgtcaaatatctttcttgtttccttgagtttttcaaataatatctttcctgagtatctccttcttccctattacatattatttaccattcaagtcctggcatcaacatttcttcatttggaaagtcatccataacccccaaaatgatgctaattgtttgaatgtgatccctattcttatattcttatttttatgggcagtcctcagcatactttaagataattaccggttatttgttcagttatctctaagactagaagtctgcgaggttagagacccctcttttattattcatgattttatctccggtactcagggtaccaaatccctgtctcctaagcatgcatacaaagagatgccatgcacttcaaaagtaaacacggcagggtgtggtggctcatgcctataatcccagaaccttgagaggccaaggcaggtggattgcttgagctcaggagtttgagaccagcctgagcaacatggtaaaaccccgtctctaccaaaaatacaaaaaaactagccagacatggtggtgtgtgcctgtagtcccagctactgaggaggctgatgtgggaggatcactagagcccaggaggtggaggatgcagtgagccaagactgggtgacacccagcctaggcgacagggtgagaccccatctcaaaaaagaaaaaaaaaaggtaaagatagggaaacttgaaattattgcagtgtaaattacccaagctaaagcacagaggaagaaaagactaaataaatacatccataacagagccttgggcagtgagtacaacatctagtggattaacatatctaaaactagaataattgaagacagacggcttaaaataatggcttaaaatgtttacatttggtgaaaattataaatccactatttcaggaaatttaacaactccctggtgagttttattttgctttaaccaaataaaaaccacagcaaggcatatcataatataaatcattggtaaaaatttgtattcgctggatctttataaacatccagagaataataagtacatttatatttcagggaacaacaatagcaatcatctccgacttcacatcaaaagtaatgagacaaaagacaatggaaagatagcttagaagtcttgacagaaagaaatactgtgaagctagaattatataactagacagtttttaagaaatgaattcaaataaaatatcttccaggcaaacaaaagcagagagaatttattgtcagcaaatatgcactatgagaaatgttaaagaaaattcttcagagggaagggaaataatgtcagatgaaacttatatctgtaaaatgaaggatttcagaaatagagaatgtgtaggtaaataccaagtgtatatttcgattaattttgttacaagataaatggtcgcttaaagcaaaaataataatgaactgagggattagtaacatatatgaaagtaaaatagttgtattagggtcctccagagaaacagaactaatagagaaagaaacatagaaagagagagagaaagactgactgtaagaaggctgggcgtggtggctcatgcttgtaatcccagcactttgggaggctgaggtgggtggatcacgaggtcaggagttcgagaccagcctgaccaacaggtgaaaactaccaaaattagctgggtgtggtggtgcgtgcctgtaatcccagctactcaggaggctgaggcaggagaatcgcttgaacctgggaggcggagattgcagtgagccgagattgcactgctgcactccagtctgagcgacagagggagactctgtctcaaaaaaaaaataataaaaaaaaataataaattgattgtaagaaattggcttatgcaattgctagcagtcttcataaccaggaagagcagatgttcccgttcaaaggcagtcaggcagaagaatttttttttcatctggggagaggtcagcctttcgttctagtcacaccttcaactgattggatgaggctcacccagtattggtaagggcagtgtgctttacctagtctaccaatgtaaatgttaatctcatccagaaacacccttgcagatacacccaaaagaatgtttgacaaaatatctgggcaccacctgccctagtcaagttgacacataaaactagacatcacaagtttaccccttgtcaacttggcatctataacatctccttaaattgtacttaaactccaagtaaagacaataacaaggccataatttcacctagtctgatataactaccctgtgtgaaaccaaaaatgcactaattccttccccagaaaaggaggtaaagtccttgcatgatatttacttttctttttgaactcccatagcttaattactataatgtaaagttaacaatacttaagtactacgatataaagtcaacatatcttatgttacacaataaggatataatagaggaaaaataagatattattatatgcacataaacaaatatattgattaaaaataaaggggaaatactcagataattacagttctcatttctgtaatgggtcgcatggtcatagctggtatttataactaagttcttgcactttgcctttagcaggtacctcagctctggttgtgattctttattaacaggtatgggagcaagcatatgacaggttaatatctgcatcctatgtaccaggggatatattaactttctcaagcaatgaagccacatctggtacaaaagctgcagttggattcatcatctggataaacataggataatccactttaattctccaagatccatcagtcttctgcacaggccacataaactcattgaatggggatgtgttgggaatcaccacctctgcatctttcacgtccttgatagtgcccctaattctctgcagtccctccgggaatgtggtattgcttttgatttactaggtagaggcaattcgagtggctttcacttggccattctcactataacatccctcacttcacaggtcagggaaccaatatgaggattctcctagatgctgaatatgtttattctaatgatgcactctagaactggggaaatatccaagttcatggacccagtgggccaactgtaaaaaagacctgaactaaaactccattgaccacctgagctcgataagcccctactctgactggtggatcacagtcacttggggtttcctggaattagcgtcacttcagagccattgtccagtagcctccaaaggtttgattacttctgtttctcttagtgtgcagctaccctggtaacagccataagtcctttgggggaaggttaggagacagattaacagcataaatgttggcaatgtaccaggggtcttctttaaggggccagtcccttattcaaggggttctgggtctataagccagctcaaatctaagaactgattgaggggctgtgactctctgtttttatgattcaagttagactttaattcacttgacctagaaggtctctgcttatgtagatcgagtatgaacttagtagggcttcctatctatttcactctgggaacattatcatcaaatagccaatgtcaccaggcgtgtgtgtcagactattctgagtgctgctgtgcctctgctgtttattatggtaaccactcccacctcgctttgggcaggttagtgctgccacttggccctgacaccctgggattcaattactccactgcattctgttatccaggtcagtgactgcagttcccaccgtaaggtctggcctacagagaaaagttatcacaggctctgcaaggatgctggggctctcctcacaagtttatttctcagaggattagtgaaaggtctgtcttctgaaccctctgaggataggtgagtaggttttaaccaacaaatggtctctaaccttccaatctccctaacatttcaatctttcctttgaatcccttctcctacatacaaccaagacaggtccagaatttccaacttgcttattgtgggccatcttttggtccatatttaagtcaacaaactggtagagccctttttatctcccagagctacagcattaactgcaggatctctgcttagtcaaccaaggtcaatgaatttgacctgatccaattttatgttccttctaccattattccacacccttaatatccattttcccacacgttccccagatttctttctgtgcaagttaaaaaacctcaagtaggtcttctgaagtgtagtaaactcttataagtcacactttgcacctcaccttgagaagcctgctgggaccggagtgaagtggcaggtctagaagcaaagaggggtggtagggtggggtcctgataagaacagcattgtgttgcacgcctcgggggaggccatgacagtttccttgagcaatacagggttaatctcctcagacacaggtgaaaaggcaactttccctggcagtgggaaggctgcttgcactggagctaggcctcttccactggccaaaaagagctaccagaatttaggggctcaatagctccagtttcatcagtttctcccacatgtccctgtttcatacttcagaattctatttcttcccaatcgcttcctcactttaacagtagacgccctgcaagtctggcagtttacctcacgttgtaactcagctggtcacaggacaagattcaggcttgattttcagcagtctcagccctgtggctagagggatgaggcctcctgagctggtcacaggacaagattcaggcttcattttcagcaatctcagccctgtggctagagggatgaggcctcctgagctggtcacaggacaagattcaggcttgattttcagcaatctcagccctgtggctagagagatgaggcaagattcaggcttgattttcagcagtctcagccctgtggctagagagatgaggcctcctgagctggtcacaggacaagattcaggcttgattttcagcaatctcagccctgtggctagagggatgagtcctcctgagctggtcacaggacaagattcaggcttgattttcagcaatctcagccctgtggctagagagatgaggcaagattcaggcttgattttcagcagtctcagccctgtggctagagagatgaggcctcctgagctggtcacaggacaagattcaggcttgattttcagcaatctcagccctatggctagagatgaggcctcctagagggcacacattgaagttttcaggtcatctattgaacccttgagctgggagcttatttctttcttttcccacattgtccagtgacattaggagcaaacagccaatatcattatactcattattttgacaaaaatattgaagaatattgtatacacactcaccctgcttcttataagcggttgattaggggaatctaatggtaatattttgcaaatttctactgccagatcatgctatgaactgtcaatgctctccatactactggaaatagtcattggtacctctaaatgtaagtgaggggaaaataggatctggaggtgagagacaggactagctggatttcctaggccaactaggaatccctaagcctagctgggaaggtgaccacatccacctttaaacacggggcttgcaacttagctcacacctgaccaatcagagagctcactaaaatgcgaattaggcaaaaacaggaggtaaagaaatagccaatcatctattgcctgagagcgcagcgggagggacaaggattgggatataaagccaggcattcgagctggcaaccgcaaccccctttgggtcccctccctttgtatgggagctctgttttcactctattaaatcttgcaactgcactctcttctggtccgtgtttgctatcgctcaagctgagctttcgctcgccatccaccactactgttagctgccgtcgcagacccgctgctgactcccatccctccggatccagcagggagtcagctgtgctcctgatctggcgaggcacccattgcagctcctgatcagggtaaaggcttgccattgttcctgcacggctaagtgcccgggttcgtcctaattgagctgaacactagtcactaggttccacggttctcttccgtgacccacggcttctaatagagctataacactcactgcatggcccaagattccattccttggaatccgtgaggccaagaaccccaggtcagagaacacaaggcttgccaccatcttggaagcggccagttaccatcttgggagctttgtgagcaaggaccccccacccgggtaactgaggcagggaacatgagatcgattcacacttcagctatgagagaaaatatcctctccatttacatagggcatatgctcagtaaatgactttgtaactttacttcatcctctacatttatgtagagtgtacaccaagtaaccaatggaaatctctcaagggtatttaaactccccaacattctgtaacagggcccttgagctcctatgctcgggtccattcccacactgtggtgtctacttttattttcaataaatctcttaattcctccctcgctttgcttgtgtgttttgtccagtactttgttcaagacgccaagaacctggacaccctccgccagtaacataagcgtatcagagagcagattttagaaagcctgaaatcaacccagacaactcattctcaaaattctttctccagggcaacttttggtatcaaaagctatatgagttagggttctccagagaaacagaatagatgacagacagggagatagatagatagatagatagatagatagatagatagatagatatagattacatagatagatacagattacatagatagatacattgagcaagttcattggtgccatttttcaaacattatgtgttcacttcatgtccgcatgtcagcatattttagccataaatatttttaattaaggcatatatgttgttttttagacataatgctttgcacactgaatagatgatagtatagtgaaaacataacttccgtatgcactggcatccatgcacacaatacatatgcatatttcccaatctatacatagatattagtgagcataatggagaaaagaatcatcaaagcaagaattattgacttcagatgggattgtgctaactttctctcacttctcaaaaccaagtgagaattctgagaaattcaataagggacaccttgtggagcaacaatgattaccttttgtgatgagattgtaaagataatgacacatgtataataggaaaaaaataagcattgctttctataatatcttactgctgcccaagaggcccattgttggattggcaccaatggtagctatggagaggcaaatgtagatgtggaaactgggacagggactaaactactccacataataaggattagaggaatttgaggtgtgaagggtgagaataaagggaggaatgtatgaagaagaagctaaaaatgataatttaaagctttgtaggggcaagaacagagtaaaaaacctatgctgatggttctgaaggaaagaaaatgtaatttttacttcagctctcataagttcatagttgtgacagactcctacaacaaaggacaaggtaacgagaaaaacaagcaagttctttaacacatgcagggcatcacatggaagaaaagtaactcaaagcagtagtctaggagtctggcttatacagcatgtcaacaaggagcagtaggtttcacaagtgaaaagacaaagaaaagcagttacaggcttccattggtgggaaacggtaggaaggtaaatatatggaaatacactaataaagtcaagtcggcttgagattgctctgggccatttctgggctgataagagttggaatggagaatttacatactgtctttaggggagaaaagaaggagagagtaggaaagtgttttcttctgtaaatctctatcctgcttttaggcaaacagagggaaggcagagactcccctgaatcttcattgtcttcagctcaacaatatttatgtcaaagaagcacattttgagatgacaccttctggtttccttcagtctcccctttgaaactttcctttcagaaagttttacatagaagagccaagttggtagctttggagcaatttggctaggggttgtgagataagggattggcaaaggcagagaaaaacatagattgaaacaaacagaaaagaacaaatttgagtaagttatcccatatcttattgaatcagtctctgagtcctgggaatacatatggtatttaaacaggtgtgtttcatttcaggatgtggccttgcacatgtgttcccatcaaaggcctccatatggtgcaggcaaatatatttatgaagaagcatttctatggaaataaaagaaaaacaaaagattaataattggagccatctacaaactactatctgagtctggagggcagccagctgagaagatttctagatgttcaactcaagcatctttttttttttttttttttttttccagacgaagtctcactctgctgcctacactggagtgccgtggtgcaatctcggctcactgcaacctccgcctactgggttcaagtgattctcctgcctcagcctcccgagaagctgggaccacgggcatctgccaccacgcccagctaatttttgtattttctgtagagacagagtttcgccgtgttggccaggctggtctggaactcttgacttcaggtgatccttccacctcagcctcctaaagtgctgggattacaggcatgagccaccacgcccggcctagactcaagcatctttagttgaagcaggagcaggcagtggcaagctgacaaatatttctggtttgccatttaaatgtcgtaaagcttgtctataaataagctgttgtgatttcttggaagtttgtatcaagttgtctggcttctgcttggaaaagcacagtgttagttttcataatttcaaggcagaaataatggaagaaaattttcaaatactagtttggaaagtcacagccagacatttgagaaaactaaaagaattcagaatccagtccagtttacaggtaaataataaaatctcaaaaacaatgaatatggttagaatctaattatcaggtgcataacagtttcctatttcttttttatgaaatataaattttttctctgtagtccccctatttttaccaaagataataatggtaagtccaatttatttgcaaagtaagtttggtccctcattaaatttagcttgatcacttacatagtacagcaagaatggtgattgatcatataggctttttataaatttgctttgctggatctttttataaggaatctcacattagacttttgaaaacctcttacaactaggaagctaagctaaggactcacgatcaaacgttgccagtaatgcctgtcaatgagcacgaatacatgtgttctggaggttcctcaaagtatcatgagtttcctgggcccatcatgaaccaacattgtttactcactgtaagtacagaaacgttgtaaggaaaccatgtattcaaggtaccaggccagttttttcaaggggcttttattggctccataaaatcagccttaatttcttaaaactctgtggtcatgtctgaaaatatgacattcctggcagctttggtaatgtaatcagtgtttccaattgttgcctgctgcaagaagaatatatttttattaaacttatacaaataactatattgtcatagaagtaagaatacttctaaatagttttcaaatttttaggtagggagaaaaggtaattgttttaattctgctcacaaaaatatactttaccaaatgccacaagctatagatagcttaagagaaaagttttccttaagtctggaaaataaaatataaaatgaatcagcaatgtttcaaagaaaaatctatttaaaaattataatccttcatcagttctgtgttgtgcaatcaattcttttgcttgatgttaacaattttattaactcacttttcccattagttttcaaaattcttatccactcaacggagtgttcttaaagttatcagaaacttgcttttaacagtacttatcagaatcttcacaattttctctgaaaaagaagtaattttggactgtagctgattggaaaaaaaaattagataagaatcaaagctgttggctgggtgcgggggctcaggcctgtaatcctagcactttgggaggctgtggcgggcggattgcctgagctcaggagtttcagaccagcttgggcaacatgatgaaaccctgtctctactaaaatacaaaaaaagccgggcacagtggctcacacctataatcccagcactttgggaggccaaggtgggcagatcaagaggtcagcagatcgagaccatcctggctaacatcgtgaaaccctgtctctactaaaaatacaaaaaattatctgggcggggtggcggggcctgtagtcccagctactggggaggctggggcgggagaatggggtgaacccgggaggcggagcttgcagtgaaccaagatagcgccactgcactccagcctgggcgacagagcgaaactccgtctcaaaaaaaaaaaaaaaaaaaaaaaaaaatcaaagctgctatctatggatgacaaagacttagaatgacgtctgaactctcatcaggttgttagcaatcttgtgaacccagaaaatctgagacaggtctcagttaatttagaaggtttattttgccaaggttgatgatgcgtctgtgacacagcctcaggaaatcctgaccacatgtgcccaaggtggtcggggcacagcttggtttatacattttagggagacacagcaatcaatatacggaagaagtacattggttcggagacacatcaatcaacatatggacgaagtacatgggttcggtctggaaaggcgggacaacttgaagcaaaggcaggaagactccaagcagggagggagcttcccggtttcaggtaggtgatatacaaatggttgcattcttttgagtttctgattaggctttccaaaggaggaaatcagctatgccactatctcagtgagcagaggggtgactttgaatagaatgggaggcgggtttgccctaagccatttccagcttgagttttccttattgattttgggggcccaagatactttcctttcacattccccctcttttcttttaaaaaaccttttggaaaaagcattttacaagaagatgaatctccggtctcaggtttcatctgatctctcatgactagaacggtttattcctagatggggaggtcccaaaagctcatttttagcaggttgtgaagtctcatgtcctgtgaagagaaaatagtgggaaggaagggagaaaaagcaacaacaaacaaaagaacaatcctggaaaaatcgatataggccacgttacgctgaagtccatacattagtaggcaggtgtgaaagtggcttttggatgtgaataagtttctattattttcttctgaaatttaagttgtgtggcttcagtttggagggtttaaagaaagcacagcttagttttcagtgactctgaattaggaaaaatgaaaaagaagacggaaaaaattgaaaatgttattttgaatacttgtagccaagaaaaattataattcagtccaaactgtagaaaataataaaaattaaaaaaaaaattaggcaagactagaatctaataatagatgtactatagttttgaaacatatttttttctctccagtttcccatttttaactaaaattatggtaggactggttgcctttattatacttggcctaattatttgtatatagtgcagcaagaataattatttttttacataggcctttacattggctttgatggaactttgttccataggaggaatctcagacaagacttttaaagccaagcccagccatggatttgtaccatcaaatacctatgggttgggtgaatttcctctcctctggaggttccaagataaacctggggcttctgcacctgtcagaaagtgacattctttacttcccacagatcacaagccctgtacagagactgtgtacacaaaatatgaggctagtttccaatggctttattggcttcataagtcaagtttgattccttaaaggaaagcacaccattccagtcaaagccatggtaaaataaccagtttcttcaattgtgtcccactgcaaatgaaaacagtttcttttttttgacagagtcttgctctgtcaccaggctggagtgcagtggcacaatctcagctcactgcaacctctgcctcctgggttcaagcaattcccctgcctcagcctcccaagtagctggaattacaggcacacgccgccacacccagctaatttttttgtattttagcagagatggggtttctccatgttggccaggaaggtctcgatctcctgacctcgtgatccacccacttcggcctcccaaagtactgggattacaggcgtgagccactgcgcctgccctgaaaacagattcttattgcacttatgcaaataactgtattgccacaccttaagaatactcacaaagtttccaaattctggagaaatcacataaagagaaacaaatgtgctccaaattttgttcataggagtataccaaattgttaaaagctgccaatagctcaaaagaaaagttttgagactctgaaaatgaaacaaaggatcagcaaacatattaagcaaaaagtcaaaaagattggtttagttcatgcagcgaaatcctgttctgcttgatactcttgaaaattttagctctccatgagtcctgaaactttttcctctattctgatgtcacaatctcccaagttatcagaaacctgcatttaagagcacctgttggagttttatagctgattataaaagcaccttgtaaaggggaccaaaacaagacaacaattgtccacaggtgaaaaaaagttttaaggcagtcatagtcaaaagacacaattgacaaggaaacttgttacctctggcacacaataatttttacataacaattatgattattactcacaatatacgctgttatatcagaattacatgagtttcccataattttggaacacataccaataatcaacttatacaaatacagcccaaagaaaaccaaaaatatttcatatttgacaatgctttctatataatttttataccaaataagccaaattatgtcatttttggactttaggaaactaatatcttaaaggattaattaggttagaaagagacataatttataacttgattttggaaagtttgtcaaatataaaaggtttaaaacatttgatattacaaaataagattacaggtcattgtaaaatcatttatttaaccaaaatgataattcaaggatttcaaaaaaaagcaaaaaccttcattcattgcaagagaagacttaattctctaaacaagaagccctaataaagacagagtgaagccaattacatttgtttttcaaaattttgtaaacaatctataaaatttaatcttgattataaaacttccataagccttttctaacctttataacctttattaaggggttggttcatgcttcaagaaaaccttgctaatctgacacaggggtccatatactggttttgcatcagcgtgcctttgacattaataattaatttgtagagaaactgaacttactttatctttcaaaattgacccttacaatcttatgctcccacctcttttgcaattgtccctgggtcttgaggagttgcatagctttaatttctggccctgtgtctcaggaatgtagtttgttttgattggcatcctctatggggcctgaagatgaggctttaattgttgccagtgtttaagatttaacaggacttgttgtcctttttagaccaaggaattaaagccctctaactcaatgttacaaggactttaaaagcatatacaggaagatacgtggatataataacctcaatttttaaaaaaaattatctccatttttttttcctaagcaaaccaaaacttaataataatatgacagcttgattatataaaagtttttgggttttttaaatatataaaccctcttattgtgactcacactgactgctcatcagactttctgatttgttttgaatatcccttctttttaaacaaccagttatttcattttagaatgaaactatacaagattctttcatatataatattatttctctttaagctttttttaacctcaaaaacaatctctttattttgataactttctttacatcttttttatttcctgattccttttaccttgttttatacataacctttaaataagctttgagttagacaaaacttgttcacctttaaagaaaaaaataaaagagacacacttgttttttgtttgtttagcaagaatgttttcctacaatatatatttattggaaaatacccaaataatgaaatatcccttatttggtttaatgtaactttataatctaaattatggccagtttgtctacaagtatttatcccattatatttacctaattattttattttgtttacatagattctttatgaaaattgtgatagtcatgatttaaagttatgaaaccaccattgcaaaattataactgagacagtggaaaaagatttaacgtaactgattccatattgctcttaacctccaggctgtccttgttcattcctgggctcaggctgaactacctttgggaggaacttagtttatagtttagctttgaaacaaagatgataacagtcgttttgcaaaacaaacctccttattgtctgtggactaaattgcctaaagccacaggattagaagttatggtaaccttactaaattcaagatggaactattttcattaaagtcatattgatgtcttatttattaaaaattacacaagcaaagatcattctgttttggaccaggtttatagttttgtaacccctatgccaaatttttaacaccttatagtgtttggcagggataagtatgaaatagtttaataaatgcaaacaaaaatgtatgctggcaattcttttttttttttttttttttttgtgacggagtctcactccgtgtcccaggctggagtgcagtggcacgatctcggctcactacaagctccgccttccaggttcacaccattctcctgcctcagcctcctgagtagctgggactacaggcgcccgccaccacgcctggctaatttttttgtacttttagtagagatggggtttcaccgtgttagccaggatggtgtcgatctcctgacctcgtgatccacctgcctcagcctcccaaagtgctgggcttacaggcgtgagccaccacgcctggtctatgctggcaattcttaagacatttctaatatgactttaccaagttagctcatgctggtcccaagcaccgatagatttgtcaaaggtcaggggcatctccactcagaatccccgcaatggttaccgaaatgtgaacccagaaaatctgagacaagtcttagttaatttagaaagtttattttgccagggttaaggatgagcctgtggcacagcctcaggaagtcctgacaacatgtgcccaaggtggtggagcacagcttggttttatacattttagggagacgtgagacatcaatcaatatgtgtaagaagtacattggtttggtctggagcaaaggcaggaagacttaaagtgaggaaggagcttccaggtcacagataggtgacacacaaatggttgcattcttttgagtttctgattagccttttcaaaggcggcaatcacatatgcatctatctcatgaagcagaggggtaactttgaatagaatgggaggtgggtttgccctaggccgttcccagtttgagttttccttagtgattttgggggcccaagatactttcctttcacaatttgctaagagtttattataataatgatacaattgaccaaaaaaagtggttatttctgtggcatacaatattttaacataaaaatcgtaattatgacagataacattttaatacatacatattatgtataagaaatcttacagaattttggaacacatgttaatatactcatacaaagataactcaaaactgttgaacattatttcttatttgacaattcctcccatgtaatttaatataaaaaataagcctaataagtatatcttttatatttcctttgggaagttccagggtcctttgggacatctcaaagttacactaaggtcaaaaagacttaatttagaatttgatctttgggaaattcatcttacagcaaaggtataaaacacttgattaaaatataatcacaggttactatgaaatattagtcatttacttaactggagtgatatttacagatttcaaaagcaaataaaagaatttatagacttgtagaaaaaccttaactctttcaatattcacttttcttaagtaatcagagacctaatgaagacagcatgaagcataggaaattatcttgatgaaacacagaatttttctctcttctttctctcctctcactttttttagtttacttaaaagagaaacaaaaatattttactgtctcttatcaattccacatgaaaattttgtttttaaaaggtcatgttctacttttgcatcagtgcacttttgatatgaagatttaatttttagaaaaacttataaatatcatctaagtttagccagcttgatatacacaaaatttctttcacaagatttatcttcaacaaacctttcacaactttctaatccattcattttatctatatcactccttttgttattcattcattctgcaaaaacatctaaataacctccaaactaagcaaaactctccttcctcaataaaagcatatcataatatctcatgacactgtaattttcttgtatactttgtgtacagaattatttccttatctctagtagtttaagttacatattagaattttaggccttataacttaatttccagtaaaaatccaggaagtaagatattttgaagtcttatttaccagtattttataagtacatattttataatttctagagacataagctttctcttagaacaattttttcatgtggaacaggacatgtttactaacatctcagatatatttgtctttatgtaaaatttaagaaaccaaaagtaaataaacttatgttcagcaattaatgtttcagtattttatcttatttggaactgatctagatcttcaatgagcatctgtcatttaacttagcaaaactgtaagggtataggtagagacttgagaaactaagtaagcaccttataaaatatagctttttaagagtatttttataaacttttacctaacttacatcttatttaattcattcttttttaacaattatgcctggaaaatttatgagacattagacaaagctagtcatcaaagaagataatctgtttgatttaaaagtcacttataggccaggtgcagtggctcatgcctgtaatcccagcactttgggaggccaaggcaggtggatcacctgcggttgggagtttgagaccagcctgaccaacatggagaaaacccatctctactaaaatacaaaattagccaggtgtggtggtgcatgcctgtaatcccagctactcgagaggctgaggcaggagaatcacttgaacctaggaggcagaggttgtggtgagccgagatcataccattgcactccagcctgagcaacaagagcgaaactccatctcaaaaaaaaaaaggtcacttattagataaaagtctaaaggtcctctaagttcttgttgtcttgaaatcactctacctaccacgttattaatttggaagcctatttttccctgttttggccagaaaaaatttaaaacttacagcaagcttttgaaatcagtaacagttcttttttcttgtgtctataggtctgtttaattgtctagttagtgtaggtgagaaatggctttcaaaggttattttcagggttggtgttttgttgttattgttgttatttttcttatccatgcactgcagacaaagcatttttaattgtcagataagcataccttttcttgttgttttcagttcaagattttggccaaagcaaaatagtggtttaaaaagtagacttggttaatctgtgttgcagctcttcactcttgttgtttggcaagtgggagggagtgttacagctcttttattcccaccatgggcaagcgccaggctcttgtcccatgacaaggaagaataaggcacatggacaccagagagagtgaggcagagtcagatttactaaatgatagaaaagcacttagcagagagaggacccgaaagccacccatgagtctgagtttgggggtttttatggactgcaatgtgagaggagtgtgctgactggtctgcaagctgtcttggagacagcaccactcaaaaagaggtatgatagtgtaaacagccaattgaaggcagaggtgaaggcttggcctgggacgttggcctgggacaaatcagtggctgaagtgatgattcactctatgtaaatgaagattcagcttgttgtcaatcacagaaaggtaggcgtatataaaataagtgaaaagtaagagactaaggtgcaccaaggagagagaaatgtgtccaaaaaggaagtggaatttgttcatctgggttcacagagtaggtgtttccattcaaggatgctggctccttcttatctggggcctgcagtttgattttcaggctgttcttggtttgaaggagttttaccagggacccaccctaattgcctgcctgactggtttcttcctttctcctctctcatgagagtcatcaacagattcagaataaaagttgtatgtctacagtgtatttattgctgatagatatgtctgcttaaattaaaccaatagtattaaactagtattatttaccaaagatttacccaagtaacataaacttagaaagcatttgggttagttcctatattttatcatctttaagcatatattttatatgagtactcatttatgtctttagccaattaaatagactattttaagagattttatatcatatagacataatgtgcaagtatacatatacacatgtataaatatacacaaacatacagatagacacaaacaaatatcttgtagcttttatttttaaattttagttaagagacaggtataatagtataaaacttactagtctataaaaggacagttagatccattagaaagaacagagatgcctcaaaatatatattgatagattgataggcatagcctgaatatcagcttccaattaaactaacttttgaccatagacctctttattaaaaatattcttttcaaatatttttattatcaaatttagctggggcaaacagcaaacaattctgcttcctagcttctcgttccctgaaatttgcatttgaaaagggatggtttcttggtaaaactgattaggaaatttatatctcaaaggctcagggaaatacagttttcaccaagaaggtattttggggaggtatatttgcctattaaaggtctaggataattgctattcaaaattccttttttaaaaagtgcaagagagccctgtttcctgatgcttttcagtatcagataacatcctgaggtgaataggtgaggtttggggttttctttgaattgctttaaagcaattaaatttttgtttttgtaaagactcaatttgtaagacaagaatagttactttttttttttttgagatagagttttgctcttgttgcccaggctggagtgcaatggtgcaatcttggctcactgcaacctctgcctcctgggttcaagcgattctcctcctgcctcagcctcctgagtagctgggattatagccatgcgccaccacacttggctaattttgtatttttactagagactgggtttctccatgttggtcaggctggtcttgaacctacaacctcaggtgatctgcctgcctcagcctcccaaaatgctgggattacaggtgtgagccactgcgcctggcctaagaataggtacttctaattcccttaagaattgggtggcagcctgaatgattttaagggactgtcccatctatccaactatattatctttaacttatttctctctatcaaggagcagattttcaactaagatgaaaatcaaaagatctttctgttccagatatagacttaattacctttgaaatgttttaatatttttttttctgaatatatcgttccattttagctaaggagacaaggcaaaaaaagcaaacagaagtttctgtaagaacgaagtttcaaaccaaaggtatacctggaaaatgactcaaggcaaaattaatacttaagacaaaaccaataagactttaaggctttaattaacatctccaaaaaaagagcaaaaatatgcatccctttcaaaatacagaccctcccaaaaaacagccaaaagcgagaaaacctttgccagccacaaatagggtacaacaaacattttcctccagagacattcttaagtctcccaaccttttggctggctgcctgcaaacaaaggcccaataacctgtgggcctttggtggatgcaaagtcataaagacaatagtcagtaagacaaagagaaagacaagcttgccattaggtgtagggggaaggatcactaatgtaggggccaagggaagacttcccccacttattgtagggacaataaatgattaccagagagaacaaacggatcagggagcagagattaacctgtaaatgatcctccttggaaactgagcctgaaagagggacattatcttgtgaatgggtctggtcaggtgtggttccattcttcagtcttcttttctataataaataataagatgacatggaggggaaggaaacacaattgctccctgtggtctttatgtaggtggggaaggtctgccagcatctgttgatctgtaagggcccgtaattcaaaatactgattataccagggagccatattttagagtaaaattccctgcactcctttactaacaataagcctttatatgacttaaaaccacagatgcaagtatcaggttccaaagtgggtgcaaaagatgcagcccctcaagatctaaagtttttacctaagataccctaggaaagcaaaaactctcattattaacaaggtaacgaaggttgaggcaattaagacaaactcctgagagctggcatggtgagacaaatgtttggacttctagctagccggcataagtacaacaacttgtgatccccaggctggcccaagatactacaaagactaacctttgagacacagcagggaccccctattagggccctgagagccccccaaaaagcatggaaatatggaaagatcttgagttccttcaaaggaaattccaggcacatagctagccctgagaagtaaataaacaacttattaaaggagataatagtagcctgaaacgatggccaaggaagctggggtcaggagatgtttgctttccctatggaaactaaggatgacatcttaacatatgtccctgagttgtctttcagaaacatggacccccaccaggatccccacagaacagattcactggcatgtagacctcaaatgagggagaactgaaggctgaactgtgaccaccactctttgtcccaaatgtcttcctgagaggcctggtgggagtcacacccatgagctggttaacattcttttctgctgatccctaattttaaaataaagcttctcttccttaatcaattgcaaatcagaaaatctttgaatgtgcccatgacttgtaagcccttgctacaggatttcccacccttttaggccagaaccaatgtaacctccatgtattgaattatgatttttcctgtagcttctactcctgccttgaaaaattcttgcctgcaaaccatttgggaggccaggatttgaagatgagctgtctggtcctgcttgtttggcaccctgaaaataaatgacttcctttctgccactgcaacctcagtgtggatatctggttttactgtgttgggtgagtggactccagttctgtaacaccttgctggttacaaagccaaactctcaaaacataaagaaaaacaaaaggaagatattttcataattttcctccttaagacaaaccacacaaaagacagagataaggaaaacaaagacctcctggaaggctaaagatcaataactaggctgggcttggtggctcacgcctgtaatcccagcactttgggaggccgaggcaggtggatcatgaggtcaggagatggagaccatcctggctaacatggtgaaaccccctctctactaaaaatacaaaaaattacccgggcgtggtggtgggcacctgtagtcccagctactcaggaggctgaggcaggagaatggcatgaacaaggaggcggagcttgcagtgagccaagatcgcgtctctgcactccagcctgggcgacaaagcgagactctgtctcaacaaaaaaaaaaaaaaaaagatcaataactaacaggtgcccaaaccaaatccacaagagtcaccaattcaaataattaattattttttcaaaatcatttttttctgttgcaaatttgaatttaaaaaacaaaaaaaataggagttttgttttttttttcctttctctctcagcgaggcactacacatagagatacgagagagctcactttggtaaaaattctcttttttctgccagcttctgccacttctcccaggatcacatctgcagctgtcagggcaagtggagtgtgccagaatctcttggctagatcaccaaaatcaagcagagaaaataaaaattttaactcaatcctcccaagttcacagttggaacagactcctgtaacacgagactgattaacaaaagaaaaataggtgacttattaacacatgcagtgcacatcacctgtgagaaaaggaactcaaagcagtgatctaggacttacataaacaaagaacaataagttttatacaagtgacaagacaaagaaaagcagcaccagacttccaaacaccagaaactgtgggaaggtaaatatatggaaatacactaacgaagtaaaaatctgctcacagattcctctgagccatttctgagctgatgagcgttggagtggagaatttacatccgtgtttatgtgagaaaacaagggaaggataggaaagatgttttcttctatcaatctctgtcctgcttttaggcaaacagagagggaaggcagagactcttagttgagaatctaagttgtcttagagaatcttagttgtcttcagttcaacaatatttatgtcaaagaggcatactttgaggtgacacattctggtttccttcagttcaaagaccagattttgaaggaaagacatgactgataaagattattcagggatttgttcctctctctttagtacaaaatagctataaaatttatgctgttcacaaatgctgggggatttgaagagttgctgaattttgagccaaggacatgtgtatgtatataaacaatgacatgtatatattttttctttttataaacttgtaaatttcttgaaatccaaaataaattcatataaatttgtcctccaattgtgacttctaagaaatatttattaaatgaaagacatcctaacaatgacactaactcgtcctccagacatcattacagttggctccttgtcatcatttggcccccagtgcaaatgttcctcctcagcagtgctatagaaagcagctccaccttccctaggcaccctctacagtatcatctattcattatttaattgttttcacagtattaatcagaacctgaaattatcttattcaagtatttggttactgacatgaccactctccttcatcctggaagcattatgataactaagacctggtatgttttcttaccattctactcctagtcccttgaacagtgcctggtatataataggtaaatactaaatatttttcgaatgaaggaagggataaataaatgggttcagtagaatccatttcactcaacggaatccaactgaaaacatactctctagtcagcaaggtttttaacatgcagattagaagctctggggaggggttgattgtatctaggaggatgtacttaaatttcttctttgggcataggggcttctggcaaattttgtagcaaattagtatttctattggaatcctagtcagatatttctgagttttagacctaagtagttttcacatcaattatgaaagataaaattatttcaaaagatacttgaattcaaatctagtatatagagtgaatgcattttaaaagttaaaaaaataagaaattaggttatatttgaaagaatctcagctgaagatttttgtgcttttattacaaaggaagaggtaccactctcgccggttttacatcttgcattttaaaaagttaagtacagccagacacggtggctcacacctgtaatcccagcactttgggagaccaaggcggaaggatcctttgagcccaggagttcaagaccaggctgagcaacatggtgacaaaattaaaaaataaaaataaataaaaatgttaagtagtgatacgagaaaggagcaggaaagtgctgggttgagaaagatggggtccctggtgagagcttcactctcgagcctgtgcccacggacccaaatgaggacaggcatttctgattttgtgtccaaaaagttgccctttggcccacgacaccccccatcctgtgcccataaaaacccaggacccaacaggcacatacacaagtggctggacattgagaggagcagaagaagacacactggcagacatcagcaggccagtgataatggaacgacacagatgctgaggggaattcggccaggtccagtcgaagaagagtccagtgctgggcagcccgactccaggggaaggccacctttccactccatcccctttccagctccccatccatctcactgagagccacctccaccactcagtaaaacccagcacttgtcctccaagcccacatatgatccaatttttctgatacgctagagcaagaacccgggatatagaaagccctctgtccttgccataaggcagagggtctaatcgagctgattaatacaagcttctgcagacaacaaagctgaaagagtgcactgtaacacgtgcccactggggcttcgggagctgtaaacactcaaccctagacactgccatggggtcggagcccagaaatgctccccacaacctgcctgcctgcatgctccccgtaggggtttgggcagcagggcaagccatgcccctgtcacatgccctgagaggggggataagggaacttcttctgttttagtaggaagtactcgtctagctttcctaccagttaaaaataaaatcaaggtcttttggcttgtgtacaaaaaattcatcaggattgtagttattgtaatgcttattaataatctacaatggatcttcagttcaactcaaagtcatgatggacactgtttggcctccagctatgatctcagccttagtgttgaagaaagcccctgaaatacgggcagacagtgatattcagagccgcatgtaaagagcctttcggaaatcccctttgctctgccctgtttcattccacatccgtctgcaccttagccagcattgcatctattctaactaattggttcttaaaatgataaagcagaacaacagataacaataagaaagtcctggactgtgggcgcttctatttgtagagaatggaagactaactgagcctatcaatattttagtctcaagagcattacccctggacagtataatgctgctaacttgtctagagaagtatcattgtacgtgctaagtaataggaagaatatgtctagcatcaattataagttgcaattcacactgtgcagggtgctcttcaaagccgcaataccttcatccttacacaactgtaaatcatgattttatttcagaatagggtctctgcttttttactcactttgaaaagaatctgacacagtgtgaaagtgaacatttaataagtacttccttctacacctgcacacagggaatggatgataaatgctgttgtctgagtttatcatgataagacgaggcacaatggagagacaattaatgaatatcctttgattgatgataagacaagcagtacaaatatggatttttcttcttttgcagctcttctcaaatagctctaaacaaaagcaaaacatgctctggccacagaaaagacttacgacacaagattatttcttattgccattaatttcatcttaatagacattattagcttattacacagattatattatattatatttgcataaatttatcacatagcttattatgtgccacacaccatttacatgctatatacatgcaaatgtgtttagtcctcaaatccaccctaataataatgatggtgataatcataacatactattatgattcctatttctacagatgaagagaatgcacagagagaaagtatcttgtcaaagagcatggtgctagtaagtgtcagagtcaggatttgaacctaggtagcccagtacctgaatgtgtgtacttacactatttatcatttatttatatttatttattgtatttatttttattatttattatcatttatttatttttatttttattttattatttatttttattttttattatttatcattcatttaatatcatttagtgtaggaacaccaaatgatgtagtgaagtaattttctttaacatgctcaacacataaaggacttcacactataataaacccagagatattttaatgagctccataggaacatatctctaagttagtcatttaacttaaaatcccactgtacctagcttccactattagtaaatcaaagagtgttctatcaaaaaattccttttctccttacctccaaccctccttatttcatagaccttgcctaccacactttctaaatggagatgtagtcccagttgtatttctactgttcagagagcgaacaggcatccgtctccaactacaaactatacacttgtgctacgtgactgagaacagcatgtggatgcaagttcaccttggaattccaccacaatgaagctgtttgtgagccgctttctgcttaaagaacactttaagtttcctcagtaaacatcttttcataatgtgaaggtaatctcaaattttatttaatactaagtaggtcataaaaagttagagtttataagtttcatttgaccatttcttgttgaaaagattttggaaatgaggacataggtctttcttgaggcagaaagcattatggatataaagaaaaagataaagagcatagggtcagagagacctcagtttaaattttaaacacatctgagcctcagtttgcacatccttaaaatggggtaaatactacacctgacacacataaggtttatctgtaatgtgcaaattaacaatgtccttgccaacataatatttaaaagtctgctttgttcccaaccttgttagaatttccatttgggtcttctgcacattatttttcaataaaatgctgatttttcagtccttgaccctcttctcttaactcttggtagtaaaataaatctctactcagacaattactaaagttccatctccagcctggacctctcccatgaaatgtgactcatatattcaactgtctgcttcacttctcttcagaaatattataatataataatattattataatggtgtaatatataataagtatctcaaatgtaacttcttcaatactacacttttgacttggacactcaaccatagttcatgctgcagtctttcttatcacaatagatgacatctcttgcttcttagtacacagtcctaaagctctggagttgtccttgagacatttttctctgaaacttatatcttgacaacagcaaattctatctattctacatgtttaaaaatatttggctgcttcaaggtcagaaagatattctcctatttttttcttataaaaacatcactgtttaatctttcatttttagatctggaattatttttgtgtgtattgtgaggtagaagcaaaatacattttttgtattgatttccaactgacctacagccatttattgaaagggtcatcctttctcccactgccttttttgtcataaatctagattctctactcttttccgttggctttagccattggcatacatagttaagatttaattactatacctttataattggcatttatatctaaaaatgtaaatcttccagctaaattctgttttccttgactattcttgatcatttgcaatttcataggaattacaaaatgagcttgttaatttatgtaaacacacatgcatacacaccctgctaagatataggattgagattgtgtggaattccagatcagtttagagagaattgacaaaaatgggcacaagactgaaccagcacttaagaagagtatatccaaatgaccaataaatatatcaaaactttattcttcgtcagagaaattaaaattaaaatcatattaagattccactacatatttgccaaatgtctagaatgaaaaacacaggtaataccaaatgttggtaagaatgtagaacaactagaattctcaggcaaaactttggaaaagcatttggccgtgtctactagaaatgaccatatgtatctcctatttcttggcaatttcacatctaaaatatgtgcaacagaagtggatatttatgtccaccaaatatgtatgtatgtttgtgggtttgtgtatatacatatatatagaaaactgaatgagagtcaacaataggatggataaatacattgtgctatagtcatacaatgaaatccaatacagcaatgacaattaacaagctacatctatacaaagcagtgctgatgagtctaaaatcatagtaggcaaaataagttagacccaaataatacattttgtattatttaatttatatatatttcaaaagcaatcaaaacaaattcatggtgatagaagtcagcatagttgttccccctggggaaaagtgattcaaagagacacaggatgagccgggtgcggtggctcatgcctgtaatcccagcactttgggaggccaaggtgggtggatcacctgaggttaggagttcgagaccagcctggccaacatggtgaaaccctgtctctactaaaaatacaaaaaattagcctggtgactcatgtctgtaatcccagctactagggatgctgaggcaggagaattgcttgaacccagaaggtggaggttgcagtgagccaggatcacaccactgcactccagcttgggggatgagtgaaaatctgactcaaaaaaacaaaaaaacaaaacgaaacaaaaaaaacagagacacaggatggctctgagatgctggcaatgttctgtgtgttatctgcatgctagtcacagtgatggcggtggcagcccttctggagcagcctctgcgggacaccagctgcagtgggggaggtgtggccggggctgcgtgctacacagagtcagccaggttgggaacaagtgggagccccaccccttaccaagttggcaggttgggagcccagtgctctgggaacagctgcagccacccagccacggctctggactcggcatccctgcggtctcagtggcccaggaagccgcccccctcaaccaacagacttggaattgcctcctcctgttccctggtgtttccctgctcccattgcctccaattttggagcaaagttgtggcagagccaaagtgctttggcaacctggccatgtatgtgtacgctcagggcagcgctgacacaccagccccctgccacctcagccccctctggactttgggtgtcaacaagcatgggagggaggctgaggggacgctgagggtggctcagcatgggcctgcaggtgcccctcagcaggaacagccttagtgctgtggatggcatgttgatggtggcaggaggcaggctcctgggtggaaaggcgtgggtccccagtgaaacccaacctttaagccagggacagactgaagcctggggaccaagctgccagctccaggtggagtctatggccaggagtgagaacttatggtgctttttctgggccgcccatggccatccatggaccaatcagcacgcatttcctcccttctgagcccataaaaaccctggactcagccagactcaaacagacattgagactaccagctgcttcataaattagttaataaaagctagtgagttttgaatgccacattagtagaatgaacactttttttttcttcaattatcttaagctcaggggtgcatgtgcaggatatgcaggtttgtgacataggtaaacgtgcaccatggtggtttgctgcacaggtggtcccatcacctaggtatgatgcccagcattcattagcggttcttcctgatgctctttctcccactcccaacaggtcccagtgtgtgttgtgcccccaccctccatgtttccatgtgttctcagcacagaatgggcgtttgaaggaagactttgaagaagaaaatgggaatgatttccagtaagtattttttatcagtctttttatgactcatacaaatatttgtgggcctaaagtaaatgtaaacactaatcttaagaaatatttgtcctttttgagttttaatgtgtctttatgtttgcatttatccaattaatatcagaacaaaaatatataataagtactagagacaatttaaagaaattaaactgtttccagaaggtagctaaataaatcattacttgtatttagaggcagaaaatagagaagtaaaatttaatgctaactttagttgatgtactgtgtcatataatatattgcaatttttagctaatttaaattaaaatagttatatcaatgattttgaaaccatgaagcaacaattatcataaatgttgttttttcaaaaattagatggttccagtagtttttgctacgtgaaatctctgactactacatcatctaaggcactttttacgtttcgtttataaagctcataaaataacctaaatgaaaaagataaatagtaaaaagcctgaagagctgatggagctatgtttcttgatttattcatctctattccatatctgaaaaaataatttatgacaatttctttgtatggaagaaaaattttataatgtttagatctattgggggaagaatgatttcctaggatttgaagctataagaataatggaaaaaaagatatatcattcttctatcttttatcatgtgtaaagtcgatttttaatatggcaagatattcaatctaaagccattaaagatatttccaaaaccttacaccagcttcagatatgttacctattatacaatgactttatttttaaaaagtaaggaaatattcatccttttactagtagtagatgattggacagctgtcttcattggtaatttaaatgtaattttgcctgaagtagatagaaaaactaatcacctcttggggtcttttacagtgatataattttatgccaactttcaacactagaaaagtaagcatattctttatgaaataaccagaatttatagctgaaaggaattttagaaatctagttcaggggtcagcaaactactgcccattgcctgtttttgtaaataagattttattgtaacagccattctcatgtttattcactcatttgttgaaatgttgtctatggctgccttggtcctacgatggcactgtggaccagttgcaaatgagaccatatggtctacaaagtaaaaatattccctagaacttgaagtataataaaaaaaaaaattatctagccctttacagaaagacctgttaatctctaatctagttcatccacctcttttacagatgaagaagttgaacccctgaggaataaagtaacttgcccatggttacatagacagtaaaagttagccgaagacacaggtcttttgctttcagattcagtaaaggtctcattacattatcccactactcataatgtaaaataatgtgtttgatattttctagtattcatgttatgatgaaataatcccttggtaagtaaaattttccatacaggcagtcagtctgcctctgttagccttattcttttcccttgaaattcagaggaaaattttaaaggtaagaaactgaaacacatattttggtccttatattgtcagtgtttctacataaggaaaacaatgtgactaaaacagatgacatctattattggatttccactcaataaaatgtttattttctctaatcaactccactttttttttctgcccattagtgttatccaagtaatacatcacgtaaggacaccattaagtagaatgcctgtctgtatctacagaaaatgagcagatggttggttcctcaaacatttaaaataaagacaaatgtagtcttgggtttaggggtgagacagtggcaggcaggacacttgggatgaaatgtataatgacgttgtactccacactccctgcatgtttacaatgtactatagatgtgaaagttaatgcaccataaaaaattgttataaaattttattttattttaagagcatgagttgggtctggtcactttcttgattgtgttaatggttttatgtgtttattcacatgacaaaatttaccagattttgtactttaaatacctgcagtttcttaggtgtcaatgacatctttaattgaaaaaaaggagtaacagaaaacaaaaacaatgagataaatgttttttttcttttttagcaagaaaagaaaatataagctagtcatttcagatacatgtatgtattgacatcaggtttgtttgtgacaaatcttcactctgtgacgaaaaagtacacattttcctgttggaccaaatctttgtttattcttgtagcttaactcaacataaagaacatgatttttatttcatatttttgtggtgataaatattttcatgcaaatgctttatatcagatggaagaacaaattactaaaacaaatacagttcatatccagtattatgtattcaccagaaactgttatattaatgattctagtttaatgcagagaaaatttcagttctgaagagtacttacgaagacacattttgtgcattaatgcaaaactgtagaaacatgaaaagtacagtgcaataaagaataacaagataacatgggtctagagtacatttttccaagtttgaagttaaataaaattatttctttcaagaacctaacttctactttaattaagataggaaagaagtcagacttacaattgtttgtttttgtattagcccaataaaaatcctagaaatgatgttctttatgtttctaaaataaggaagagtatcctggggaagaaaataacacttctttagttaagttgtatgttgtgtgcctagtgaaaatacccacgctttgttggtaatatcccaatttgccatcttctttccatatttgctctcaggggattagtgttgacttctaaggagttaaagctgctcttagaatcatcttttctaacccactgtagctgtctggaaaacagtaagatcccaagggattttacaaaatgtaattcttcaacatgcacaataaatgaaaagaataatttatatttcatacaactctaattatcatatggtaaaaggaaaaagaaaggtcatatccttgaagttacaaattatgtatacgacccatctgaagccatcactttcatacaaggtaggtttatggctcattaactctgttctgtgtaacatgagttatatgatcttactgtttatgcattttaaactatggatatattgattattatatatttctaaataactagtgtgtaaaattatgacaggaatgattggatgtatcttgggataaatatattaactagaattagtttcttctcaactattggaagaactaaaacaaaattcttaaacagaagtgattcaaatgatattgttattctaaaaatcaaaaaatcttttaaatattcaacaattacagcaagtgggacacaatatgtgttccatttttttcttgttttctgttttaaaatctgaaataacattttatgtatacctccaagagcccaggctgcagtgcagtggcaggatcttggctcactgcaacctccaccgcctaggttcaagcaattctcctgcctcagcctcacaaatagctgggattacaggtgcacgccaccatgcccagctaatttttgcatttttagtagaaacaggtttcaccatgttggccaggctgctctcagactcctgacctcaggtgattggcttgcctcgacctcccaaagtgctagcattacaggcgtgagccaacacgtctggcccaagaagaaattttaaagccttctcatgacagctattcgcctagaatttgacatgataaaacttttttattttaaaaaagagaaaatagaataattctccactcttgacttgtacatttgaatcaacattaagttgtcgtgggattatctttaaacaaaggtgatgggttttgtcatggggctgaggagtttcatttgctttattttattataaaatgaatagtataatattctaaactctacagaagattatacagtgaaaagttcaagtttccctctgcccttctctacccaatctttccctcctgaagtaaccacagttaacaactttttgtgtactgcttaggttattttctttctttcttttttttttttttttttttgaggtggggagagggacaggatctggctctgtcacccaggctggagcgcagtggcgcattcactgcaaccttcgcctccttggctctagcgatcctctcacctcagccttctgagtatttgggactacaggtgcgcaccaccacacctagctaatttttttgtatttttggtagagatgggatcttgctatgttgcctagcctggtctcaaactcctggggtctggccatccaccagcctccacctcccaggcaatccactcacctgagcctcccaaagtgatgggattacaggtgtgagccactgcacagagcagtgttcgggttattttctatgcgtatacatataggttttatagtgccaaggcttgtagagaataggtgacagccagtgatcaaagtggaatattttagaagaatagaaagcagtattcaattcaataaaacacttttattggacacctgctgtgtgcaaaaccacaataataaatttcacagaaggcataggaaagcactaggatgaagaagtcaccgtagttctgtcttcaattggtatgtgtttctgaaatgtgcaaacaccattactgcaaaaaaactcaagaatgttacgcagcattaaagactgtttgggagaaaaaaaacacagcaggattgactctactttgatgaatttttaatctcatcatatagtcatggaagactgacactgaatagcatatttgcagaagggaaatatcctagcatggtccaagtttaaactacatgaggttaagaaaatagctgggtaacattttggattttatccaacagacaaagtagtgacattaatggttattttaaaatagtctatcaatatcagatgtattttttttaatatatatccagttgaaaggagaatggatcagagatggaaaagaataagatgagcaaaacaggcacttagtgtgatcctccaggcaaggacccaacttaataggagccatagtaagactgaactcagagacatttcagcaaaggtgggactggcatggatgtggggtatgaacacttgaatttggggtatagaacagacaacttgggaagctacaggatttcttgtgtgagtgattgtgtagatgttgaagttgttagttaagaaagagaatatagaagaagtagctggtgcagagtgggaagaataataaacttggctttgcaaacactacatttggattgtctatgaggcctttccataaatcctcccagaagcaatgtgtgggacatttaagttcattgactgtgtggaacttggagccatacagttaaagattatttgctagagttagtatcactccacaagatttttatttttttatgtcaacctttattttggattcagggagtacatgtgcaggtttatggcatgggtgtgcctgggtgttcataggtggcaggcttggtgtacaaatgaccccatcacccaggtactgagcatagtacccaatatgtagttcttcaggctttgtcccccttcctccctctcccttcaaatagttcctagtgtctattgttgccatctctatatccttgagtacccaatgtttagctcccacttaaaagcaagaacatgtggtatttggttttctgttcctgcatgaattcacttaggataatggcctccagctgcatccatgttgctgcaaaagacatgattgcattcttttctgtgtctgcatagtattccatggtatatgcataccacattgtctttatctagtccaccactgatgggcacgtagcttgattccatgtctttgctattgcgaatagtgctgtgatgaacatgcaagggcatgtgtctttttggtagaacaatttgttttcttttggatatatacccagtaacggagttgctgggtcagatggtaggtctcttttaaattctttgagaaatctccaaactggtttctaagaggtaaacacatccacctagctgaaaatgctaaagtgggtggtaaaaagaggtggacacagaaggagagcacttcatcatggaagagaaatagcaccttgatctcaaacaggcacctcatcctcctgctggctcacagggctcagcaccactcccgctctggcattggtccaaagactcctttcgttactgtgctcctgggctgtagtgacgggtctgtctggcccactctttgttatcagcagccattcctccactcacattctcatcttactagattttagttagtttctctttcaccctcttgtccccaagagttagaatttattttgagtttaaagagtttttactactaaatacttcatgaaaaaggaaaagattttaaaaaatagaaacaataagaaagtgataagaattaaataaactcttaaatgtttttaccttagtattcatgttcatctttgaaatgtgaggaaaacacaatgagtggttcttagctatcttcattgcctcaagtcttgtattttccttctttgcatcaaaacttttaaaactttaatgattttttttatcccacaggctcttcccctgagtctttaccaaatcttctaaccatattctttcccagccattacactgggaagccctcaaatcaatctgaatgttgaacagcaactgcatgcacctgtaagactcatttataattcagagattatcacatgattatcacatgatcagtgtttttgctgcttaatggaggaaaatgctccgtgttattcttttttttttttttctgttgagacagagtctcgctctgtcgcccaggctggagtgcagtggtgccatctcggctcactgcaagctcggctcccaggttcacatcattctcctgcctcaacctcctgagtagctgggactacaggcgccgccaccacgcctgctaatttttttttgtattttttagtagaggcagggtttcagcagggtcttgatctcctgacctcgtgatccgcccgcctcggcctcccaaagtgctgggattacaggcgtgagccaccgcgcccggcctgttctgtgttattcttaacataattaaggacacaaagtggaatataagatatttttgtcttctccatgttttatttcagtttcaacaacaataaacatttactgactgcttcctggccagaacactggaaaataaaagaaagtgttacgtgtgtttttggttctcaaaaggcttactaaaggatagttatgtaaacactggaagagaacagataacctcagaagagagaattccctacataaccagttagcatatcctaaacaagatatcacacaattatgctattaaaagggatattttatatacgtactatataaaaatatgttttatatatttttatatattatatataatgcatatttatataaaataaacattattgaataattatttttatatttgggaggaaggtcaatttaaatccataccacattataacccaaaataattctatttaaaaatattttaaagactatttttccccaaatctcaaaggttctctttcttaggttctctttctttctttcttttttcaaaaaaattttaaggaaaaagccatgtacaagattttctttcttaaactgctaaaagcatcaatagatttgaggataatggcacacaagaatgttatgtttaaaaatcatccaagttagaaacataaacatgcattagttaaatgataaaaggatatgaacttgcagttgaaacaagaggtagtgaagttttaactaaatgttggctttaaaatgtggtaaaggaaccggtggagggagatggctgaaaagaagaccctactgaccatctccccagcaggaacaccaacctcaacatctacacaagaaaagcaccttcatagagcttaaaatcaggtgagcactcacagtgtctggtttaaacttctaatcgctgaaagaggcagcgaagcaggtaggaaagggtcttgaatcaccgaggccacccttcccccatcctccagcagcagctgcagggcatggagaatctacgcacttggggaaaggagagcgcagtgtcggtgagacatcacatgaacttagcgcttccctgtcaccgtggaaagcaaaaccaggctgaactcagctgacacctacccacagagggagcctttagactagcctgagccagaggggagttgcctgtcccagcagtcagaacttgagtctggcaagccttgccaccatgggctaaagggggagctccaaataaacttgaaaggcaatctaggccgcgaggcctgtgattcccggacaggtccttggacaggtcctagtgctaagctgggttcgaagccagtggacttaaaaggcatacaacctactaagacaccagccagggtggctaagggagtgcttgcgccattcccccaaccccaggcagcacagcttacagctctgaaagagatcctttcattccccttgcagagaggagagggtaaagaggactttgtcttgcatcttggataacagctcggccacagtaagatggacaggtacccaccagtcagggttgtgaggcctcctttctgggccctagctcctggaccacatttctagacacaccctgggacagaggggacccctctaccttgtagggaagaaccccattgtggcaggaaccattgcctgatgactaaagagcccttaggccatgcataaccagcagtgacacccaggtattattctgtgggccttgggtgagattctgagacttactggctccagatgagacccagcacattcccagcaggggtggctatggagctatggctccttctgcttgagaaaccagagagaaaactaaaggggactatatcttgcaccttaggtaccagcctggctacagaggggtagaataccaagtgagctcttgaggtcttcaattccagagcttggctcttgaatggcatttctggacctgccccgacccagaggggagcccactgctccgaagagtgagtgccaggcctgacagtgttcaccgcaagctgactgaagagccgtttggccttaagggaatatcagtagtagcccagaggtactcccatgggcctgtggtggtggcagccaccaggcgagtctcctctacctgtgctaaggggaaggaagagcgaggagggctacatctcatggtttaagggccaactcagctgaagtgtaatataacactaggtagatttctaaggtttttgactccagtccctggctcctggaaagcaccttttgaccctcctggggcctgggggcactcagtgtcctgaagcctggctggctttgccatctgcttatcacagagctctagggccttgagcaaacctaggtggtagccagatagtggttataggaagccttgggtgatacccagcactgtgctggtttcaggtctgactcagcagtctcagtggtggtggccacaggggtgctcgtgtcactccaccccccggtccaggcagctcactacagagagagagagaggctccatttgtttgtgagaaagtaaggaaagatagtgagattctctgcctgacaatccacagaattcttcttgaccttatccaagaccaacaagtcagctcagtcttactgagcttgggtgccctctaatgcagatacagcttagaccacaacatccaagtcttttcaaatacctgaaaagcgtttccaagaaggttgggtacaaataagcccagactgcaaagactacaataaatacctaactcttcaatgcccagacaccaacaaacattcaaaagcatcaagatcatccacagaaatatgaccttaccacattagctaaataagacaccagggaccaatcctgaagaaatacagatatctgacctttccaaaagacaattcaaaatggctgttttaaagaaactcaaagaaattcaagctaacacagagaaggaatttagaattgtatcagatagatttaacaaagagattgaaataattatatagaatcaagcagaaattctggagctgaacagtgcatctgacatactgaagaatgcataagagtgttttaatagcagaactgatcaacctgaagaaagaattagtgagcttgaagacaggttatttgaaaatacatggtaagaggagacaaaagaaaaatgaataaaagataatgaagcatgcctataggatctagaaaatatcctcaaaagggcaaatctaagggttattggccttaaggaggagggagaggtaggggtagaaagtttattgaaagggataataacacagaacttcccaaacctggagaaagatattaatatccaagtacaagaaggttatagaagacaaagcagatttaaccaaaagaagacaacctcaaggtatttaataatcaaactttaaaggtcaaggataaagaaaggattttaaaagcatcaagagaaaagaaacaaataatatacaatggagtttcaataagtctggcagcagacttttgaatagaaactttacaggccaggagagagtggcattacatatttaaagtgctaaaggaagaaaacttttatcctagaatagtatatctggtgaaaatatccttcagacatgaaggggaaataaagactttccactcaaacaaaagctgagggatttcatcaacaccagacttgtcctacaagaaatgctaaaggagtacttcatcagaaagaaaaggaaactaatgagcgataagaaatcatctgaaggtttagaactcactggtggtagtacacagagaaattgagaatattataacactgtaactgtgatgtgtaaattactcttatcctaaggagaaagactaaacaatcaaccaataaaaaataataactatgacaacttttcaatatatactaaacagtatatactatactatactatactatactatagtatagtatagtttcaatactatactaaacagtatagtaagatgtaaagagaaacaataaaaagtaaaaagcaaggggacaaagttaaggtgtagaatttatattagttttctctttgtttctttatttatgcaaacagtgctaagctgttttcagcttaaaataatgggttataagatagtatctgcaagtctcatggtaaccgcaaattgaaaaacataaaacaaatacacaaaaaatagaaatcaagaaattaaatcataccgccagagaaaatcaccttcactgaaaggaagacagcaaggaaataaaaaagaaagaagaccagaaataaccagaaagcaaataacaaaatggcaggataagtccttacttaggattaataacattgaatgtaaatagactaaactctccaattaaaagacacagagcctctgaatggatgaaaaagcaagactcaaccatctgttgcctaccaaacaacacgcttaacctataaagacacacatagatggccaggcatggtagctcatgcctgtaatcccagcactttgggaggccgaggcgggtggatcacctgaggtcaggagttcgagaccagcctggccaacatggtgaaaccctgtctccactaaaaatacaagaaaattagctgggcgtggtggtgggcacctattatcccagctacttgggaggctgaggcaagagaatcgcttgaactgggaggtggaggttgcagtgagctgagattgcaccactgccctccagcctgggtgacaagagtgacaccccatctcaaaagaaaaccaaaatgcaacaacaataacaacaacaaccaaaaacacacatagactgaaaatagatggatagaaaaagatattccatgtcaatggaaaccgaaaaagaggagtagttattctttttttttttttttttttttttgagatggagtctctctctgtcacccaggctggagtgcagtggtgcgatctcggctcactgcaagctctgcctcctgggttcatgccattctcctacctcagcctcccaagtagctgggactacaggcgcccgccaccacacgtggccaattttttgtatttttagtagagatgaggtttcaccatgttagccaggatggtctcaatctcctgaccttgtgatccacccacctcagcctcccaaagtgctgggattaaaggcatgagccaccgtgcccagccaaagaggagtagctcctcttagacaaaatagacttcaagacaaaacccgtaagaacagacaaagaaggtcattatataatgataacagagtctattcagcaagaagatataataattgtaaatacatatgcatcaaacagtggagcactcagttatataaagcaaatattattagagctaaagagagagtcagacttcagcacagtaatagctagagccttcaacaccctactttcagcaccgaacaaatctgccagagagaaaatcaacaaagaaacataggacgtaatctgcactatcaaataaatggacctagtagatatttacagaacatttcacccaatggctacagaatacatattcttttctttagcacatggatttttcttaaggatagaccatatgttaagtcacaaaacaagtcttaaaattttcagaaacattgaaataatatcaagcatcttctctgactccagtggaataaaattagaaattaataatgaggggaattttggaaattatataaacacatggaaattaaacaatatgctcccaaatgaccagttggaaaatgaagaaattaagaagaaaactgaaaaatgtcttgaaacaagtaataatggaaacacaatgtgccaaacctatggaatacagtgaaagtggtactaagagggaagtttatagccataagtgcctgcatgaaaaaagaagaaaaagttcaaataaacaacctaatgatgcatcttaaataactgtaaaaacaagagaaagtaatctgaaaattagtagaatttaaaaatgaagatcagagcagaaataaatgaagttgaaataaaacaattaagaagatcaataaaataaaaagttgcttttttaaaaagataaacaaaattggcaaagctttagccacactaagaaaaaggagaaggcccaaataaataaaatgagatgaaaaaggaaacttttaactgatactgcagaaatggaaaggatcaccagtggctactatgagcaactatataccaactaattggaaaatctaaatgaaattgacaaattcctagacagatgcaatctacaagattgaatcagaaagaaatctaaaacctgaacaaaacaataacaagtaataaaatcaaagtcataatagaaagtctccaagcaaagaaaagcccaggacctgattacctcactgctgaattctaccaaacatttaagtaactaataccaatcttactcaaaatattttgaaaaatagaggaggagggaatacttctaaactcattctatgaggccaaattgccctgatactaaaaccagacaaagacaccacaaaaaaagaaaactataaaccaatatcactgataaatattgaagcaaaaatcctcagcaaaatactagcaaactgaattcaacaacacattaagaagatcattcatcacgacctagtgggatttatcccagggatgcaagggtggtccaacataaggaaatcaatcaatgtgatacatcatatcaacagaatgaaggacaaaaagcatgggatcattttcattgatgctgaaaaagcatttgacaaaattcaacattccttcatgataaaaatttccagaaaactgggtatagaaggagcatacttctacataacaaaagccatgtatgacagacccacagctagtattatattgaatgggacaaaactgaaagcctttcctttaagatctggaacatgacagggatgcctactgttaccactgttattcaacatagtactggaagctctagctacataatcagacaagagaaaaagggcattcagattggaaaggaagaagtccaattatccttatttgcaaatgatatgatcttatatttgcagaaaactaaagactccattaaaaaacctattagaactaataaacaaactcagtaaagttgcaggatacacaatcaacatacaaaagccagtagcactttatatagaagcaaacaatctgaaaaagaaatcaagaaggtaatcccatttaaaatacctacaaataaaataaaatacttaggaattaatttaaccaaagcagtgaaagatctctacaatgaaaactataaaacattgatgcaagaaattaaagagaacacacaagaaatggaaagatgttccatgtttatgaattggaaaaatcaatactgttaaaatgtccatactacccaaagcaatctacagatttaatgcaatctctatcaaaataccattgacattcttcagagaaatggaaaaaaaaaatcctaaaatttatatggaacaacaaaagacccagaacagctaaagttatcctaagcaaaaagaacacaactggagaaatcacattacctgacttcaaattatattgcagagctatagtaaccaaaatagcatggcaccggcataaaagtcaacatacaaaccggtggaacagaatagagaacacagaaagaaacccacatatctacagtgaactcttttttgccatttcccaagaacatacactgggggaaaggacagtgtcttcaataaatggtgctgggaaaattagacatccacatacaaaagaatgagactagaaccctatctctcaccatatacaaacatcaaatcaaaatggattaaaaacttaaatctaaaacctcaaaccataaaactactaagagaaaacattggagaaactctccaggaccttgaacggggcaaatatttcttcagtaatattccataagcacaggcaaccaaagcaaaaatgggcaaatgggatcacatcaagttaaaatgcctctgtacagtaaaggaaacaatcaataaagtgaagagacaatccatagaatggaagaaggtgtttgcaaattactcatctgacaagggattaatagctagaatatataaaaagctaaaacaactctataggaaaacgtctaacactctgattaaaaatggggaaaagatttgaatagacattttaagacatacaaatggcaaacaggtatatggaaaggtgctcaacatattgatcatcagagaaatgcaaatcaaaactacaatgagatattatctaatctcagttaaaatggcttttatccaaaagacaggcaataacaaatgctagtgagaatgcagagaagagggaatcctcatacactgttggtgggaatgtaaattagtagaaccactatggaaaacagttttgaggatcataaaaaaactaaaaatagagctaccatatggtccaccaattccacacctaggtatatacccaaaagaaagaaaatcagtatatcaaagagatacctgcactcccacatttattgcagcactgttcacaatagccaagatttggaagcaacctaagtgtccgtcgatagatgagtggataaagaaaatgtggtacatgtatacaatggaatactactcagccgtaaagaagaatgagatctagtcatttgacaacatgagtggaaatggaggtcattatgttaagtgaaataccctaggcatagaaagacaaacatattctcacttatttgtgggagctaaaaattaaacgattaaattcatggagattgagagtagaaggatggttacagaggctgggaagggtagtgggggcggtggggaggaagtgaggatggtcagtgtgtccaaagaagaagttagaaggatgaataagacctagtatttgctagcaatatagggtgactatagtaaaaaataatttaattgtacatttaaaaatagttgagtataattggattgttcctaacacaaaagataaatgcttctcgtgatggatacaccatttaccctgctgtgattattactgattgcatggttgtatcaaaatatctcatgtaacccataaatatatacacttactatataacaacaaaaattaaaaataaaaacatttttaaaatgtgatacagtgtggaaactaaataaatatgaaaaattttagatggtaaaaccgcagtaaagtaggattgctttcacatattgttggtggcagcctaaatttttataaccattttagaaagcaatttggcaatataaggtaaaagtctctatattctttaaatcagtaaatgtagtgcagaacaagctaaaatatattctcaggaaataaattgtaaattatgattaactcaatatagcatccattaaaattataattttacgattctagaaatagtgtaaagttataagtggaaaatcatggatattaaattacatatacaaggtcattgctactaggtaaaattggtttgttcatttgaaatatgatatataaaatgtacaaaaatgttagcagtattttgaaagagtgattatacctgagtatttttgcaattattcaaattttgttattggttatatgtggtttttatgattttttttaaagaaaagtgctcctggttccagctaaatggacctggggtcattggttttctttcccctttgccttttcacttgataactctcaggttttctaacttgtctttttattttctccaggattaatttatctaaaatatgttgttaccaaggacagtgcattattaagttattgctgcaataatactgctgatcaaatcactctgatctcagtggtcgacactgaagaacattaatttttggagtgggggctccaagttctgcagaccaattagggcaactctaattgaggatgcaggttgccagggcttgactctggggtctaggctgcagggctgacccattcgtctcatttgggggctaaagctccatggaggtagctactgaggcatgctcttctcatatacctttgctgaatttctattggttggatgaagttatgggactaaagccaacatcaatgggaaggagaaatatatctcacccactctgtgattccacaaagtcacatggcagagggaaggagcaaagaattaacaataatacggtctaccataagtaggttaactgtcatctgtatatttcacaatctccatctataagtaaaagatgtttggttatataatctcatcagcgagttatttaacctaagcctcaatttcctccttaagtatggatgatgatagtatctgtttatggaatgcaatgggattaaattagataatgcttgcaaaacactcaacataatgttcaacatgctatctgttattaatcttcaagtctcatgcagctgtgtgagacatctatgatatttcacggtctacaataaactctagtataaatagagacacagggaaaagacaagaaaaatctctctccactttacttcacattctctatggggcctccaaaggctaatggagattcatttcaggtctctatgtcatctggatcaccccttgagggcttatgtataaacactgaggccaggtcatccttggttttcaggactctgcactattagagatggttttaagatgacttgagtaacaagtttgctctgtgcaagaactgagaatctaattcaagttaaggaagatttacaatctttacttaggttccaagtaaatctaactacctctaagaagttgcagtcgccaaagggattcagaatagtctctgagagttaagtacctctgggccacccagatctcgtgccctgggaagcaggataccctggcccatcaaactgacaaagtactcggccatgggatggtcacacctttgttatgttcagatttttttcttgtctattcaccttatattacctaaagatagcatagtcatcaacatataagccctataaagattaatattagacaaaattaaaattatcattaatgtaaaatttctaaaacattatcaatatattattttaatgcttgcccttcattttagcagaagtattgaggtaatttttctattctgcttacctttttgtggaaatgctgtgaagatacattgataaaaatattaagtattttattatgtgatgtcatgtgttattttgctttaaggagaccagtctcaacttctgatttcccataaaattattatgggaaatgtattaggtagcactgcttcttatatgtatggcatttattagaaactggtagcataaatcttaagaataaggaaaaaagagagaattaaaaagacagagagaaagaaagagagagaggaaagaaggaaggaaaagaaaagatgagggaaaggcaggaaataacttgccaaaaggaagcatgtttgaaactaatatagcaaggacattagactatgcgttattttgaatttagttatcaccttttctagttttctttatatttttatatgttcaatattaaacatccaccaaattccatttacctgcattatcaaagaattaaaaaagcatactttatcatgcacctagctctccttttgttcagttgaaactctggattaaactcattgaagagtctttgaaaatatgaaataatctgtttatttataacctttaattaaggaaatatccattaccatgtttccagttgacaagaataatgtcttggtcatttcgtgatttattattttttaagtacttttcagataacttgttcagaatagggtagaaaaagtcatgtatttgaatcatgtgtctcactctgcgattcaggtacaggcctaaaactcccggggctttcatcaacatcgcatttcacaggatgccacactaagccacatgcacagacacgctccatttgcttcttccattccagtgacatggtgcagttctcctgccttctgttaggctgggttctccgtggagtgctggcctgagtgaataccggaaagaagctactccctgaaaaacgcctttgtctccttcagggattccttctcgttacttggggtggcccccttgcatcttccctggaaagatcctgccggtcaggagccaggccttggtctgttgccgaccattctccttccctcttatctcaattctgataggcctttttctgttacccacatctttaccttctctccagccttcaatattgtatacctctctgagttctctcctagtgtattaaaaacactgagcttccctcacatgcacaaaacaaacaaaaaccctatttgctatcaggagcagcgattcctcattacaagaaatgtctgagttccacgaggcgtgatcttcttctgaatcttctggcctcgctcatgcaatcacctgcctcctctaaaaacctccttgcctttaaaactatgcatccccacacaagtttccaaagaacctttcttaaattcaaagtatttttctccttgttttataaaacgtcctcccaggttatgtgactttaacatcattaactaacttccctgtgccttgctaggtttcctcacataaagataaataataccttcctcataaagtaacagtgaggattaaataataatgtgtgaaaggtgctcagtacgactccagattctacggaaaagatcaaggaaagatggctattgttggcttttattgttaatacctcacagcccataggcttcaaaaccaatgctatcttatttgatattttaattatttgctgtttttggttatcttcttatttgattttttaattatttgctgtttttggtcatcttctttggtcatctttggactctcccaaaggtgacagtcctcccacgtgccagtgctcaagtcctactccaaaataagttggctttctctgaggcttaacacttcccagtccagagatataattcagcaaactactcaaacttgaaaataactttaaaatcccaccctaattcaagctgccaccatttctcatctggtgtcccaaagcttcctgactcatctccacatgtcacgctgctgcagcacatccaaacccactcctacacactgtgctgctggagaccgtcactgtgcatggaaaggtccaaatcccaactccctaacttcaccttcctgatttcacatgtcctgtcctctgcttacctccccactgtcccttcagccactcttcctttgtctttatcttctcttacctcacagtttctctcatctcctcccaattaccttttgccctttttaatcttcttttttaggaaaattcatacaatacaatgtaaactctaccaggatgtttttcctctcaaacttccctcctcccttcctgcttcctcagcctacctgaccgtaggtaacattcaaagtgcagctcaatggccaggcacggtcgctcatgcctgtaatcccagccctttgggaagcttaggctggtggatcacctgaggtcaggagttcaagaccagcctggccactatggagaaaccctgtctctactaaaaatacaaaaaaaaaaaaaaaaagctggatatggtggtggatgcacgtaatctcagctactcaggaggctgaggcaggagaatcgcttgaacccaggaggtagaggttgcagtgagccaagatcacgccattgcactccagcctgggtgacaagagtgagactccttctcaaaaaaaaaaaaaaaaggaaaaagtgcacctcaaggattgcttccttacaaaagacttcccttaaccctccaactaaatcagaagcctctgtaacatcctctcatccgtctagagatcatttctttcatgacccttctccagactttaccttttgtttatttatttgtttgattcttgcatatgctcgcttgtccttgctagaacatatatgttcagtgagggaaggatcctttctgccttgtttattgctgtatctcagaatctagaagaatggggcatagaatagtaaagtttctatttaaaaaagagcaagaattgcacgtcctttaaaatattttcaataaatatttttaaaaagtcatttaatgaatttcattgaattgtgttcatgggacaattaaattgtctccctcacttgacagtaattccaaaggcttatggaaaccttctgctggtcgactgttgcaggtggagcctacacagtgcacggcgcgacggttggggctcctttaatattagatcaatcaacatgcatctttagggtgcccccactgtgcctgcgtgagaacgtgaaacgttactgcttcctcagccttctttcttccacacctctgagtggcaccctgaggaggaagtgctcatgacttccgtagtgaaggctgttctctctgaagatgtcactggggaaattttatcctttctaaatttagaaagtgggggagagaaatgcagctaaatggttcagattcagagggagatagtgagaaccctgaaaatgaatcatggtacttttcacacacatagtgaatcaaaatttaatggcagtgaaaggctgttgataacattcctttaaaaaatccacataaccaaagacatttacttgcagaaaacttcctggacttctaagtagaatactaggcaggtctgtatttttaaatttagaaaccagtcacagattttttttctctaaacttcattaagagctgtgctctgtatcagctggtaagcctctaatcctacaaaggttgcttatcaggtttggggaaaaaatattttaaagggaatacaattcttgctctttcttaaatagaaattttactattctatattacattgtcgtataacatgtcatttggtgcccctggaatctcctgtaaaatagaagcgtacgctagtaaatgtcatgatgaaatgaaaccagggattatgaaagttgtgaagctttcattaaatataaaatcttatattcggtaccttagaatcagtgactctaatacgttatttttaaaatttattgtcaatattagccgtgtccccaaattaagaaactgcactgagcgtttacggcattgacttaagagaaatacagtcaacgtattttaaatatattaccatctgtacccaaatataaaatgatctttaaatgtaaggtagttccccattttatcacaaactgttttgatcaacttgaaatagaagcccttaaatgaaagtgtcaaatgtcaatttacaatattaatcatttcagttacccagacatttaaaattacatattctggtacagcactgtttagggaactttctgtgatgacagaaatgttccacatttactctaatacgggagccaccggtcacatacggctagtgggcatgtgtgcccacttgaaacacggctagtacaaccgaggaactgaatttgtaaattaatttaatcttaactaatttaagtttaaattggttggtgtggctagtggctactgaaccagataacacagctctagaaaactaaagatttttttagaaatgttgctattttctactctcattcaaactccacacgcttcattgacaacactattgtcatcatcataacaatgatgttagatatgttatttaatttttcacagcacataatttttacttctaagttgattgaaaatacaaaaaaaattagaaaaatgttatgtgaaaaggaatatagaataagaaaaatgtgccctgatactcatggggccagattagcccttgtgtaaaaagagtttgaggagaggaggcacaaatcaagagatccgggccctgttctctttgaagaagattctacttagatgttcgggtttagcactttgttcttctaagttctcagaaaccaaagaatttgtgtagaaatggtaattttacctgatgtattacccaagaggcctcttaaggacaagggtagccctcttttatgaaggcaatttttgagaaaaaaagccattgctttatatatggtacatatggtaagtaagaacaattgaagaagaactgaacaccacttatttaaaaattgtgtactttatttacaaccacatgaaatattttccaatcaccaagccatctttagaagttttccttccttaatcatcaaaatgtcagtacaagaagtttggatttagttgtgagtgactgggtgctgtaaagtccaccaagtagtggcatcatagagcaccaggtggctccctaaacagtgagacctgggcacaggtgtcaatccccagagattctgtcatctaagtcatgaggtcatctaagtcatgagcatccacatggaacatacagctatgcagttactggcaaataaaacaaaataccgactgtgtctcctacagtgagatcaaagaaccactctccacttactctgcaaacttgccttggtaccatctccttccgagattcaataattgatgtttaatatgtgctatttagttctgctttattattaagaattccttgaatgagatgaatgaaaagaatattaatctacttcaatctagaaaaaaaaatcctcatatccataaaatgaaattaatgatttccagaagcaaataatttctgtgatgatgttctcagaagaattaaggtgctatctggtgccctgcttggatcgttagcctaatgggactgatcaatcagaaggataatggctagatggatatttttgttgttttatttttaatgaataagagatacttatattcattaaaattagaaaaaagataatgaatcacctcaaattacagaatttccatatttcccaaaaaactgacagtgtgtctgccaataatagccacatacaatatttatgcaagcctggctttctgtaatgagaaattcaacaattgccatggtgatatcttgggaggcaaggaggaaatactggtgataacgggagtcttgagtggtgatggcgggcagcatcataccatcccccttgggcctgggatgctgccaaggtctgcagcgtgatgtttgtcctcctccatcgtcatccaaacaaacaggaaacttgctctacagaaagtaattcttgctgtttttctttatacatttctcaaaatatcttttaaatactttgttacagtaggtagtcaggcctacatgagcagggcaagagagcccttccatcccaacagaaatgtcaggttaccattagatgatggtcaggcagttgttaaactgtctctctaaaaaaataattggttacagccagtgccgtggaaaggcagtctcccagcagatagaaacacctgaaactggtgatcagcttcccagtaaggtctcaggagttgcgcaagtgggctcaagcatgcgcattaagaggcaaaatggcggagtttaactggtagatgaccttgcacggacatttgactggtacgggaagaacgcttcaaatgagcatacatacagctccggtaaacacactgcacgtgtggcacctccaagagcgggcaggcaactgcacaggcagacagcccaccccaagggcagaatcagggaagaagagacgcaggaccccggaagcatgccaacgtcacaccgcgcacttcatccctcaagtcacccgcgtggccctcttgcgagtgagctttgcttcctttcgttcctgctctgaagctttttaatgaactttcactcctgctccaaaacttgcctcggtttctgtgtcttacgcgcctcagtcgtattctttcttctgaggaggctagggctgaggttgccgcagacctgccccgattcgccgctgctaagaatttctcagactccaagtttccagtcttccctgagcagctctctgtgacttttttcttcctgcgctgtctcgcactttacacacagttttctctgaggaaccttcctcctactaaatgttctaagttagttttccatgattttttttctcctccttcttcccttgactgttgggatacagaaatatttcacacaaatgatttctaatacgattgagtaggaaggaaatcagcttactttaaaagtctagaagcattcttaagtctgcttttcaataatcgtcttttttcatataatacttttcttgccctctttggaaactttgagcctgaatacaaattagaacaacacaaaattcaagtccttatgatggaattcaaatttgtattttggctcaattagctgctttctagtacatttaggatcatagcatttagcccacatttagtggcaaaggtagtaacattaacgttgggttaagtacaaaacattaaccaaaaaatcttgtagagaattgagatgttatgactagaaagaaattatgaagatgttattttcagggtatacatggactttaactgggcactgatttttatcaagaagtattagcaattaaattaactgtctttcatgtgtttaagaaatcagtcttctatccatattatatgagacaagaacatgacaaaatattttaaaaagcaaaagaatgattataaaaaataatgcagaaataatatttttaaagaaaatatatttaaaatgcagttttgggatattttacagcaagttacttcaaccatacctctagttatacagaattttgtcaagaaacaaatcatattttaacatatctagtttgaagttttccaaatacaaataaataaggcatcttaaaagcatgacaatttattctgtcattacttaaagcttttaattttgcatacttagggctagtaaagatataataagaaatagattggaagcagctgaacaaacatagtgttcataaatgcatttgatttgatattgacgtcaagcagttctaccaaagtgatttaagaacttgagagataagctaatacggtggtctaaagggagtcttatcttgttctgtacatatgagttcagagctctctattgaattctactttttaccacatctgattattcttcacggaccactgggaatagaccaaattggggccactgatcctaatttaagtcctttctgacccctttctgagtcttcaattcttgcttgcaaaagagagtattcaaaatgtccgtatcaaaataatatttagataaaaggtgtgaataattcatgataaaaaatttgctttctgattatgtaggttattatattaactaaacatgtttattttaccttttgatgtggctctgttctgttagccctaccacaaagatgatatttgtcacagtgtaacagtctattatattacctcttacaaaggcatgatattctattgatgtttaatagaataatttttaaagtacaaataaatgatttaatttatttaaataatttatattaaatattaaaatgtatatatatcacagatattttatatgtatattacctatattcaggcatgcagttagggaaagaaacggagggaaattgttagttaaacatgatcttaagaatttcttccatatgtggaaaagtcatcagttcatctggcatatagcaatatatacatatatatatacatatatatagaatgctatgtatacatttatcctacattcatttaacatcaaaacataaaaaagttatttctttattctctctaagcaaaaaccagtaataacagctctgtaaatagactctagaccaacagatcaagggaacaggttaaaccccttgcttatttgttagaattcaaagagcctcactttagctaatctgattgggctaatttgtgtgtaaatacagatatggatagatagaactatatatatatatacaaacaatatatattttatgtaatataaaatacatataatagataaattagaatctattcatttaacttacctgaaaccatataatcactcaaatgtgtctgcatgtctgtgtgtatctgtgtatgcatgtgtatgaaatgtagttttttaacttgacatataatagatgtaaatattttcggggtacatgcgataatgtgttacattcgtataatcaaataaggataattggaatatccatcatcttaaatattcatctttatgttagaaacactaaagttattatcttctagctgttttgaagtgtacaatagattaatgttaactatagctatcctactgatacatcaaatactaggtcttatttcttctgttataatgcatattcgtacccattaatcaacctctctttagctcccctttcccccaacccttggtagcctctggtaatcaccaatctactttttatcttcatgatatctttttagctcccacatatgagtgacagcattcaatatttgtcttgctgtgcttggcttatttcacttaacataatggcatccagttctattcatgttactgcaaatgacagaacttcattctgttttatggatgaataatactccattgtgtgtgtgtgtgtgtgtgtgtgtgtgtgtatcacattttctttatccattcatccaatgatggacacttaggttgattccatatcttggctattgtgaatagtggtgcagtaaatacaggagtgcagatgtctcttcgatatactaatttcctttcttttgagtatatacccagtagtggcattgctggatcatatggtagttctatttttagtttgtttaggaacctccatactgttctccatagtggtgttattaatttacatttccacgaacagcatatgggggttcccctttctccacatcctcaccaacatttattattacctgtctttttgataaaagttattttagctagagtaactccttgtagttttgatttgcaattctctgacggtgagtgatgttgagtattttttcatatacctgttgatcatttgcatgtcttgttttaagaaatgtctattcagatcttttgcccattttaaaaatcagattatttattttcttgctattgagttgtttgagctcctatattctggttattaattcctgtcagattgatagtttgtaaatattttctcccactctgtgggttgtctcttcgctttttttattgtttcctttgccgtgcagaagtttttagcttaatgttatctgatttgtctatttttgctttggttgcctgtgttttttgaaatcttacacacaaagtatttttccagacctatgttctgtagcatttccccatgtttttctcagtagttatatggtttcagatattaaatttaagtcttcaatccattttaatttgatttttgcatatggcaagggctaagagtctagtttcgttcttctgcgtatggatatccagttttcccaggtccgtttattgaaaagactcatctttccccattgtgtcttcttggcaccattgtcaaaaatgggttggctgtaaatatgtggatttatatttgggttctctattctgttctgttgatctatatgtctgcttttatgccagtattacactgatttggttactacaactttgtggtatattttgaagtcaaattgtgtgatgccttcagtttcgttcttttgtagttccatataaattttaggatagttttttctagttttttgaagagtgtcattggtattttcatgggggttccattgaatctacattttagggtagtgttgtcattttatcaatactaattctttcagtgcaaaagcatgacatatcctttcattattttgtgtcctctgcagtgtcttttatcagcgtttgatagttttccttgtacagatctttcatatctttggttaagttgattcctaggtattttatattcttcttagctattgtaaatgggattagtttcttgatttcttttctagattgtttgctgttgccacatctaaatgctacttattttggaatgctgatttttatatcctgcaacttgtaatggagttttggtggttatgactatgcatgtctttgaactgatttggtagttgaaagacatatatttttaaaacttcaaaaattagagaattgatatgggtagatatttaaactctacttcattaattcatctcattttatgaatgtgataagatactagaaagcaagtggcttccaaggggcaaaaactaataaattacagagacaagactttagcctaacttgtttaacttacaataaagtggtacttctctacctcacttagaataaagcagtattgtatctcctccaaagtctgtggtgaaacttaattctcagcacaactgtatcaaaaggctggcccttaggaaataatcagaccatgaggcctctgccctcatgaagaaagggctggagagaactaactagccctcttttgtacttttttgcctttccctcccttctggcatgtgaatatacagtgtttgctcctctggagaatgcaacatataaggcgccatcctgggagcaaagacagggccctcactagaccctgaacctgccagccccttgatcttggacttctctgttttcagaactatgagaaatcaatttccattgtttataaattactcactctgtggtatttttttataacaacacaaaaaaactaagacaaattggtaccaccagaaatgggtgttgctataaaaatacctcaaaatgtgaaagtgcctttgaaactgagtaatgggtagagcctggaagaatttggaggtgcatgctagaaaaagattagattgccatgaacagtgcattaagggtgattctgatgggagttcagaagagaagagctgtagacagagcctcaatcttcttagatattacatacatggtcatggtgagaatgctggtagaaatatggacagtaaggctattcttagttctcttatttggagatgaggaatgtcttatgggaaactggaagaaaagcatcctagttataaatggcaaagaacatggctgaattgtgtctgtgtcctagtgttttatgaaaggcacaacttagaagtgataagctgggacatttcgtgaacgaaatatctaacaaagcattgaggttgtcgtatagcttctcttgactgcttatagtaaagtgcaagaaaagagaaacctgaaatatgatcagagctgaaatctataatcaaaagggaaacagaacttaaagatttgaaaattttgggcacagccagatggtaaaaaataaaaaagcatgtttgggagaaaacaccaagggtgtggctaagggagcatttggtaaagaggttggtatgggtagaagaaggccaggcactattcatcagaacaatgaaataatcaccccaaagcatttctgaattctttgtggctgccctactcatcataggcccagcatgccagggccttgagggttgaactgtttcgaaagaagggcccagtgtggccttactgactgggattgcctcaagtctatgttccttgcatttcagtgcagtgctccttggtcaccccagcgtggctcaagtgggcccaggtgtggctcaggctgttgcctcagagggcacaagcagtgaatggtgacatctccatggtgctaagtctacaagcacacagattgcaagagccatggaggcatggatacctctacctagatttcaaagaatggctcagacagctgtggggcccagtgttttaaacttcaaaggctacagtttaaaacactacactcacaggcaggcccactgcagacagccccccatgagggcaatgcccagcacagccatagagtcaaggccaccatagagagctcccattagggcaatgtctggtggagctgtggggatggggtcatctccaagacaccataactgtagaggcaccagtaaagcaacgccagcctgcgagagctgcaggcacctgactccatcccctgaaagctgctgtgtgggctacaccaagcaaatcagtggaggtggggtcccccagtgacttggaggtccaaactctgttctaatgtgtccagcgggcagggcatagagtcaaagattgaatattgtttgacttgttgcattttggacttgcttaggattgtgttttgggagcatacaactgtttaatgttacaggctcacagttgaagagcaaattgagtctcacccatatctgatctagttgagatttgaatttagactttaaggttgaatctggcatgagttaagactttggggttattgggatgaaattcatgtgttttttacataagaaggacacaaatttgaggggagggtcaagagcagaatgcaacaggttaaatgtttgtgtctcctctaaaattcatatcaaaacttaatccccaaagcaactatattaagaattaggtcctttaggaggtgattaacctaagagggctccactctcatgaattagtgacctcatacaaaagctgaagataactagctaggcctatttttgcctttttgccttttgccttttgccttgtgagtacacagcactggaggtgccatcctcgaaacagaaaccaggaccaaaccaaacaccaaacctgctggtgccttgaacttgaacttcccagcctccagaacagtgagaaataaatttctgttgcttagaagttatccagtccaggtatttcattatagtagaacaaatggattaagacacactgtaatgcactgcttcataaatggcattatattatcctattaattttgttgttaattttgctctttaaagaaatgataaaattggggccaggctcagtggctcacgcctgtaatcccagcactttggaaggccaaggcgggtggatcatgaagtcaggagattgagaccatcctagctaacacggtgaaactccatctctactaaaaatataaaaaattagctgggcgtggtggcacacgcttgtagtcccagctactcaggaagctgaggcaggagaatcgcttgaacctgggaggtggaggttgcagtgagccgagatcgcaccactgcactccagcctcagcgacagagtctcaaaaaaaaaaaaaagataaaattagtaggaaaaatcattttaatgaacatgtgatcttggaaatttgctctgaagccctcatatggcagcaatattaaagcagattaaatactaagatacgtgtgtgcgtctgaaattatttttacataaactggtttctctaactttactcaagattattttaactaattttaggcagagtaataccctagtttgaaaatatttttaggcaaggaaattgcaagcccccgtttggcaatatgctctaacacagggcttctcaaccctcactatccatgaacccccagctaaaccacaacatgcatgagcacacacacacacacacacacacatgcacatacaagtcctccaaatcaacatgagaaaagtctctcacataattcaagaatgctgtttcaccaacttcaaccctcagtctgacaacaagatgtaatagtaaatgtagtatatccgtttgaagcactttataaactgaaagaaactggacacaaataaaatggttcaaccatctcttcgataatttttatagccatggaaagacacctcatagtcacataatcttaagcgtgttcatggagcagcgagtcaaatgacattatgtggcaataaagaagacttcagcgcgtttcctgactttaccagtgaaaacatctgaccttgaggagggcactgaaaatgccactgcatcgacattttttttttttttagatggagttttgctcttgttgcgcaggctggagtgcaatggcacgatctaggctcgctgcaacctccaccttccgggttcaagcaattctcccgcctcagcctccgaagtagctgggattacaggcatgcgccaccacacctggttaattttttgtatttagtggagacagggtttcaccatgttggtcaggctagtctcaatctcctgacaggtaatccacccgccttggcctcccaaagtgctgggattacaggcgtgagccacagcgcccggccgcatcgcatctatttttgtaaaatatgcataattctagaatatgtttgttgtgaggattgaagctcataatatgtacccttttaaaactttatgttgaaatgcctcaaatcaaaatattatcatatgatgcagtttattcatccttatgagaagacacctgatagggactgtcaagggtgactgtatcaaatgtgcaagagattcggggcatttgcttattgcagtgaattgcacaaaagaattatttgaaataaatataacatgcaatgaagttgtcaataagtagcataatttatacttgctagttcaatgctggacacagataaagtgtttcaaaatacaaatgcctcacagagaaaagggaagtgaatgagaagaaaggaaatttattgaaatgaaagataggagaaaacaggagaagcacagaagtgacagacaggaacctattgcacatgagaatgacacttcactagacagaccctttcagaattcaatcacaatgctaaactttccaaaagttcacaaagtaaaacttttgagtactagcagtgacacaggtcctgttgaaattttcacaggaaatagagggaacataaactgattagtttttaatcaagataaacacatatgtccactctaacttagtaatcgcttatgtttaacatgttaaatacaatgtattaaacttattatatgctaggcactgttttaagtgtttaatatctgtggtctcatttattgctgctaactgcctaagaaaataggtaatatccctactttagctttgtggaaacagatgttcaaagctattagtctcccatcatagcaagtagctgagccaagatgcacacgtggtccctacagtttaaaacactacactcacttttctcttctgtactattgaagtgatgctgtcattattcactattcatttaatgtcttttgcacttgttttaagatcagttcaggagtatttcagttcaagtcccaccatgaaaagagaagccacaccagcattttagtagagagaattgtttccaaggttattgtagacccgaaaaggcaaaaagggagacagaggatggttagcttacatctccaggactggaacaaaggaaaaagaatgggcttatcaccacctacaacctcagaaactaggcccagcagagctgtgacccagacacctgagaagtgggcttttctttggaggagtcagggagagaccccacagagctgggattcagatttctgaggggcggtgctacctcattgctgcttgttatctccaagctggagatgataggaatggttctgggagtgtggaagaaaaggtatgtcaactactaaaccgaatgctgccgtggctgtattgacttgagtgcttcccttctctccgcctgctgtcttcctgtctcccactagtgacttgtagctgcagaagcagacggcaaacagtcctacagtttccaacccagcaccactgagcagatatataaaggtagatttgagctatgcaagtcagtcagttccattattttataattaagccatactttttgtttaattactatatactcaatttatcagatttgattaaataacctctgagtattgtcaaaagataaatccacttcccaaagataaggatttgccaccatggaggatatcccaatttcagactacatctattttccaggcaaagtttcaaattattttcctcaggagacatcaaaagatgtcttcagagaaaagacctgctgatactggcgttaggggttacataaagaaaagggccagctccttcctgagttccctggagtgagttccagaaaacaacccagagtttccaatcagcgtcttagtgtccaaggaccagccgataatgtgagaaaatatcccatgatgaaagagtaagtcagtaataaagcaaaatgtggggacagaaagataattcaggaagtagaaaactgaaaaaatgagtataaattatcagaaaaataaaaacaaactattgataacaacaggaatgccatgaaaaatgaacaattagaaaacagtgacaactagaacaataaaaaagtctttgaaaattaaaaaaaaaatgatggtcaaaataaaacttctaatacaagaggaaaagtttcagaaatctatcaaaaaataacaaggaaaaatacaagacatggagaatcattgcaagaaactcactttctagaaaaaatggcatgagagtggggagacagaaaaaaacgctggagaaaaagttataaaagcactaatacaggaaaatttccccaaactaaaagacttgagtcctcaaaatcctttttaatggccaggatgaaaaatgaaaatgtcttatttaaggcatataaaattaaaaagcatcagcactaaagagaagcatctaaaattttccataaaaaccgtaaatcacatacaaaagaatgagaatctgaatagtgctgaaggatcaacagaagcctttttttttttttttttttttttttttttttttgctaaaagtcaatggaacaacaaggcctgataaattttaaagaaaaaataatgttcaaccttgaaattttgttaatactttattctacaggtgtactgcttttaatacacacttcctttaaaaatttccttgctacggcaaggaaaacagaaagtaactaagaaaacgggagtcagttctagaatatggtatatccaagttaggaaattaggaacacagccacagataacagcacacagctaaagccgagagcagccagtccagatcacagcaagtgaaaagagactccaaaaagttttttctagttaagagaaagactcagtagaaaagtagttgatatttagaatcatagccaagaagaattaagaagagtaagtaagaaaagaattaaggatgtgagaatgaattatacaagtgaaagaacaggtgcatctccttcaaaacaaatatctacacagtataaaaggagtaaacatagcatgctagctggcccagcagtgaacaatattttcatcacgtagtggtgtaaatacagcttgctaatctacattaaaaataatatgattctattgtgataattctattgcaagaacgagggaggggcaaataagagaactaagtctatatccatcatcatagaaaatcaatatgtaatatttcaacatgcaaaatcaataaatagcaatatagatttcatgtttagaaatagggataaaactacagaagaaaaagctgaaagagtgaagtgtctgcctctgtagggtggtactacaagaaaaaagaactgcaaggtgctattgtgtactgtggtaagttttcagtatggggctgtttatttatatgtttgatctaaaaatcgtccccccccctccgtggctctgccctgcgtgggcggactgcgaggacctgatctctgcaaactacacttcccaggattccttgtgcattgactgctggctcgtttcagccaatgagaggcactggcagaaagtcagttgtcctggtatatgctggcatatctccgcttctctctcttctgtggtgccacctctggccactgatattctcctcacaaggcacaaggtccccctgcctagtgaggcctccaaagttctacttcaggcttggcggctccaactcttaagctactctctttgaacctccaacctagggacaagggcaacttccagcagcaaggaatctcatcttccgctggtggctccttaaggtcttataacacctttaaaaatagcgtcctaggccgggcacggtggctcatgcctgtaatcccagcactttgggaggccgaggtggacggatcacgaggtcaggagttcgagaccaccctggccaggatggtgaaaccccatctctactaaaaatacaaaaattagctgggcgtggtggcgggcacctataatcctagctacttgggaggctgaggcaagagaatcgtttgaacccgagaggcggagcttgcagtgagccgagatcctgccactgcactccagcctgggcgacagagcgagactccgtctaaaaaaaaagaaaaagaaaaagtgtcctatattaaataaattcctcatattttatactaatattaattccaattcaatactttacatcagctttgatttttcaaatggccctgagtgatacaagtaactgtgtagtattttaatatacaagtgtcagaaagtattgacagagcctctcgaccaaactttactctcttcaacgatttctcaacttttagactttttttacttatctctacattgtccaaatttagcaagaagcttgctaagtcaatttagtcattctccttgtctgctcaccctggatatctgatcgggttcctcatcctccaccatcctccagatgatgtgtgattgccctggcctgcctccagccagcatcctggcaggtcagtttggccacagaatctcccttactactaatgtttcctcttagtaattttccgtccaccgagctccctcccctgctccttgtttataaattctcactttttcttatttttttcagaactgagcccaatctctctcccccactgcaaggcgccattgcagtagtcctggatctatgacaaaagtaccctcttgaacaaagtctcccttactgtttttaacaagtttcattaatacttttttcttaaacagtataagtttctaaaaggtcaaatatatatttcatagtgctttgtgaattcttaaggaaaaaaatcagaacaatggcagaatcacttcaaaagaaaaggcgtggtggctcgcgcctgtaatcccagcactttgggaggccgaggcagcaggatcatctgaggtcaggagttcaagaccagcctggccaacatggtgaaaccccatctctactaaaaatacaaaaattagctgggcatagtggcgcatgtctgtaatcccagctactcgtgagactaagcggggagaatcgcttgaacccgggaggcagaggttgcagtgagccgacattgtgccgttgcactccagcctgtgcgatggagcaagactctgtctcaaaaaaaaaaaaaaaaaaaaccaaaaaaaaaaaaccaaaaaaaaaaaaaacagagagagagtgagagagagatcttatattctcctaaagtgtctacttggaatgaaattctcaggagttcacttatggctagttaaagccattgcattgttctacaatactgcaaaatgaaataagtaaaatattttgtccccaaataaaagagtacagcttactttttctaagaattaatattcatgaaaactacacttgtgtttttattttgtccccagtgaaaatcagcgtctcagcagcagatccactgaatatatcggtacaacttgatagatcactgcttcttcctacgagacttcagcgtcaaactaaagggaaaaacccagcagttttcttattattatcatgtatttaattacataaataatatttttaaaacagtccagaagagcacataatgaaaaccatgtctctctcattcgagtgtgctctctgtgggcagccagtgtccacgtctcctgtacccttccataatccatttatgtagttataagcatgcatttacattttcccagaaaacggggataataacatcattaactgaagtaaaatttttgtaaggattaaataagaagagaaggaaacaaaaatttaatatattaagtccttaataaatgataaatatcagttattcatattttctaatttcatcaaactatctactatcaagtatggaaataaatttatctggtctcctactgaggttgttttccaagcttccaagtttccaaagtttatataagtataagtattgtataagtattataagtgtatgaaatgcatgtataaaaaatacatagtgttgttgtagatttaagggattgtgcatttttacttttgtattaccaaacaatcctccaatcaaaaagcagacacacgcacacactatataagaggtgtgataatgatgtatagattgtaagtgtaatataagtcttcaaaatatgtcttgtggaacagatacaatctttcacaggtaaaaactgaatctttagtaggtttaaaaaagacattgtatatcgacataatcatgtgtgttataacataagcagtgatgtgaagcaggaattggatttgtatattgactccctgtcacagttaagatgctagactagttgaaggggaagaagacgaggtgtatcaactgaagtcagattatagaggaagttggagccaaatttctgagttgttggagaaggtaattacagattttgaaaccctggaagatataaatgcaattttttgtaaggacaatcatacctcctcttctcagactgatgatttccattacattttaaagggcctaagcaacaacatgtttttggtaagtctgagcatagttgcaaaccaaccagttcctaaattatgaaaattgtcattttctttcaaagcaaaatgacttaaacggctacaaatcaagttgtattgaataatccagggtttgcaatgtttactgtaattctgttttctgcaatgtgtagttttaatggttcttttattttgagaattagttctattggtatcaatatactcttagctcaagcagtaggtttgcttttttatgatactgtacaacaacttgagtggagctagcaggctgatttcatatgctagacatatctacctatccagtacttcttggcatataattttttttggacatgtacaaagtgtttttttccaagtatacaatacttcaggattaactatagtggatatgctgtacaatagatctccagaactcattcatcctaactgaaacttggtacccttcgaccaacatctatctcctcattctcctcccccacatcctggcgaccaccgttctactcttggcttctatgagttcaacttctttagattacatgtagacgtgagatcatgcagtatttgtctttctgtgtttgacttatttcattagcataatgcttatccatattatctcaaatgacaggatttcctttcttttttttactctaaatagtattccattgtgtatatataccacattttaaaaaatcagtttatctgttgatgagcatatcttggctattgtgaatagtgctgtaatgacatgggagtccaggtatctctttgacttactgatttttttcctcttggaatttatacccaatagtggaattgctggatcatatggtagttctatttttaacttgttgagaaaccttcatactgttttctataatgactgtgctagtttacattcccaccaacagtatagaaaggttctcttttctacatcctccccaacatttgttatcttttatcttttcataatatctatttgaacaggtatgaggtgatatctcattgtggggttactttgagtttccctgattattaatgatgttaagcaattttttcatataccttttggccatttatgtcttcttttgagtattgtatatgcaggtcctttgccaattttttaattggattacttgttttctggctatttggttgtctgagttccttatatattttggatggtaactccttatgaaatgtatgctttgcaaataattccataggttgtttttcacttttgatcatttcttttgctatcagaagcttttattttttaacattatttatttattttaattgagaaatattgtatttatcatgttttaaaatgtgcatccattgtgaaatagctaaatgaaggtaactaagatatgcattacctcacatacctatttttctgtgtgtgatgagaacacaaaatctgctcttaacaattttcaggaatacaatatagtcatccctcagtgtagttgggagatttggttccagaagccctgcttataccaaaatctagggatactcaggttccacagtctgccctgtggaacccacatatgggaaaagtcagccctcagtgtatctgggttttgcatcccatgaacactgtatttctggattgaaaattctgtattttcaatacagaattctgcagatgcagaacccttggatacaaacggctggctgtatttattgaaaagatctgcatagaaatggactcaaagaattcaaaccagtgttgttctagagtcagctgtacattgttactaactatagtcaccatgttttacattaatgctcttcaacttatttgtcctatcttactgaaattttgtatcctttgcccaacatctccccagacctccatgtttagcccctggtaaccactattccactctctgcttctatgagttccatattttcagattccacatataggtgtaatcgtttatatttttgtgcttggcttatgttacttactataatgtcctcctccagattcatccaggttattgcaaatgacatgattttcttatttttaaagctaaataatagtccattgcatttatgtaccacattttctttatctgttcatctgtgatgtacacttaggttgcttccatatctaggctattgtgaataattctacaataaacatgaaaatgcagatatctctttgacatactgatatcattttctttggatagatatccagtagtaagattgctgggccttatgatagttctatttgtaattttttgtgaaacatccatactattttctataatgattatactaatttacattcccactgacagtgtgaaaggatttccttttctcctgtaggttttcagtttgatgcaatccaaatggtatatctttgcttttgtcacctgtgcttttggagtaatatccaaaaaatcattgcctagatcagtgtcaaaaagcttttttccctgttttcttctagcagttttacagtttcaggttttatgtttaatccattttaagttgattttccctatgatgtgagaaaagatccaatttcattcttctgaatgtagacatctagttttcccaataccgcttactaaagacactataatttctccattgtgtattcttggcatttttgtcaaacagtagtggactgtaaatgtgtgcatttatttctgggcactctattctgttccattggtttatgtatctgtttttatgacagtagcatgctgtttcaatttctgtagctttgtaatatgttttgacattaggtagtgtggtgtcttcagctttgtttgtattgctcaagatttctttggctacttggggtcttttataattccacatgatttttagaatctttttcttctacttctgtgaaaactgtcattgaaatttttgtagggattgcattgaatctatagctcactttgggtagtatgaatattttaactgtattaattctttcaatccatgaacatgagatatctctccatttatttgcatatttttctatttcttttatcagtcttttatagttttcagggtacagattttttacctctttagttaactttgttgctaggtatttttaaaatgctgttgtaaaattgcattgttttgattgtttactatatatatatatagtcagtgtttatatagactaacaatgaactaccatttttagtatatataaacttcttcattgaagaagaattcagatagttcattgttagtctgtataaacactttgtatatatttcaacatttataaacatacacaaacactatatatactaacaacatttataaacatatataaatactctataaatactaacaatgaactagcttacttcttcagatagtatacataaacactactaacttttgtacattgattttgtagcctacaactttattgaatttattatttctcaaatatttttgataggtctttagggctttttatatgatttatatatgattatgacatctacagagaccattttacttcttcctttccagtctggataccttttattccttttatttgcctaattcctctaactaggacttttagtgctgtattgcatagaaggggcatccttgtcttgttcctgatcttagaggaaaaactttcagtttttcaccttaagtataatgttagctgtgaatttgtcacatatgacctttattatgttgagatacattccttctataactaaaatgttgagagtttattctgaaaggatgttgaattatgtcaaaaggttttccttcatctattgagatgatcatatggattttacctttcattctgttaatatagtgtatcacatatattgatttgcatatgttgaaccatccttgcatcttagggttaaatcccacttgatcatggtgtaagatcctatcaatatgcttttgaacttggtttgctcatattttgttgaagatttttttatctgtgttcacagggttattggcctataattttcttgtagtatctttgtctggttttggtattaggtagtgctagactcacaaattggctgataactttgattttgttttttattctaaaccactgctttctttctttttaagcatgtttaacaatcagagtcacagtgtagagcaggtccatcttccatccccctccaactctcctcatgcccttcccagttaatcctcctgtcacaacctcccaaagttctgggattacaggcgtgagttatcatgcccgacctaaaccactactttcaataaagagtgagaataaaacaatctatcataatgtttatgtttcttcatgcatacagtttgtataaagaatgtataatcatttttacataagcacttcacatctatatgaaatcccatttctattcctatctaagtgacgtgggtttgtttttctcaagacaaatggtttgttctattttaatttctgtcttactgtttttcttaatagggtagaaatgaacattttgagatttggaatcagactggtataatttgaatactagctagtctgtttattaattccgtatgtttgtttggatcacttctgtaaattccagtttctcatctgaaaatgaatacaattacagggcttacctcataggattgttttttcctgttaattaagtaaaatgagaaaggcagttaagaaagtgactattatatatcaagaaaataacgtatgatatctgttattattattgctattattaactattataaaaaccatgattggaagatgacaacagagctgaaactccagtgaaagactgaactagttaaaaatgcaccaaagccttgttattctgtctagacatgaagaggcttacaagtggaaccacatctttgactccgatttagaagggtggcatgtggaactcactatttcatcttttatcattccccagcactagacactataattactctggttatcactgtttctgggctcagatttcagcaggattgcatatctatcacaattaaaaaggcaaatgttgtatttttttaatgtggttagtgaagaaaagcttttaaataagtattctaaacctctggtttgagtacttgggaaaccatgaataggattgtaagaaggcattgagagaagaaaacttcaaaacttgcatttttgagataactttttaaaattctaatttccagtgaaaaatgtatagtgttcatgcaaatatatgcaaataaatacagctgcttttctattttaatcgtaaacctggccccttgaaatattttagcaaaaactatttgcatggaggctgtaataaacgatagtacatgtccctgttacatcaaacaaggcattctctgtatgtagactgctgcatttattattattattattcattacttcagaatcatatcatgtgaagactattgttctctggatcctggtgatggttttcattcagctgattttggcaatgattaaatttcttgttttgaagctagcggcatctcatatacaagttccctgagcatagagaccatgtcttatcttgctcatgactaaatctccaatgtcaagtacagtactcaaaacacaattattttttgataaacatttattaaatgaatgaataatgtctagtttaaatatatctagtgttttcatgatattctttatgtgttgaagcacccataccagttcccttcaaaatctgtgagcatagttctttcactgagtgtaggtatttgcaaatttgaccaagttttctgtaatagtacagaaaggcagaatcaatgctttctagaaaaaaaaaaatgaggttcagcttatcttgtcactattatgagaaagcatctctgtcccagtcataagatgtgtcatagactggaagtttctgggattttccataaaggagcagaatcacagacagtagaggggacatatggccccagtcgccctgctctgttcatggtgcctccttcctagtctaaggagagccagcaccactgcctctctcccatctgacctccactcatgactgcctagtacagcctgatgcacgctaaggccagagtagtgccatgaggaggtgtgtattttttatccccagtcacttatggctattttaaatctacggaagatcaaaaaaaaattatccttaagccaacctcatgtaattatacccattatacagaatagaaactgagttaatggaaagttaatgacaagttcaaagctgtcaaataataattctgtaatgggaacacatagcccttgaattttcctatatttatcctaagagcaggaacaatcctttttttgtctttcaactgaaaggttttattttattttatttttcatcaatttttattttaagtttcagggtacatgtgcaggatgtgcaggcttgttaataggtaaacatgtgccatggtgatttgctgcacagatcaacctgtcacctaagtattaagcccagcatccattagctattcttcctgataggctcccttccactgtcccccacaacaggccacagtgtaggtcattccctcccaggtgtccatgtgtcctcattgttcagctcccacttacaagagaatgtgcggtgcttggttttctgttcctgcgttagtttgctgaggataacagcttccagctccatccacatccctgcaaaggacatgatcttgttcctttttatggctgcatagaattccaggtgtatatgtaccacattttctttatccagtctatcactgataggcgtttggattgatttcatgtctttactattgtgaatagtgctgcaatgaacatacacgtgcatgtatctttaccatagaatggtttatattccttttggtatatacccagtaatgggattgctgggtcaaatggtatttctgcttctagatctttgagaaactgccacactgtcttccacaatggttgaactaatttacactcccaccaacagtgtaaaagcattcctttttctccacaaccttgccagcaactgttgttttttgactttttaataactgccatctaactggcaagagatggtatctcattgtggttttgatttgcatttctctaatgatcagtgatgttgagccttctttcatatgtttgttggctgcatgtatgtcttcttttgaggagtatctgttcatgtcctttgcgccccttttaatggggttgggtttttttttttttttgtaaatttgtttaagtaccttagagatgctagatatttagacctttgtcagatggatagattgtgaaaattttctcccatgttgtaggttgtctgttctctctgataatagtttcctttgctgtgcagaagctctttattttaattagatcccaatttgtcaatttttgcttttgttgtcattgcttttggtgtttccatcatgaaatctttgcccatgcctatatcctgaacagtattgcctacattttcttctagggtttttattgttttgggctttatatttaagtctttaatccatcttgagttgacttttgtatatggtgcccagtttcagttttctgtatgtggctagccagttctcctggcaccatttattaaataggaattatttcttcattgcttgtttttgtcaggtttatcaaacatcagatggttgtaggtgtgtagtcttatttctgggttctctattcttttccattggtctatgtgtctatttttataccagtaccatgctgtttaagttactatagcactgtagtatagtttgaagtcaggtagggtgatgcctccagctttattctttttgcttaggattgccttggctatttaggctcttttttggtcctatatgaattttaaaatagttttttttttttttacttctgtgaagagtgtcaatggtagttttacaggaatagcattgaatctacaaattgctttgggcagtatggccattttggcgatattgattcctcctatccatgagcatggaatgtttttttcatttgtttgtgtcctctctgatttctttgaacggtggtttgtggttctctttgaagaggtccttcacttcccttgttagctgtattcctaggtattttactctctttgtagcaattgtgaatgagagtttattcatgatttgtattttctgcatgcctgctgtttgtgtataagaatgctagtgatttttgcacattaattttgtatcctgagactttgctgaagttgcttatcagcttaagaagctttggggctgagggccgggcgcagtccctcatgcctgtaatcccagcactttgggaggctgagacaggtggatcacgaggtcaggagatcgagaccatcctggctaacacagtgaaaccccgtctctactaaaaatacaaaaaaaaaaaattagctgggcatggtggtgggtgcctgtagtcccagctgctcgggagactgaggcaggagaatggtgtgaacctgggaagcagagcttgcagtgagccaagattgcaccactggactccagcctgggcgacagagtaagactctgtctcaaaaaaaaaaaaaaagaagctttggggctgagacaatggggttttctagatatagggtcatgtcatctgcaaacaaagataatttgacttcctttcttcctatttgaatacccaccctttatttctttctcttgcctgattgtcctggccagaacttccaatactattgttgaataggaagggtgagagaggggatccttgtcttgtgctggttttcaaagggaatgcttccagcttttgcccattcagtatgatattggctgtaggtttgtcatatatggctcttactattttgaggtatgttctttcaatacctagtttattgagagtttttaacatgaagggatgttgaattttatcaaagatcttttctgcatctattgagataatcatgtagtttttgtctttagatctgtttatgtgatgaattacatttattgattagcatgtgttgaaccagccttgcatcttggggatgaagccagcttgatcgtggtggataagctttttgatgtgctgctggatttggtttgccagtattttattgaggatttttgcatcgatgtttatcagggatattggtgtgaagttttcttttttgttgtatctctgccaggttttgatatcaggatgagtctggcctcataaatgagttagggaggagtccctcctttcagttgtttggaatagtttcaatagaaattgtaccagttcctgtttgtacctctgttagaattccgctttaaatcctttggtcctcagctctttttttggttgatgggctatttcttacttcctcaatttcagaactcattattgatctacttagggattcaatttcttcctggttcagtcatgggagggtatatgtgtccaggaatttatccatttcttccaggttttctagtttatgtgcatagagctgtatatagtagtctctgatggttgtttgtatttctgtggggccagtggtgatataccccttatcatttctgattgtgaatattgattcttctctcttttcttctttagtctatctagcagtctatctattttattatttttttcagaaacaaaacagttcctggatttgctgattttttgaagggtttttttttttgtgtctctgtctccttcaattccaaagatcagaatcttatctccaagaaatgggtaaatatggtattgtgtctttgcctcaaactgcaaactttgacatctcacaaattttgaaaattccacatagccctagaagttttctgctttttcttgtttctttgaaacccatttcaatgtaactttttctttgatttgctctcttgtatacaaatctaaatagaaccacaaaaaaaaatatgcaataccatttggaaaaaggaagcaatttataaataatcaatgactaataaaaatgaaactagttttccttttttaacacttgataaagaaaagttaggtcaactttgaagcacttaataaagtgttttaaattaaattttttaggttggatttgtatctcaaagtagaaatgcctagtcagccttatcaatgaatactccttttggtttgcattacatatctgaacagtttttttcatttgcattaaatatcctaatatttttcctaatatgttaaaagatgatattgcatctgtctgatcagacatactggtccaaaacttaatttactaggatatgaaatctttgttagcttggagaaataatttccaattatgcatttcagtctcaaaatgcacacctaaacccatttaagactagctaagaacatttttataatgcatttcttagaattagctacagttatggactagtttttcttagtctttttttatgaatcaaagatagattgtctaccattcttcctcccctcccgttcaccttgttctagatggaatgaattgatgcaatttattctgtatcatttaactcatcctttatttctataaaggcaaaaataaagatataagtgtgaatccatgttttcctatttttttggcatttaaaccgaagtgtagaagattaggtattaattataattgcttaaaattcttcatagtagctttttaaataaatgggaattccaagaataattataaggtgattttaaaaacaaaaatacaagaacttatgctcctaaataattgttatccttctaggaagttatattggataaatagcaaccttattgaaataacctgtggcctgaagtaacagtgaaagacctatatggatttaaaacatctttctaccacttaaaaatagtatgatctaaggcaagttatttaagcactctgtctctcaatttaggtatctgtagattgttacaaaatggccttgagtggaagacatctccctaaatgcatcccgcattgaatcctggctggccttaggccgacagaatgtaacagatgtgacatcttgccagttctaagcctaggcattgaagagcttttgtagcttttgtctgaaatcaaaccactctgctatgaagatggcccatctaccctattggagaatgagaggtcatgtggagaaaacatgtggtagcttagctggcagccaaaagccagacgtgagcaagtccatcctggaacctccagcttcaattgagtcatccagtgacatcaccacatgaatgatcctaagtgacaccagcagaagaaacaaccagattgccaatgcacactaagaaccaagccaggtactaaattaggcagagataagggctggagtttagagattctaactccagtaatgtgctacttccacctctctgtctgaggggcaaccatctggcaatcctgagtacaaggcagaaattcagcatttggataaggaatctgctactgcttgggggtgtttgcaggaggaaatatagacatgcagttacaatgataccatccgtttctgaaaggtaagaagcaaaacacatgactagacacaacttccaagtcaagttaggagtttttcttttgtgctatgtgttggttaaaatcagaatctagcattatatgacttcagaagcttcctagttacacatacccagggaaggagaattcccataatcccataatcttattcagattaaactgatttattcacttccaattatgtgccattttttgagaaccttatcttggtaagagtagatttgggtgagagggaatcagtcttaggtagaattgaagaatctcagcaccagctaaatatttttgagcagcctatggacacgtttccagtgagagaaagaaagaggattggctaagtgtggtagctgacaccttccactgtgctcacaaagtgtgttgctctactccatgcagctctgaccagcagcattgacataatgacctccttgctacagggagcatctcaagctcagggattcaggctttttatcttttaaatagaattgccagacagcatacacgatgcccaatttaatatgaatctcaggtaaacagcaaatcatttttcagtatgtctatgcaatatttgtgacatacttatatcaaaaaatgatacactgttaatctgaaattcaaattactatttaactgggtgtcctcttgtgtttttagtcggtttgcttattttgcttcatttgttttgtttttggctaatctggtaaccctccttagaaatgaatgtcaatacagttgtgccatagaagaggtgctcaaggctgggcgtggtggctcatgcctatagtcccagcattttgggaggccgagatgagtggatcacttgagcccaggagttccagaccagcctagccaacatggtgaaaccccgtctctactaaaaatgcaaaaaatttagccaggcatgttgacatgtgcctataataccacctaccagggaggctgagatgggaggatcacttgagtccagcaggtggaggttgcagtgagccgaaatcgcaccactgcacactagcctgggaaacaaagcaagagcaagactctatctcaaaaataaaaaaaaaaagaggtgctcaataaatgctatttgaatattgattcaaactttttgcaattccacctaatttcttgtcttgttatcatggttccactaaccttttcgatgtcacagactctagtgtgattctacacagaaatctcaacccctgtaataattatagccaaaataacagtattatctatatttctgcagcagcttatggtttttcaaagagggagtacttgcttattttaaaaataaactctgagtaattacacagttaaactgtggctgtagatgaaaagaaaatggagagagtgaaaaatggtggttcatagaaagatctttgtgcttacataaggcactacatttctggttcatacattttccctcatattctgaaatcagatcgttgtttttctaacatgactgtggcaggttcaaaggaagagaaaataactaaatgtagaatactgttggctgtaggtgaacatgcattaattccctgtcatcccatttcatgccttgcaatcttccaactgttaattaagacaaacagcaaaatcatatcctttagcaaacagtctagtaccctttcccagtctgggatgtgacaggcaccacactcaaagtatgctttttttggtcatctttatatagcataatagaccaaccaagtacaagttaagcagactgaaaggaagaattatttcacactcctgctgatgctgctggaaagtgtagaaatgatcttggagtgcttcctttagttctttatcctttagaatagctcacagaaggcaacctaacaagcattaggattcacaatgccatctgtctgttaaaaatatagtctaattccaaagaagggcattacataatagtaaagggatcaatgcaacaggaagagctaactatcctaaatatatatgcacccaatataggagtgcccagattcataaagcaagttattagagacctacaaacagacttatactcccacacaataatagtgggagattttaacaccccactgtcaatattagatcaacgagacagaaaattaaaaaggatattcaggacttgaactcagctctggaccaagcagacctaatagacatctacagaactcttcaccccaaatcaacagaatatacattcttctcaacaccaaattgcacttattctaaaattgaccacataattggaagtaaaacactcctcagcaaatgcaaaagaatggaaatcataacaaacagtctttcagaccacagtgcaatccaattagtactcaggattaagaaactcactcaaaaccccacaactacgtggaaactgaacaacctgctcctgaatgactactgggtaaataacaaaattaaggcagatataaataagttctttgaaaccaatgagaacaaagacacaatgtaccaggatctctgggacacagctaaagcactgtttaaagggaaatttatagcactaaatgcccacaggagaaagtgagaaagatttaaaattgacaccctaacatcacaattaaaagaactagagaagcaagaggaaacaaaagctagtagaagacaagaaataactaagatcagagcagaactgaaggagatagagacacgaaaaacccttcaaaaaaatcaatgaatccaggagctggttttctgaaaagattaacaaaatagactgctagccagactaatgaagaaaagagagaagaatcaaatagacacaataaaaaatggtaaaggggttatcaccactgatcccacagactaccatcagagaatactataaacacctctacgcaaataaattagaaaatctagaagaaatatataaattcctggacacatacaccctcccgagactaaaccagggagaagtcgaatccctgaatagaccaataatgggttctgaaattgaggcaataattcatagcctaccaacaaaaaaaccccaggaccagacaaattcacagccgaattctaccagaggtacaaagaggagctggtaccattccttctaaaactattccaaacaatagaaagagggaattctccccaactcattttatgaggccagcatcatcctgataccaaagcctggcagagacacacagaaaaaaagagaattttaggcaagagaattttaggccagtatccctgatgaacctcgatacgaaaatcctcactaaagtactggcaaaccgaatccagcagcacatcaaaaagcttatctaccacgatcaagctggcttcatccctgggatgcaaggctggttcaacatatgcaaatgaatcaatgtaatccatcatataaacagaaccaaaaacaaaaaccacatcattatctcaatagatgcagaaaaggccttcaataaaatttaacaccccttcatgctaaaaactatcaataaaataggtattgatggaatgtatctcaaaataataagagctatttatgacaaacccacagccaatatcatactgaataggcaaaagctggaagcattccctttgaaaaccagcagaaaacaaggatgccctctctcacccctcctattgaacatagtattggaagttctggccaggacagtcaggcaagatcaagaaattaagggtattcaaataggaagacaggaagtcaaattgtctctgtttgcagatgacatgattgtatatttacaaaaccccattgtctcagcctaaaatctccttaagctgataagcaacttcagcaaaatctcaggatacaaaatgaatgtgcaaaaatcagaagcattcctatacacctataatggacaaacacagaaccaaatcatgagtgaattccctttcacaactgctacaaagagaataaaacacctaggaatacaacttacaagggatgtgaaggacctcttcaaggagaactacaaaccactcctcaaggaaataagagaggacacaaacaaatggaaaaacattacatgctcatggttaggaagaatcaatattgtaaaaatggccatattgcccaaagtaatttatagattcaatgctatccccatcaagttaacattgacttttttcacagagttagaaaaaactactttaaatttcatatggaaccgaaaaagaacctgtatagccatgacaatcctaagcaaaaagaacaaagctggaggcatcatactacctgacttcaaactataccacaaggctacagtaaccaaaacagcacggtactggtaccaaaacagatgtatagaccaatggaacagaacagagccctcagaaacaacaccacacatctacaaccatctgatctttgacaaacctgacaaaaacaacaatggggaaaggattccgtatttaataaatggtgttaggaaaactggctagccatatgcagaaaactgaaactagaccccttccttacaccttatacaaaaattaactcaagatggattaaagacttaaatgtaagacctaaaaccataaaaaccctagaagaaaacctagacaataccattcaggacttaggcacgggcaaagacttcatgactaaaacaccaaaagcaatggcaacaaaagccaaaattgacaaatgggatctaactaaacctaagagcttctgcacagcaaaagaaaccatcatcaaagtgaacaggcaacctacagaatgggagaaagtgtttgcaatctatccatctgacaaagggctaatatccagaatctacaaagaaacaaatttacaagaaaaaaacaaacaaccccatcaaaaagtgggcaaaggatatgaacagacacttctcaaaagaagacatttttgcggccaacaaacgtgaaaaaaagctcacgatcactggtcattagaaaaatgcaaatcaaaaccacaatgtgataccatttcatgccagttagaatggtgatcattaaaaggtcaggaaacaatagatgctggagaggatgtggagaaagaggaatgcttttacactgttggtgggagtgtaaattagttcaaccattgtggaagacagtgtgtcaattcctcaaggatctagaaccagaaatgccatttgatccagcaatcccattactgggtatatacctaaaagattataaatcattctactataaagacacatgcacgtgtatgtttattgtggcactgttcacaatagcaaagacttggaactaatccaaatgtccatcaatgatagactggataaagaaaatgtggtacatatacaccatggaatactatgcagccataaaaaaggatgagttcatgtcctttgcagggacatggataaagctggaaaccatcattctcagcaaactaatacaggaacagtaaaccaaataccgcatgttctcactagtatgtgggagttgaacaatgagaacacacagacacagggaggggaacatcacacaccagggcctgtcagggggtggggggctggggagggatagcattaagagaaatacctaatgtaaatgatgggttgatgggtgcagcaaaccaccatggcatgtatatacctgtgtaacaaaccttcacattctgcacatgtatcccagaacttaaagtataataataaaaaaagtacagtctaattcattagacactgatatatatatatatatagctttgtttgctagttatttcttattgctctctgttgacccgaaactaagtcattaagcagcaggaaaagtaataagagctaattttctgttcaagtcaagaaaatgtgctacctttatagtgctttaggaagtcttcatcatcaaaaaatactaaagaatactggaagaggaaagcatttacatattaaagtggtaaaaagatagaggccaaagtctatacaagagataaaactaatcaaataacagccataactcttaagggatatgactgtctgcaaagactaacatttccttctactatttaagagaaaataaccccaaatcaaaaccagaaaattaaatgaactgaagacaatttattgcaaaatatgacaatctgtacaaactttgtgagaatggcatctctttgtactatgctccagagtttgtctaatctttcaaggatgaaatgtttacccccagttgtggttctctgagatctatgtttcttacttgattagacacaggacaaaaatctcaaaagaatcctttgagatttttttgcatttatatttgagatttacatttatatatttatatgatatatttgtatataaatctgtgcattatgtattatataaatttggcaatttagataatgtattctccttagtgatatctaaggagctatcatattcccttcttagttatcttcccaggagtgaagtgaggtgatatgaattgagcaattgaggcagattttaacagcaattcctctggatcaggactaaatatttttgttggtggtgcttgtttttattctgcatatattatatatatatatatatatatatatcattaaatttaccttttaaaatgactttaagtgtataattcagtggcattaattatattcataatgttgtacaactatcactactatctatttccaaaaccttttcatcatgccaaatacaaactcagtaactattaagcaataactctccattctcccctctgccaatactggtaacttctaatctactttttatcactatgaatttgcctatactagttatttcatataaataataaagtatttgtccttttgtgtctcactcattgcactcagcataatgatttcagggttcatccatgttgtagcacatgtcagaactttattcttttttatggctgaataataatccgtagtaagcatatacattgtgtttatagagtcatcttttgatggccactaggttgtttacaccttttcgctattatgaataatgctgtgatgaattttggaatataagtatatgtttgaatacctgtttcaaaaaacaaaaaaaaagattgtttcctgttttgaaaaactgctgcaccacattacactcctaccatcaatgtatgagaatttcggtttctccccatccttgccaacgcttgttttccttttcattttgtttatttatttcagtagatttagggggtacaagtgggttttggttaaatggatgaattgtgtagtggcgaagtctgggctttgttttttgttgttgttgtttttcagacagattctccctctgtcgccaggctggagtgcaatggcgcaatctcggctcactgcaacctccgcctcctgggtttaagcgattcttctgtctcagcctcccgagtagctgggagtacaggcgtgcccatgcccacctaatttttgtgtttttagtagagacggggtttcaccacgttggccaggttggtctccatctcttgacctcgtgatccgcccacctcaacctcccaaagtgctgggattacaggcgtgagccaccgcacccggccaaagtctgggcttttagtgtgcctatcacctgaaaaatgtacattgtacccaataggtaatgtttcatccctgacccctgcccctctctgagcctccagcgtcctttataccactctgtgtgcctgcatccccttagcttactccctcttataagtagaactaagtatttttgactaaagatttggagcgccatgctgcctccatcctcatcagaaagcaccatgttgccattcgatggaaacctttgacaatggagcaccatgctgacagacgagaaccaaaaggaggctccagggctgctgccccacgtgccatatattctgactgtatggcaggttcttgaattcactgcttcaggtcctttgaattgtaacaaatgccttcaggttacaagcccttagtttattatgacttgtgtgcttcctttttacagccctaacaaacataagactcttaatgtaaaggagatctgtagagaagcttcacttacactctaatttggagatttgtcaacatcagtgtattaatccctttcctccctccctctctcttccttctatgtgagtttatcatttgaatgtaaacatttgcctttgaactgactggataattggttcggagactctttaagcatttatttagaaagcaaagttcaggtttaatttccctacagttacatagtatagtgaggtgggaatcttcactgcatattccagctgttttgatataattagatgtttatgctatgtccacatccgcttttcccttctcacactcctctagttttccctgtaccattggtttataaatcactcccaaactgcccctccttaatcaggccaggcagaagccagcggccccatgccagcggccagcagctggagatgtggggtcgcagccacgcggcgtgacccagggtcagaaagagtgggccagagagaaccatggcccgcactgctaacttccaggacatccacaattttcattcccaggaagagtctttcctgggaaaggtacagaaatttcagttgctctagcatgtagtgggattttataatgagccaggcaggaaaataacagatggtgcactgagtgtaaatatatgaaaatacccttggagcagaaacagaaggctggcactcccaggggactcgggcgaaaacagacaagactccccgctgtctctcagctcttctaatgtttttctcacgtcttaaggcacagacaatgtctattgcatgtaacatcttatattctctcaccttagtgcaccaaatcgtgatcctcttggaggccctcccctctgatctctgtgccctctaatctccttgcttcctcctctctgctcaggtttgctttcttgggtctctcctctttcatcttagctgtttctccaggctgtttgaaggttcccacctccgttctttcttggttctggatctgtctgttagaatgactccaactccagcgctgtggctttcaccatgtttcttcactttcatgtctttttttatttataattgagcacacacacacaccacacacacactctctctctctcctatacttccttctttagaaagctttctgctgttgttgttgttttaataatctttcagatcattttatttagctttcatccatttccctcattaaagtcagttgaaagttttgtcaacatgtaatatgcatttgatataatgattttagtataataattacctgaggtaacactgtgtcagaggagaagtgtggccaattatatcttaaattacatgaacagcgctttccctttcacacagctatacatttctttaggcactaaaaatctgtaatctgtagcttccattaaattggatttagttgttttgcaaataaaattgtggaataaaaggttgtattagttactgttctccagagaatgagaatgaatagggtgtatgcatgtgtgtgtgtgtgtgtttacaatcagttgactctaagtaaagcagtggagagcaatgggtgggcctcattcaatcagtggcaggcctaagagcaaagagagatttctcaaaaaagaaggaagtttcctcaagactgcaacatggcaaagctgctcagtagactcagttagtctattgccctgcagaatttggactgaaagctgtgacatcaattctttcttaaaactctgagagattgcttgattgattttaaggaattggcttacatgattgtgggggctgacaagtccaaaatctctagggcaggccagcaggctggagactcaggacagagttaaagttgcagtcttgcatataaattctgcagggcagtagtttggaaactcaactgggtttctgtgtggaagtcttgaggagaattctttcttctttgagaaacaggctttgtttgcaatctttgctcttaaggctttcaactaattgaaagaggcacacctgtatgatggagggtaatctgctttacttaaagtctactgattataagaattaatcacacctaaaatatacctttacttcgtggcaacaacacacactgggaacgactagacaggggcaagggttgaaaaactaactgttgggtactatgctcactctccgggtgacaggataattcatggcccaaacctcaacatcaagcaatgtacccacgtaacaaacctgctcatgtacccctgaatctaaaataaaagttgaaattattaaaaagaaatattgaaggaatgatataaagattttaaatgaataaataataataccttgactggtgtttggccaaacagctgggcattctagtcctcgccaagtcaacacacaaaattaaccattacagtggtgtttccccatttgtagggagagggaaaggatcacatttaatgaaaaacatttttgtttccgaatgtatatttctaactcatttttctttgaattttcttatattttcatgtttatacagaaatacggtatattggcatttaatttagcacaaaacttgagattcgttattctaaagttttaatattttgtgatgctctacaagaaggactgtaactcccagacacaaagctacctgcaagttcaagcattgctgctttttacatgaaatgtcatggtaactggcaaggattccccaagggcctagaagtagtggaagtcagattccccttatatgcagtgtactgtatgaacatatttacatcctccaacaataggctgcctttagcagcctgtaggtttggaaaacactatttttgtttgggctccgggtccagccatttcaagcctggtaataactgcggtctccctcaccaccttcctcaccaactggaatggtgtgttggaatattttcagctgttaattacataatacctcaaaacagtgcttaaatagatatttttgtccacataaaaataatctgaaggtaggtggttccaggttagtaaagtggtcagtgatgtcaggagccgagtccacatctctctgggtctgtggcctcccttcacagtcgcatgagagctgctgtagctctaggtgtctccttacaacaccatggtgcttgaaagcaggaaacgggtgggagggaacaaaaccttcttctcatacatttcccacatttcaggtagaaaaagtttcccggaggcggaggttgcagtgagctgagatcgtgccactgcacgccagcctggcaacggagcgagactctcttaaaaaaacaaacaaaacaacaacaaaaacgaaaaatgtttcccagaatcctcggcacaggtttctgcttccacctcataggccaaattgatcacatgttcttccctagccaatgaccgggcctttctcccctgacataaggggatctctcctgtcaaatgaatacaataaggttgggttagcaagcaagaaagtgggtgtggatgccgttgaatagctgcagcaatatctaccagatgccacccctttggccgcttggcattcacactcaccctccttccacacatacacaacacatcagccctcactgcacaaatgaggcccacagcttccttcagctccaacgccatgatctcaggtgaccacctggactctctgtcaagtccaaatgttgctcctcacaaatgtctcctatagtaaagcataagccatctgtccactacatacctaagacatagaaatggagaaggaacaagttaaccctaataaagccttgtatttggcagaggggagaacaggaaatagtaaccacttgtttacagcacatatcagatactgctcagcaggaatagtgaggaccatatattctggaaatggagtaagctcctcttagctgctctgagagccctgattctttctttcagtagattttcttgtccattttaccacatggcaattttggaatgcacattggagagtaaggtcttcctaggggctgtagagattgcgcagccctcttcctattggtggaattgtggggaactgggaattgctttgaggattgaactttcacagaattctgcagccagccttggaagttctgttagcacaactccgttatcttaaaaatttagtatgcttgttgtcacagaaattaaaaaaaaaaagacatcataacttctgaccacaataaaattaaaagtaaaaataaggttttttaaggcataagaaaagtcttatgattaaaaatacactcataagtaatactaattcctgctcaagaaagaaattatgatatacatttaaaacaatagaaaaaaatggaaatataccatatatcaaaacctgtacacggcagataaggtggtatttagaggttaatttgtagccttaaataaatatctcaaaaacattatatgtagccttaaataaatgtatttaaatagtttttaaaatgaagaaaaccattcagctaaaggcactagaaaaagaacaacagcataaacttaagttttgtggtttttttttttttttggagacagggtctcactctgattgcccaggttggagtgcagtggcgtaagtttggttccctgcagcctcaacctccccaggcttctcccacctcaacctcctgagtagctaggactacaggcgcacaccaccatgcccagttaaatttttttagttttgtagagatgcagttttgctgtgttgcccaggctggtcttgagctcttggactcaagcaatccacccaccttagccttccaaagtgctgggattattacgagtgtgagccactatgcctggccaacataaactttaaaaagtagaaaataaacttaattctaaaattttaagagcagaaattactaaaaagaagaaaaaatagagattaacaaaatcaaaactgattattgaaggaaaattaataaaataggcaacattctaagaagactgagaaaaacaaaataagaaaaaatacaacattagaaattttaagagcagagatactttaagatttcaaaacgtataacgggatacgttaaaaactttatgacaatattttaaaattagattaaatggatactttaataaaaatggcaaaaatttgacaagaagaaacaaagaatctggataacataataataaagacattttatctcatcaagatgtaaataatttctattttatataaactttttcaaagaagatgaaaaaattacctatctcattgagtgaggataaatcttgctttgtaaggatagaataacactgacaaggacagtaaacgaaaagaccatatgacctactagaatataaatgaaaaaaatcgggggaatagcattaggagatatacctaatgttaaatgatgagttaatgggtgcagcacaccaacatggcacatgtatacatatgtaactaacctgcacattgtgcacatgtaccctaaaacttaaagtataataaaaagaaaaaaatcctaattaaaatattttcaaattgaattcaatagtatattaaaaatgataatacttaagtagcattttatccctataaatgaaaatctggttcaagagaagaatcctctaatgtcgtttaccacataagaaattacactggtggttgccgggtgtaaggggaggggaaatgggcagttcttcttttaaggacatagagtttcaattttggaagatgaaacagttctgaagattggttgtacaacaaggtgaacatacttaacactactgaactatatatttagaaacagttaaaatagtaagctttgttttttctaataaagctttttaagacattgcagaacaaatatataaattttatctcaatagatacagaagtgttcaataaaatcagtggtcatttataatttttttaaaattagcacatctgaactataaaggagtttccccactgtggttggctcgataacgatccccttatgtccacatcctaatccctggaacctgtgaatgtcaacttgtagggcaaaagggaccttgcaaatgtgattaagaatctcaagaaaggaagagtatcctggattagctatggggcccagtgtgattacaaggatccttagaagagggtggcatgaggagtcaaagatcagaaagagacgtgatggtggcagcgtttggagtgacgtgctttgaggatggaattccttggctgccaagggattcaggcaggcactagaagctgaaaaaggcaaccaaacagatactttcctcagagcttccagaaaaaaccagcccaacagacaccttgactttaccttagtaaagctgattttgcaatctggcctccatgactataagaaaataactgtgtgctgtttttaagtcactgttttttgtaagttgttacagcagcaaagggaaactaatacactcaatatcattgattcatttattcaacaaatatttagtacagacctgtcatgtattaagcgcttttccagactctggagatatcaaaataaacaacaaaaaaagcttcaaacaaaacagtaacaacaaattctaccctgttgcacttgtattctaatgaggaagttgagggtaaataatcacaaattagtaaaaaaaaataaagttagacaatgatcatctccaaggagaaaaataatgcagggaggagaggacgtacacatcatggtagaggaggtattgttactgaaacaccaggtgctcggtctaggctctgctgctcaccgcacagaaagccaatcactgagatgatgagtgttgccaaggaagaaggctttaattgggtgctgcagctgagaagatgggagctcagtctcaaaatccatctccctgactgaccaaaactaagggtttatatatcaggaaagaaatgtaacaacgtgtaagaagacaggaactccggaggagcaaaaaaacaatcataatgaatgagaggtggcatcccattatctggatgtgatgatctggtgagttccagttccttgatccttttcttgagaggcatgaaggttgtttccggaggaactcagataaaataaatataagtttcaagctttaagaccagagggtcaacttctatgtttatcaaaaaataaaataaactatctgtgggactattgggtcactttcagtgagatgcatttctggattgggagggtaggataggagtcaattaaaaagtgtcattggagtaacatcggaggaagtaaggagcagggccttgtatgtgtctgggataagagcactacagtcagaaaaaagtagcgagtgtgaagtttagaggcaggggcgtgggcctgtcaggtgagagaagaccagtgctggagtcaagggagccagaggagagtcccaggagatgaggtcagagaagcaaggatggctgtagaccatgccaggccccacagattgcaatgagggctgagggcacactggggaccctttgtaaggtctttttttaaaaaattattattattatactttaagttttagggtacatgtgcacaatgtgccagttagttacatatgtatacatgtgccatgctggtgtgctgcacccattaactcgtcatttaccattaggtatatctcctaatgctatccctcacccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctcaaaggacatgaacttatcattttttatggctgcatagtattccatggtgtatatgtgccacatttcttaatccagtctatcattgttggacatttgggttggttccaagtctttgctattgtgaatagtgctgcaatgaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatggcatctcattgtggttttgatttgcatgtctctgatagccagtgatgatgagcattttttcatgtgtcttttggctgcataaatgtcttcttttgagaagtgtctgttcatgtcctttgcccactttttgatggggttgtttgtttttttcttgtaaatttgtttaagttcattgtagattctggatattagcctttgtcagatgactaggttgtgaaaattttctcccattttgtaggttgcccattcactctgatggtagtttcttttgctgtgcagaagctctttactttaattagatcccatttgtcaattttggcttttgttgccatttcttttggtgttttagacatgaagtccttgcccatgcctatgtcctgaatggtaatgcctatgttttcttctagggtttttatagttttaggtctaacgtttaagtctttaatccatcttgaattaatttttgtataaggtgtaaggaagggatccagtttcagctttctacatatggctagccagttttcccagcaccatttattaaatagggaattctttccccattgcttgtttttctcaggtttgtcaaagatcagatagttgtagatatgcggtgttatttctgatggctctgttctgttccattgatctatatctctgttttggtaccactaccatgctgttttggttactgtagacttgtagtatagtttgaagtcaggtagtgtgatgcctccagctttggattgacttggtgatgcgggctcttttttggttccatatgaactttaaagtagttttttccaattctgtgaagaaagtcgttggtggcttgatggggatggcattgaatctataaattaccttgggcagtatggccattttcacgatattgattcttcctacccatgagcatggaatgttcttccatttgtttgtatcctcttctattttattgagcagtggtttgtatttctccttgaagaggtccttcacgtcccttgtaagttggattcctaagtattttattctctttgaagcaattgtgaatgggagttcactcatgatttggctctctgtttgtctgttattggcgtataagaatgcttgtgatttttgtacattgattttgtatcctgagactttgctgaagttgcttatcagcttaaggagattttgggctcagacagtggggttttctagatatacaatcatgttgtctgcaaacagggacaatttgacttcctcttttcctaattgaataccctttatttccttctcctgcctaattgccctggccagaacttccaacactatgttgaataggagtggtgagagaggacatccctgtgttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttgttggttgtgtctctgcccggctttggtaccaggatgatgctggcctcataaaatgagttagagaggattccctctttttctattgattggaatagtttcagaaggaatggtaccagttcctccttgtacctctggtagaatttggctgtgaatccatctggtcctggactctttttggttggtaagctattgattattgccacaatttcagctcctgttattggtctattcagagattcaacttcttcctggtttagtcttgggagagtgtatgtgtcgaggaatttatcaatttctagattttctagtttatctccgtagaggtgtttgtagtaatctctgatggtagtttgtatttctgtgggatcggtggtgatatcccctttatcattttttattgcatctatttgattcttctctcttttctctttattagtcttgctagcgatctatcagttttgttgatcctttaaaaaaactagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggctgttcagtttccatatagttgagcggttttgagtgagtttcttaatcccgagttctagttcgattgcactgtggtctgacagacagtttgttataatttccattcttttacatttgctgaggagagctttactttcaactatgtggtcaattttggaataggtgtggtgtggtgctgaaaaaaatgtatattctgttgatttggggtggagagttctgtagatgtttattaggtccacttggtgcagagctgagttcaattcctaggtatccttcttaactttctgtctcgttgatctgcctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctctgttggtttaaagtctgttttatcagagactaggattgcaacccctgcctttttttgttttccatttgcttggtagatcgtcctccatccttttattttgagcctatatgtgtctctgcacaagagatgggtttcctgaatacagcacactgatgggtcttgactccttatccaattcgccagtctgtgtcttttaattgggacatttagtccatttacatttaaagttaatattgttatgtgtgaatttgatcctgtcgttatgatgttagctggttattttgctcgttagttgatgcagtttcttcctagtctcgatggtctttacattttggcatgattttgtggcggctggtaccggttgttcctttccatgtttagtgcttccttcaggagctcttttagggcatgctcggtggtgacagaatctctcagcatttgcttgtctgtaaaggattttatttctccttcacttatgaagcttagtttggctggatatgaaattctgggttgaaaattcttttctttaagaatgttgaatattggcccccactctctttgggcttgtagagtttctgccaagagatccgctgttagtctgatgggcttccctttgtgggtaacgtgacctttctctctggctgcccttaacattttttcctcatttcaactttggtgaatctgacaattatgtgttttggaattgctcttctcgaagagtatctttgtggcgttttctgtatttcctgaatctgaatgttggcctgccttgctagattggggaagttctcctggataatatcctgcagagtgttttgcaacttggtttcattttccccatcactttcaggtacaccaatcagacgtagatttggtcttttcacatagtcccatatttcttggaggctttgttcgtttctttttattcttttttctctaaacttcccttctctcttcatttcattcatttcatcttccatcactgttaccctttcttccagttgatcgcatcggctcctgaggcttctgcattcttcacgtagttctcgagccttggctttcagctccatcagctcctttaagcacttctctgtattggttattctagttatacatttgtctaaatttttttcaaagttttcaacttctttgcctttggtttgaatttcctcctgtagctcagagtagttcgatcgtctgaagccttcttctctcaacttgtcaaagtcattctccatccagctttgttccgttgctggtgaggaactgcgttcctttggagtaggagaggtgttctgctttttagagttcccagtttttctgctctgttttttccccatctttgtggttttatctacttttggttcttgatgatggtgatgtacagatgggtttttggtgtggatgtcctttctgcttgttagttttccttctaacagacaggaccctcagctgcaggtctgttggagtttgctagaggttcactccagaccctgtttgcctaggtatcagcagcggtgtctgcagaacagcggattttcatgaaccgcaaatgctgctgtctgatcgttcctctggaagttttgtctcagaggagtacccggccatgtgaggtgtcagtctgcccctactggggggtgccttccagttaggctgctcgggggtcaggggtcagggacccactttaggaggcagtctgcccgttctcagatctccagctgcatgctgggagaaccactgctctcttcaaagctgtcagacggggacatttaagtctgcagaggttactgctgtctttttgtttgtctgtggcctgcccgcagaggtggagcctacagaggcaggcaggcctctttgagctgtggtgggctccacccagttcgagcttcctggctgctttgtttacctaagcaagcctgggcaatggcaggcgtccctcccccagcctcactgccgccttgcagtttgatctcagactgctgtgccagcaatcagcgagactccataggcataggaccctccgagccagttgcgggatgtaatctcctggtgcgtcatttcctgagcccgttggaaaagtgcaatattcgggtgggagtgacccgattttccaggtgccgtctgtcactcctttccttgaccaggaaagggaactccctgatcccttgcgcttcccgagtgaggcaatgcctcgccctgcttcggctggtgcacggtgtgctgcacccactgtcctgcgcccagtgtctggcactccctagtgagatgaacctggtacctcaggtggaaatgcagaaatcacccgtcttctgtgtcactcacgctgggagctgtagaccagagctgttcctattcggccatcttggctcctcccccccttgtaaggtcttgaacagaggagggataaaagataaaattcaactcctgtgttacaaacattgttctagtgctgtttaggaaatcgtctgaaagaggagaagagtgataccaggaaggccaattaggaggttaatgaaaaaacattagcccaaaatgatggtgccttagaccagggtggcagtcgtgaagacggcaaaaagtaattttgtaaatatttatataaagtagaactgccatgatttactgacaagctaatgtggcgtgtaaaagggttttggcctgggtaactgacagaatggatttgcctttagtcaagatgaagtagagtgagtttggttggggaaggatggaaaataccaggcattcagtttgaaatgcacaatttgtcattcaagtagaagtgaaaagtaggcagttggacatacaaatttaaacttctgaaaaacttaacaaactagagatataaatttaacataatcaaaaataggtagtattcaaagccaagagtgagcatacatagaagaaagaaacccgggaactcattcctggaactccaacacatcaaagtaaaggagatgaggaagaactagcaaagagagtaagaacagctggagacgcagaaagaaaagcaagagaatacagtgctctaaagtccaagaaagctcttcatgaagagtatgtgggccccatatacctgattagccacgtaaaatggggactcagcatgacccagcggtttcagtcacacggagggcagaggcaaaaatgggcagccggtataggcgcacgacggacagcacacttcatgatgacactttggaagcagcttcactgaattttcagggaaagacaaacatgccctctttcatctcttctagtcacaagtgtaccagagcttaacgacaacaacaacaaaacaggaaaaacaaatgaagtacaagaagtggatggaaagaggtaaaaactcttctctgctgtttatatgatgtctgtatacaaaatccaagataatctacagataaacacttagaaactgataagagattttaaaatgtattagattcaagattagcatgcttgaatcaaactattctaccatactaaataaaaacatactttttccattaacttcctataagcagttacgtgctggttacttgaagacaggaaaggaaagagagacacctgatatgcggtgattgctgatttccaaggtgcaacttctcctcccacagcccatttgaagctaccagtgtaatgtcactgaagcagaactgccaatagttgcacgtaactggcccttgcaaactggtgtcagcgccagcacaccactgcaaatcaactaaaatgttgaataaagaaaacatcacattcatagatgttatcaaaactacaagatctattttaaaaaactaaccaaatggcaataacatgcagagatcttttttaaaaaatgttttaaattaagaacggaatacttcagaaaaagtaatactaatggcagggaagaattgatattgttgatgccaattcaccccaaataattataatttcagcacagttataatcaaatctcaacagagaatcttcaaattcatttgaaagaggaagtggtcaaaaataattgagacagtttttaagaacaacaaggtagggtgacttgcactactaaaaaataaatccctaaatacttgatattgatgttaggatgaacaaataaaacaatgtaaccgaatagagagcccataaacagttatttttagaaacctgatatataccagatgtggtattactaattagtgtggaaagagtggcctctcaatcgatggttctgaggctattgaatttccatatgggaaaataaacaaaattcaaatttctctaagacaagaaaaaaataatccaccaagaacaaactgaacaaattgcaaaatataacaaagggtaattatctcaagtttatagggagctcttaaaatgaataaatatattaaaccaaatagaggggataaatccacgaaaaacaatagttaaagttagaaaaataaagagcctattttctttttttttttttaattccttcttaaaaaaaaacgggatacatgtatagaacgtgcaggtttgttacataggttgcgtgtgccatggtggtttgctgcacctgctgacccatcctctaagctctctcccctcacccccaccctccagcaggccctggtgtgtgtggttcccctctctgtgtccatgggttcttgttgttcaactcccacttaggagtgagaacatgcggtgttcggttttctgttcctgtgttagtttgctgaggatgatgaagagcctattttcatttaaaaaatcaaaatgtattttaaagtactcaaatccattaagaatgtttaaaactaattttaaattaacaaaatacttttatttccctatcaaaatgaaaaaaaagtaaaagactgatttttaaaaaatccataatctgtgttcaagaacttatttctccatacagtaagggcaactttacagccaaacatattttccaaacttggcagaagtataaattggcaaaacctttttggattgagatatacttacggaaatttaagtataccttctttgaccaaaaaattcaaaaagttatcctaaagaaagcagaaaaagtataaagggtcatatgtagcccatttaagtgaagaaatggaaaattctttgataaccaaaaaaactagttcatagaagttccatatagtatgatgtatttttcataaaacaaaaaaagtatgtatttgaatgacttaaaattttctagaagtaacatgcagaagtgagtatttctccatgctgaagttacggagttctgttttcttgtttatattttgctgtgctttcttaattttgcagtattactcatatattaggataaatcattttcaaaaaaataagcaaagcagacatgcacttggggtttttacaaaatattttattgacaagtattatttttaaagtattatttttaatgtattatctcccaccctaggagaaaattttgtgccctctcctaggatgggcttaactataagaatgttgcaaataaggaaaaagtgagtagtatgtaccaccactctctctattttgccaactagctcagctccccctggagtccttcatgcgcatgttcccattggatgaacctcccacgtgatgtttcttggtctctaaaccaatgagtctccgtgagtcaatatccctacatcacacacacacacacacacacacacacacacactctctctctctctctctctctctctctctcgtatgatgactcctgaatcatactgtgtattaaagttgcttattcacatgtcatcttcctggtagactataaagccccagagaataagacaaatgcactattctttttatatctcccagaaacaattaacaaaataccctgcatatactgatgtaaattacttatttgttgactaaatattgcaaggacttcataggtttaacttggactaattcatggttacggttttttgttttgttttgtttttgttttttagatggagttttgctctgtcgcccaggctggagtgcaatggtgccatcatggctcactgcaacctctgcctcccaggttcgagcaattctcctgcctcagcctcccgagtagctgggattaaagtcatgcgccaccacgctcagctaacgttgtatttttagtagagacggggtttctccatgttagtcaggctggtctcaaactcccggactcaggtgatccacccacctcggcccccccaaagtgctgggattacaggcgtgagccaccacacccggccagttactttttataaattgaaaataagtaatttttaaagaaataaaagtcctttttatttaaaaaataaataattacacaaattatgaatgacattgggttcaactacaattatatttgagaagattacatttaattgatggataaatgatctgtagtgatttatgattggaaacataagggacaccttttttcctatttttatctgtgccatagaagccaaaaatgttctttcataaaacatactttgaggcctctgttagagacagacagtaagaatgcatgaaacagggtctactctaatacatcaatttcttagttatcatgaagtattttatttgctggatacaaagagattgatgtataaactaaattgataataacagctaccatttactaaaaacctgccacgctgagtgtcttgtgttcattctctccaaccccataaaaaaccttgttgtatagtgagggaaggagcagatattctaactaagctctattaactgcaaaaccaaaactctcaaccaatagatccacttttttacagatatactaaaagcagtttagtagcaatttcagcaatgtagtcaaagtttctggtgctatgtcttcaaattttcatggatcataacacatctgcagtacagttgtgatcaaattattatatccactgcatttaccaaaaataaaatgatacacaaaaagtcctcaggaaaactattctcttgaaatatctttatagtgatgcctgggggaaaatctcgtttagctaaagtgctgtttgtaattagcatggcattcccttttacgtctaaaaatagaattacaatcatcattttaacactatatatacattggtctagcttttatattttatttggatgaaaatagaatagcaaaaaagtccatgttttctcaaaaatacttacgatgaaagctggatgtattaacacatatctagcttataaaactagctacccaatagagtataatgaaatattgttcctttatttagcaattgctttttatctaggggcacagatcactgacgaaactataagaaaacaatgcaatgcaactgctatttcagtcttgcatgtgcccgggtgtaattaacaaatgtatcatatgtaaacaattacatacttcatagtacaattccaaactcaaatctcacattttagagacctacctttagaaaagctctttcttttctttagatttgatcatactgcttcagaaacactgtaagtttcacagggaaaggattattttgcaaagttgcagatccaatacattgctttggttttacatacaaagtaagtatgggaaaatttatcatgcaaataaagaggttcaacaaaatatcatacaggtatcttctattcatttttgtccagcactttgtaatttgagtgacacgtcctggccaggcaatgcactatgtggcaagagtgtagattcaggaactagatcatctggatatcacgcagcttcatgacaagcacattggtctccaggactgcattgtgggtgaccctaataaacttactcagatatttgaatagcttctctattgtttgatagagaaaaaagaatggctggacataacaccaatttttgattaccaaagctacaattctttgttttgggttttcttgagacagggtctcactctgtcgccagctagaatgcagtggcacaatcccagctcagtgcagcctcaacctccagggctcaagtgatcctcccacctcagcctcctgagtaactgggactacagatgtacaccaccacgcccaggtaatttttaaatttttttgtagagataagagtctcactatgttgctcaggctggtctcacacacctgggttcaagcagtctccctccttggcccctcaaagtgctgggactacagatgtgaaccgtcgtgcctggcccaaagaattacaaatcttaacctttatccgaagtctaatgaatttgatataatgctttattgaggataaaagaattaatttcagctaattatcttcaaaaaggatttttatttaaaaattctgtccttgcatacattttctggacataagctaggacatcatttcggtctgattttggttacaaagtgcacaggcgccgcttcaatctgctaatcaagctttaatgtgtcgtgttatgttgctctcaaattgtgaacatacggtagtttataaataaacgtctcaaggacttagtttctgaagattacggagctggaagagctactcagagaaactgaaataccttctaaaatgtattttcaagtttcttcttaaatcttcaaattggattattagagagaaagcatgaatagatctgcttcttccctttggggattgagagaggtttcgtgtctttaagaagcctcttgaaatatacagatttatttaatatatgtcagaatctagagagaattatgatatcaaatgctttttcggaaatgcagtgtatataatagagaatatgatattgttttctgaacttctttcctacatcctacgatattcaaagagtaattcagcatggcctccagccctgcagctcatccctgtgcgttttggattcaaggactccagcctgcagtggccaacaggaaatacagtaattgtgatcttgctctttgaagatgggatgataattatcacagaactcataggaaatgtcttttttgctctatagactgtgagattatgcatatcttttagtagtttattccctgaatccttaaaaattaatttaagtttaccatcagattttagattttcctctattcctacctttggttatgacatcagttttgtgaacaaagtaaactcaatacattataaaatgctgaagtaacatatcattttccctaaggcttacctcttttatttgatttaaggaaaatttcttattttctgtgggggcttagtgcattgatgtggagaaattcatccttcttggtttttgtattcttttttttttttttttttgagacggagtttcactcttgttgcccaggctggagtgcagtggcgtggtctcggctcactgcaacctgcgcctcctggattcaagcgattctcttgccccaggtttttgtattcttaaaggccaaaacatatgtctggatggcctcatgctcatctgtgcacaccatggcagaacccagtacattgttttgtttacatccccccaaaatagtgaaaaaaatgaagcaccaccatttttatcttgagcacctcttcactgttcttaacgcatttgggcggtagcagaaaagatcattccccaaaaccttgctaagcacgttgtccaggtggggagagtattactgctcagttttccagttacaggtgctctagtatctttcttctaatttaggcatcactggcaacaatcaacttgtcagatttatatagtagatgaaaatggaaaagagaaaaatcgagtccaaggctgcttttattctgaagtttaaatggcagctattatcatttcatgtagcccattatgtaggaatgatgtctaggactgtacagtttcatcatgagtttccatgagcttcttttcatttttacatcttttattttaatcagtgggaaatcacgatattagagattccactggtgccctgaaagacatgctttgtgaaatttttgtttcaaaacattatttcaaaataaataatgtatacttaattcagcaccaggacccatgattagatgcaaatgagatgacatgaaatatctttactgtgctatttacattcatatatgtttacttgtactttaaatcctataacaaaattatgtaagtaaacccaaagtataatgtttagagaaaattagttcttcacacttcaatatttatgaagtacaactttttgtaaacatggaaaattgaaaaatgtcattgaaattaacctgtagaataatatggattaaataaatgctattgctgttcctctgactttaaaaaatcaaaagcactttctagattaatctgagtaatcacaggccgcttaaagtagccaggaatataaagtggaacaaccaacctcagttccctgcatccgaaggtttagacctattttagttcatctcacgctgctacaacgaaattccacagactaggtaatttataatgagcagaaatttatttggctcaaagttttggagtctgggaagtccacaattgagaaaatgcatctgcatctggtgagggacttctgttgtgtcataacatggcagaaagcatcacgtggggagagagaggaggaggccaaactcatccttttacaaggaactaactcctgaaacagtggcatcaatccattcatgagagggaagccctcatgacctaaccatctgtgatggtcccacttttccacactgctggattgaggattatgtttctaacccgtgaaccttgggtgacgcatttaaaccctagcaacaccctagctgattcacagatatttatgctaaagcctagttgatacagtttgatatttgttccctcaaaatcccacgttgaaatgtgatccccaatgttggaagtgcagtctagtgggaggtatttggttcatgggagtggattcctcagaatggcttgatgccctccctatagtaatgagtttacacaagagctggttgctcaaaacatcctgacatctctcttgcttcctccctcaccgtgtgacacatctgctcctccttcgccttccaccataagcggaagcttccggaagcctcaccagaagctgagcagatgctggagccatgcttgtacagcctgcagaactgtgagccaaataaacttcttttctttaaaaattacccagcctcaggtattactgtgtaggaatgcaaatggactaacacactagttattttcagatatttgtaagtattatcatccttcatccaaatacaatttttaacatattttaaatgaaaataatttaagaaatatggagctggatagtaaaagagaaaaaaatgttatcttaatataattttagtgggtttatacatcaaacattaagtgggagaggtctttaagcacttgcacaaggctgaaaaacaaggaaaaggaagttacctcgtagatgtctaacagagatgcagaactgatctgcagcagcagttaggacaaaggcaatcatatatggaaaagcagataatatgatttttaaagctttgagacatttccaatttggagtaacagaatgttagccagcacgtgccaatacagccttgccagttacttattgctgacattcattctgattagcccattattagcctgagctgagctgattagtgtagtttacatctccctgggttaactacagcccatcctcattatttgcagattccagatttatgaatttgcctgctcactaaaatggatttgtaaccctcaaatcaatactcccaagtgctttcctggtcatttatggacatgcacagagaggggaaattatttatttatttatttatttcaataggttttgggggaacaggtggtgtttggttacacgcataagttctttagtgatgatttctgagattttggtgtacccatcacgcgagcagtgtacactgtacccaacgtgtaatattttatccctcactcctctcccaccctttccccaagtccccaaagtccattgtatcattcttatgtttttgcatcctcatagtttagctgccacttatgaatgagaacatacaatgtttggttttccattcctgagttattcacttagaataatggtctccaattccatccaggtttattttgttcgtttttatggctgaatagtattccatggtatatatttataccacaatttcttttttattattattattattatactttaagttttagggtacatgtgcacaatatgctggttagttacataggtatacatgtgccatgctggtgtgctgcacccattagctcgtcatttagcattaggtatatctcctaatgctatccctcccccttcccccaaccccacaacagtccccagagtgtgatgttccccttcctgtgtccatgtgttctcattgttcaattcccatctatgagtgagaacatgcgttgtttggttttttgtccttgagatagtttactgagaatgatgatttcccatttcacccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatgtataccacaatttctttatccacttgttaattgatgggcatttgggctggttccatatttttgtgattgtgaattgtgcttctataaacatgcatgtgcaagtatcttttttcctgtgatgacttactttcctctaggtagatagccagtagtgggattgctggatcaaatggtatttctacttttagaactcagttctttaaggaatctccacactgttttccatagtggttctgctagtttacattcccaccagcagtgtaagtgttccattttcaccacatccataccaacatctatttttttttaattttttgattgtggccattcttgcaggagtgattttgatttgtattgtggttttgatttgtatttccctgataattagtgatgttgaacattttttcatatgtttgttggccatttgtgtatcttcttttgagaattgtctattcatgtccttagcccactttttgatgggattattgcatcgttaggcaacttcattattgtgcaaacatcatagagcgtactacgcaaacctagatggtatagcataatacacacctgggctatctagtaaaatctattgcttctaggccacaaacctgtacagcatgtgactgtactgaacactataggcaattgtaacatagtggtatttgtgtatctaagcatatgtaaacatagaaaaggtacagtaaaaatatggtataaaagataaaaaatggtacacctgcatagggcacttaccgtgaatgaaggttgcaagattgaaagttgctcttggtgagttgatgaccagtgaatgaatgtgaaggcgtaagatgttactgtgcactactgtagactttataagcactgtacacttagactatactaaatttattttttaaatttcttacctcaaaaatagattaaccttagtttactgtatcttttttacttataaacttcttaattgttttaagctttgactcttctgtaaaaacacttagcttaaaacagaaacatattgttcggctgtacaaaaatattttctatctttgtatccttattctataggcttttgtctgtgttcaacctttttttctacttttaaaattaaaaaaaaagctaagacatatgcacacacattagcctaggcctacaggaggtcaggatcatcaacatcactgtcttccacctccacatcatgtctcactggaaggtcttcaggggaagtaacatgcatgaagctgtcatctcctatggtaacaatgccttctgctgcatacctcctgaaggacctgcctgaggctgttttacagttcactctttttaacataagtagaaagagtacattctgaaatgacaataaaaatttagcatagtaaaatacataaaccagtaatttagtcatttgtacatgtttgtacgtgctagtctttaaatgactgggagcacagtaggtttctttacaccacatcaccacaaacacaggactaatgcattgtgctaagacactatgatggctacgatgtcactaggcaacagaaatttttctgcaccattataatattacggaaacaccatcatatatgtggtccgttgatgatcaaaacacattaccggcacatgactgtatgtataagtacaaattggataaaatatatgtaactttattctatctaaaattatttcccagagtaatgctaagtatttttaaaataatgttctttcacattaaaagtcaatgaatttttgtggtttttgttttttgctaataataattttttttaatttctaacttttaagttcagaggtacatgtgcaggatgggcaggtttgttacataggtaaacatgtgtcatggtggtttgttgtacagattatttcctcacccaggtattaagcctagtacccattagttattttccctgatcatctccctcctcccactgtccgccctcccatgggccccagtgtgtgttggttcctcctatgtatccatgtgttctaatcattcagctcccacttacaagtgagaacatgcagtgtttggttttctgttcctgtattaacttgctaaggataatggcctctagttccatccatgtccctgcaaaggacatgatccccttcttttttatggctgcataatattccatggtatatatgtacattttctttattcagtatatcattgatgggcatttaggttgattccatgtctttgctgttgtgaatagtgctgcattgaacatacacatgcatatgtctttacaatagaatggtttatattcctttgggtatgtacccagtaatgggattgcttggtcaaatagtatttttctctctaggtctttgaggaattgccacactgtcttcaacaacggttgaactaatttacactcccaccaacaatgtaaaagcattcctttttctccacaaccttgccaacatctgttgttttttgactttttaataaacgccattctgactgtcaagagatggtatctcattgtggttttgatgtgcatttctctaatgatcagtgaatgttgagctttttttcatgtgtctgtttgccacatgtatgtcttcttttgagaattgtctcttcatgtcctttgcctacttattaatggagtttttttccttataaatttgtttaagttccttatagatgctagatattagacctttgtcagatgcatagattgtgaaaaatttctcccattttgtaggttgtctgtttactctgttgatagtttcttttgctgtgcagaagctctttagtttaattagattccatttgtcaatttttgcttttgttgtaattgcttttggtgtcttcaacataaaatcttttcctgtgcctatgtccggtatagtattgcctagattttcttctagggtttttattgtcttgagttttacatttaagtctttaatgcatcttgagttgacttttgtatatggtacccagtttcaattttctgcatatagctagccagttctcccagcaccatttattaaatagggaatcctttccccattgcttgtttttgtcaggtttgtcaaagaccagatggttacaggtgtgcagtcttatatctgggcactctatgctgttccattggtctgtgtgtctgtttttgcaccagtgccatgccatttgggttactgtagcactgtaatatagtcaggtagcatgatgcctccagctttattctttttgcttaggattgccttggttattcaggctcttctttggttctatatgaattttaaaatacatttttcttttttttattatactttaagttttagggtacacgtgcacaatgtgcaggtttgttatatatgtatacatgttccatgttggtgtgctgcacccattaactcatcatttagcattaggtatatctcctaatgctatccctcccctctccccgcaccccacaacaagccccgttgtgtgatgttccccttcctgtgtccatgtgttctcattgttcaattcccacctgtgagtgagaacatgcggtgtctggttttttgtccttgcgatagtttgctgacaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggcatctcattgtggttttgatgtgcatctctctgatggccagtgatgatgagcattttttcatgtgtcttttggctgcataaatgtcttcttttaagaagtgtctgttcatatcctttgcccactttttgatgtggttgtttttttcttgtaaatttgtttgagttcattgtagattctggatattagccctttgtcagatgagaagattgcaaaaattttctcccattctgtaggttgcctgttcactctgatggtagtttcttttgctgtgcagaagctctttgacaaacctgacaaaaacaagaaatggggaaacgattccctatttaataaatggtgctgggaaaactggctagccatatggagaaagctgaaactggatcccttccttacaccttatacaaaaattaattcaagatggattgaagacttaaatgttagacctaaaaccataaaaaccctagaagaaaacctaggcattaccattcaggacacaggcatgggcaaagacttcatgtctaaaacaccaaaagcaatggcaacaaaagccaaaattgacaaatgggagctaattaaattaaaatacatttttctaactgtgtgaagaatgtcaaaggtagtttaatagaaacagcattggaattagaaatagaaatctataaattgctttgggcagtttggctgtttacacgatattgattttttcctatccaagcatgaaatgtttttccgtttgtttgtgtcctctctgatttcctttaacaggggtttatagttctccttgaaaaggttcttcacttcccttgttagctgtattcctaggtatttgattctctttgtagcaattgtaaatggaagttcattcttgatttggctctctgcatgccttctattggtgtataggaatgccagtgatttttgcatattgattttgtatcctgagactttgctgaagtggcttatcagtttaagaagctttgggactgagacgatggggttttctggatacagaatcatgtcatctgcaaacaaagataatttgacttcctcccttcctatctgaatgccctttatttctttctcgtgcctgatcgttctggccagaacttccaatactatgttgaataggaggggtgagagagggcatccttgtcttctgctggttttcaagggggatgctttcagcttttgcccatccagtatgatattggctgtgggtttgtcatttatggctcttattattttgaggtatgttccttcaatatctagtttattgagagtttttaacatgaagaaatattgaattgtatcaaaggctttttctgcatctactgagataatcatgtggtttatgtctttagttctgtttatgtgatgaatgacatttattgatttgcatatattgagccaaccttgcatcccagggatgaagcctacctgattgtgatagacaagctttttgctgtgctgctggattgtttgccaatattttgttgagaatttttgcgtcgatgttcatcaggttattggtctaaaattttctttttttgttgtatctctgccaggttttggtgtcaggatgatgctggcctcagaatgagttagggaagagtccctccttttcaataataatttttattagtttaactatttccacttcctcttttcctccccccggtaacttgtaggcatacacattatcttgacttctcaagacacgatctcagaattctccattcatcagtctgcaagaactctttgcaacaaaaccatttaaagtctaccagagcctaggtctctggagcattttgtttgcagttgtttataaccaacttccagaaacactgaatgtcaattgcagtatactttgaaaagaagttatttgtcactatagatttcttaccaaatttagtttgttgcaacggaaaggccttttattttaggtgaaaaatgacttctgatttgatttagtcaaagttttaatttaggttttctagtttcattttctttttcctcttctctaatcttataaaaaatatcccactactgcaaaatgtgcctgcttgctataaacaaaagcaggctctaatagagtaaaaagttacaaacatactaagatgtctaattaagatacttattgtaaaattggaaaaaatatttataaaaatagagaattttaaaaaatcgaattgccaagcatttctaagtactcacaattctacattgcacaggagatgtttcactcctgtaactaaattttaaacaaaagaaatgagcttttaatcttgggcacctagaaatagttattaatatagaaaaatacaaagttctataacacggaaccaatatgatatatatggttattggtcttatgttagatcttaagataaaactttttcaaatagatattcaaacagtacaatacactgaaaatttttctaaaaccttttctatttacataacattttatttctgaaagcaaacacacatgccaaaaaggctgagtttaccaaggttacaaaatgaatcagtgaaaggacgaggaatataatttaaatctcagattttgtggtagtatctaatagactcctcatttccattaatttcctaaaatatagtattgttttatagagaaagcaaaagcatttcacattttttctgcagtaagctgttagagtgtaatatctttggagatcaagactccgcattgctcttctaggtgtctacatgaaaaataactgattccactaaagagtagagaggaaaaacaaaactggaatcaagcaaatatgaggacttacaaacatacaaaaggtttatttttaaattcactaagaacactaaacgtgtttctgattctcaattttaaattttgtttttgttccaacaattccaactggattttacacaattggatttaatccaaaactctatttccatttaatagcacggaaactggacctgatatttgtttaaaaggaggccttggcctccttacattaccctttcattgattcacagccttgcactcagaaagtgtataccacaaaatggagatatcccagcaagaacagagagagagagaggagaagggttggggagctggtgtgtcctgtccccttgctgctgacagtgactgtcatacagacaggactcaactctctgtccatttgtctcttttcaccaacctttgccttcaaggccattaaactccctctattcacttagcttcaccaccaccaactcaatgcctatgtcagctatctattgctgtgccacacattaccacgccttggtggcttcagacagcacacattcattatcacaggtttctatggttggaaatctggacgccacttagctgcctcctcggcttcagcgtctcttacaaggctgccatcacagtgtcgacggtgctgctgtctcatctgagggtcacctccaagctcacgggggttttggcaggcttcagttcctcgcagactatcagactgaggacctcaggcccttgctggctgctgcccagcagctgccattggttcttgctatgtgggcttcttgctatggcagcattactctatctgagccagcatgggagagcggcaatagggagagtggcacagtaaggcaagagttaaaatcttatgtgacataatcacggaagtgacatgctaccacctttgctgtactcttatggttagaaacaagtcacaggtgccacccacagctatgggaaggggatcagaccagggtgtgaataccaggaggcagagatcactggggacatcttcgagcctatctaccaggaggcttgagctcaggcccaggtctattggccctagaccagcaatccattatttcagccttaaatcagattcttagaacttcattttggtgataaactagtttactgtttttgttttttcgttgttgttttttgtttttttttggcttgatacctggttccaagagcaccgtgtcccagccttgctcttgatagcggaatacttgcctgcaaatgtttccccctattttctgaatgtatcactccttcatttctcctcgccgtatgttctgttttgggccccggcatgaatacactgcctctcatgcacatttgcagactgcccactgctgaatctcccgcgaggtttttcgacaactggttagttgaatactctgaaaatacgctagtatctttggctaatagtgcttgtagcacatctctatggaccccacagactaacagctgcttttcaatcctgatacgtatttctttgcacagatttcctaaataaacaagtcttattcacatattgtgacacttgccattctcctgacttttaggtcggcctggtttcctgaccttaacttgttctttctgacccaccctgacagtgcctgagctggggctctgatacatgtttaattgccagcaaaaccctttatctcttataaatccctctccagttcgagttccatatctaatcacaacattcacaaggatttaagaaaatacaactacttattgaagcacaaatctataatgatggagaaaataggctttcaaagaaagtatgtttttatactaaatatttaaaactgtcaaactacttattctggaggtttctattttttaacagacaggtcaagtagaagaaaaggcgattctctaaagaacattattccaaaaagtacatctctgtttaaatcatgtttttgctctttcctgtgcctcagataacctcctgtgtcatccatttttacatgtcaaaagcccatctacacttgaggtccatttcactggatacttcctccttggagttttctctgatcaccctaacccaacacagtgagtcccctctctaaacccccaaacaatactcatactggtcgtggggtatgtcatacatactactttttatattctcctttcatgatcctgatgggttgtaaatgtctgtataccaaaaacaatgtatttcttttttttttttttaatactttaagttctagggtacaggtgcacaacgtgcaggtttgttacatatgtatacatgtgccatgttggtttgctacacccattaacttgtcatttgcaataggtatttctcttaatgccatccatccctccccactcccgccaccccacaacaggccccaatgtgcacacgtatgtttattgcggcactattcacaatagcaaagacttggaatcaacccaaatgtcacatatacaccatggaatactgtgcagccataaaaaagatgagttcatgtcctttgtagggacatggacgaagctggaaaccatcattctaagcagactatcgcaaggacagaaaaccaaacaccacatgttctcataggtgggaactgaacaatgaaaacacttggacacagggcagggaacaaaacaacgtatttcttacttttctactcattgagatagattcagtgtcaacatatttttagtaaatttatatgagtaacatagtaatactcaaagttttattatgaatagacaatacccgctttaggagacagagttgaaatctttaatatcatatgtaatttcattaaagatctaaatgtctaatatcttatgtgatgttagtatttattaaatgatattagaaataaactgcaaaactcattttttgaaatatttaccacagttaaatatatcatagataataaatacattttcattttctttgccttgtatcttcctatttcttagtaatctaccagtttaatttgggcatatctgtacccctaaaataaaaaatgttgcatttttgtatgtggatacattaattcaaagtatagtagcacttgaaataccttgaaggtcttaaagcatcacaaagctgaacgttagaatcagtatctgatctgaataaagatgacctctctatggctgcagcatcagctgcaaaagcctcaccaagggggtctgcaggaaatgcggagggcagtggggtgccccagctggatcctacttgccaggaggcactatctctctggtagctgggagtactgatagaacagggctctcagctgtcagtcctctttgaggattgcttcagctaaagaatactgcttcacccaagcccacagctactgactaaccaacatacttactctgtggggcaactctgaaaggtcattctggctccagagctctctgtagattaggctaagtccttcactggatcttcatttcagctcaactgtgggccagtcttgctttcatctcctccctcctacaggtgttaatcctaaaattatttcctaataaacaccctgcttaaaaattttcatctcagagtctgttccccaaagaacttaacttgcagcaaacactagggttgctcttgggagaagagaggatttccacaaagagataaaatgattattctttgctgtttctacctagagaaggttttttccaacctttggtactattgatgttatgagctggataattatttgctgttaagggctaccctgtgcattgtaggatattgagtagcatccctggcctctaccactagatgctagtagcacacgtgcatatgtgtgcacacaagcgtgcacgcacacacacacaacccatgtgacaaaaatgtctgcagatattgccaaatgtcccccgaagggcaaaatcctccattgagaatgtctgccctaggactaattctggcgataggagaacaacaagcaatgaaagaagctggtgcctcccagatgccaggggtagcagttgacaggacacaggtaagcggaggcccggcacaggcagtcaggaacaccttcctccgccacccagcccttgactgcacccccacacctcaccactgggttagctgtgaagagctgagactccataatttggaactagaggtcagtcgatcattttggggggtgcactgtcatgtatggaacgtctttcatcctgctcaatgcatattcactatttataggcttctgaaaggtgtcacattctcttcagtctttgatgaaaagcaggattctccaattccacagagaagctgtaggttttagttgtttttttttcctcttcaaattcttgaagtgccagtgttcttaaaggctttcctgatctgctttaaatgtcctgggtatgcatttaagtaagagagacacttccttcacatataatctcttcaattgcaggggaagctagggtattgggattctagagaatttccttcactcttgaattcctcgatttacatagaaaaagctggagttgggggaaatgagatgtacaattgaggcagaaggaagtatcagagctatacaggaaccagcataaacagaatatctgtaagttgggacatattcaaaatactatcactaagtgctccaattaccactactactattattgtcacatttccatccacatactttttttccttcttttttctgttttttaatggaagtatgattgatatatgaaaaagcagtatatatttaatgtatacatcctgatgagtttggagataagtacatatctgaaatcatcaacagaagcactgccgtaacgttacccgtcactggcccaggttcctgcctccctctctttttgtgtatataataagaacatctaacataaagtctaccctcttcataaatgtttacatatataatatggttttgttaactatatgctctatgctgtgccgatctccacacttattcatcctgcgtcagtcaccctagggacgcttagattgacatctatctgctgcccactccccccagccatggtacccaccattcgactctctgtttctatgaatttgactattttagactcgtgacataaatgggatcatgtactatttgtcattttgtgcctagcttatttcctttagtgtcctccaagttcatctatgttacaacaaatggcaggatctctctttttttttttttttttttttgagacagactttcactcttgttgcccaggctggagtgcaatggtgcgatcttggctcaccgcaatctccacctcctggttcaagcgattctcctgcctcagcctcctgagtagctgggatttttttttacaggtctgcaccaccacgcccggctaatttttgtatttttagtagagatgtgatttctccatgttggtcaggctggtctcaaactcccgacctcaggtgatccacccgcctcggcctcccaaagtgctgggattacaggcatgagccaccacacccagccttttttttctttttaatttcaacttttattttagactcagggggtaaatgttcaggtttgttacactggtatattgcctgatgctgaggtctgcggtattaatgatccatgagcatagtaactgctagtttttcagccctcactccccttcctccctttctttttctggagtccccagtgtctgtgtttgtcatctttatgttcacaagtgtccagtgtttagcgcctacttataagagagaacatgtggtatttggttttctgttcctgcatttgttcacttaggataatggcacccagatgcatccatgttgctgcaaaagacatgatttcattcttttttatggctgtgtagtgctctatggtgtgtaggcaccacattttctttgtccaatccactgtgcatgggcacctacgttgattccatgtctttgctattgtgaatagtgctgcaaagaacatacctggcatgtgtctttatagtagaatgatgtattttcctttcgctgtacacccagtaatgggattgctaggttgaatggtagccatgttttatgttatttgagaaacatccaaactgctttccacagtggctgaactaatttacattcccaccaagagcatataaatgttcccttttctccacagcctcaccagcatctgctattttttgactttttagtaatagccattctgactggtgtgagatggtgtctcattgtggttttggtttgtatttctctgacgataagtaatgttgagcagtttttcatgtttgttggccatttgtatgtcttcttttgggaagtgtctgttcatgttctttgcccactttttaatggggttgttttttgcttgttcacttgtttaagttccttatggattctggatattagatctttattggatacagtttgtgaatattttcccccattttgtagggtgtatgttagctctgttgataatttcttttgctgtgcagaagctctttagttaggtcccacttaccaatttttgtttttgttgtagttgtttttgggatcttagccataaattccttgccaaggctggtgtccaaaatggtgtttcctaggttttcttctagattttttaaaagcttgaggtcttacatttaaattcttgctccatcttgagttaatttttgcatacgctgaaaagtaggagtccgggtttaatcttctgcatttggttagccagttatcccagcaccatttactgaataggaagtcctttccccattgcttattttagtcaactttgtcaatggtcagatggttgtcgttgtgcagctttatttctgggccctctatactattacaattggtctatgtatctgttttttgtatcagtactatcctgttttgattactgtagccttatagtatagtttgaaatcagataatgtgatgcctccagctttactctttttgcttagggttattttggctattttggctattttttggttccatatgagttttagaatagtttttttctaattctgtgaaggatggcattggtagtttgataggagtagtgctgaatctgtagactgctttaggcagtaggccattttaatgatattaattctgccaatccatgagcatggaatgtttttgcatttgtttgtgtcatctatgatttctttagtagtgttttgtagttctccttgtagaaatctttcacttccttagttagaggtattcccaagtttttttttgtagctattgtaaatgggactgcattcttgatttgactctcagcttgaatcttattggtgtatacaaatactcctgttttttatatatactacattttctttatttcatcttttcatggacatttagattgtttctatgtctttgctactgtaaataatgctacaatcaacgtgagagtgcagatatatcttcaagatcctgatttcaattttgggaggtttatactcaaaagtgggatggctggatcatatggtagttctatattaaattttttaggaacctccatattgttttcaatagttaatgtactaatttacatttccaccagtgtacaagagtgcccctttctccgtatccccaccaacacttgttgttttttgtttttttgtgaatagccatcctgacagatatgagatgatgtcttgtggctttgatttgcatttccatccacatattttttaagaataaatagaaaaaggaggtgcttttatatatgtgtgtgtcacaaaaggattatatgcaaaccaactgcaaaatacaaatgctgcatttcagcactgtctttaacctttgtcttaatttttgaatttaagattttacaatagctataatttattttctgttaaccaacttaatttttacatgcttactaatgcacctttgtatcatagtgtttagcattagcaacactgtgggagaagaggcagagaaaatatccatgaaatacaggtaatctttaattttatgagacagtttcttcccatgaagaatttataactttctcagctctaatcaaattccctgccacaggagcacgttctaattagagccatctgctcctagcaggatattcatcccaggccaatgtatggtgaaacattctaatccattttaagcatctaatttgtttctgcactaaaattctaggcaaagagcagctggatgtcattggagacttttcctgcacaatgagggcaaggaaagttaaaacagaaattcactgagtggaaaccacggatctgtaattaggaaatattaatctaggacatgcagtgataaaaatcaatgaccagctgctcatatcatgcttattgaagtagttgaccctagaaaaactactaccatctcatttgttcataggcttttcgccactcctttttttggatcaagagacatggatttattcatccatccactcatttattcattcacactaccaccattgacaatttttgagcaaggcactgtgctttgtgctaaagacaatgggtacagatgtaagtcactgatctggttttcaaaagttgatagacagtgtaaaataatttcaagagtgttttaaaaggtcattttaaaacttatcttgggggcagaaaggaaataatgtatgcaatagtctatttttgttcctaccatacatatagcaattaagtgtaagtattatattattccctccagaacttgtatattattacataattacaagaattgagatatctcagatactttgtaaggatggtacatctttgacatagttgtttatattcaaatgccaccatgaaactcagagtagatacaggagctataaaaggagaaaaaaaaagactattcaaatttccattaattggaaatgattttaaaggaaaatgtaaaataccaattcaggtgtcaatgaatgactcctaggggacaagttaacacacacagacacacacacacacacacacacacacacaatcagaagctacctcctgttagagtctatttttctattggattttaaaatttctactttaagtcacaattaaatgcaaatacttaacagaactgttcttgagctcttcattgctaatagcctctgctgattttgccctcttcttctctacccctttgcttcagctccagtttcccaaatttctgtgacggggtgaaagagtacactgagagagagaaaaacaccacacctccggaagacaaagggatgcaatcacctgatccagaggagattatttctttaaaaaaaaaaaaaaagtcacacacacacacacacacacacacacacacatgcgaagctttgcatactgaagtgaacaccaacagtttcagatttcaaaacgaatggacccatgtgcacacgggcacatagacatacacacacacacacacacacacacacacacacgacatgatttatttcagcagagcatcagaatgcaataataaccaaaaaggtatcatatattttacaattattctctattaaatgtggaaccaagattaagctctagtgacaaaaaaaaaaaaaaaaaaaatcctagacccaggaccagagcagctggtggctacaggtaatgtcactgaagtggttcagctatgacagaggctcaggtgtagactgctgagcagaaacatccttgtgggtacagacgcgcttccactggtccgcaaagaaacacaatccaccaatttcaaatgcaagttcatcctggaagcaaacctcagaactacactgatgacataatcgatgcccacattaagaatggaggcccagcactaaaggaaagctgtctctaaacaagtcatcacagaagcatatctgtgattattgccagtaatactttgtcagccttaattcatcctttctatcacaagagcctatagtaagagacttagcctgtaaacagttgactctgagctcatttcaaatcagcaacacataggcgagagttataaataatgcatgcagtgatgctgcagaatggtttgggtgcatgcagaatgaatgaccgtgttgcatacgtcttaaaaagtgtcgatttacttttgttcacaactggatagtggctaagcatagacatttgtataaatattcgccaagacgagtcttccaacaaaccatactaattaggatgctgtaaaataatcgcaaaccaaaagactgctgaatagtttacaggtagggcatatgtgggccctaggacaatgtatattctatttggcatattcatcatggatttagaactaatagagatcctatctttttagtgcctgaagtggctaaaaaatatcttcttaagtggccaagcgtggtggctcatgcctgtaatcccagctctgtgagaggccaaggtgggaggatcccttgaggccaggagttggagagcagtctaggcaacatagcaagaccccgtctctacaaaaaaaataagaaaattatccaggcatgatggtacgtgcctgtaatcacagctattcaggaaactgatgcaggaggatcacttgagcccagaagttcaatgcttcagtgagctatgatcacatattttatacataaaatatgacatattttatattcgaggatatatataatatatatcttttagttatcttgatgggaatgggtggtttatacttcccaaaacccaataagatatttaaacatgttttttcatgctgaagttatttatttactgccatgttcaggaaagtatgatggaaaagaaataaagagaagaggagaaataactatctttaaactgcctcccaagattcacagataagctatacaaaaactctaagctctggcctatcaacgttgttggtgtttggggatcctttttcaccagctctactttaagcttctattaagcttgccaaattgatttcagatttgttatacgcctggcacagcaggcactatttaaaatgtatgttcctggcagctgaggtggggcagtgccgtccagtctcaacgtcagctggccttgtttggcaccttcatcacatgtacatgctcctattaatctactgtctaacaaagatctggaaaagcctagtatcttcccatattaaagccagatcattaaagaaataccacttgagattgtatagaagggcaagaaaataattcttaatttctaaaccaaattggtttcatagaaattctgcctttggctgatcacttcactttagtagagcaaagcaataaatttttatcccttttcactgaaacccttggttatctctgcaccagggaagaaaataatgtcttctattaagattaatattgttatgggaatattactatgattattattataaattcacctccatctttgcttgtttgcttgtttggtttgcttctttcttctttgaatacaccatacctgaggaagcagaatcacatggctgatgatatcaaactggcttaatgtaattatggactagttgtgaataaaaatatgtactgaccgcttattatgtgaatagcactgtgttaggtaaataatgtttttcttttacccaatggggaaatgatctcttcccacaaagagtccagtgattaggttgggtaagaaagccatagccatgaaagaattaatgaacagaagtgtgctctagtgcagagtcatttctactgaaagcatcagagaggcttcgcagaaagattggaacttgaggtgagtcaggaagtttcataaaagatggataagtaggccaggcgcagtgcctcacgcctggaatcccagcactttgggaggccacggcgggcggatcacgaggtcaggagatcgagaccatcccggctaacacagtgaaaccccgtctctactaaaaatacaaaaaaaattatccgggcgtggtggcgggcgcctgtggtcccagctactcgggaggctgaggcaggagaatggcgggaacccgggaggcggagcctgcagtgagccgagatcgcgccactgcactccagcctgggcgacagagccagactccgtctcaaaacaaaacaaaaagaaagatggataagtagacagaggaaggaggagctggcttggcaccaagtctaaggtatgaaagaacatggtttgtaatataggaaagcacaatctatttataatacacacatacttaaatatttaaaattgattcaacaggttaaagaccaggctttgccaagagtagataccagtattcctatggtttggtctttcaacgagtagactctttgaagtgtttcaatatattgtatttcccaccgatggagtttaaaaagaaagggaaagaaaaacagtgcaaatcgattcctgctgacaacaacacctacacgttgctctttgggagtaactgttttccaagttgtaattaggatcttttgtccattctacgtaaggtatggtaacatcacaaatacaaaactgcagtggattttatattttaaaatataaataatgaattagatgtcatgatgaccagctgcttagctgattttaccactcatggctatttgaccgggttcagaagggcaagagccattaacaagggtaattacctcctgcgcctctctcctcttccgcagaccctggcctgtaataggtgccattccaggcactccctcagtgctgaatgaatacataaatgaatgaattgtagatatggcttcagataataaggaaattcaaactactgcatgctctttgcccaaaatgactgtgtggaaagaaaataaatactgcttctattaagatattccttcattataggaggtcatatgagaaggttgggagaagaagggagaacgatagtaataacaagggatttctcttcatctttaatgctaaggatcaaagacctttctcctatttgaggctgactgcatttgcattgtacacctttagatgatgaataactagacatgttgtgtgtatttatgattgtgggttaaattttaggctgtgaattctgatgtcaaaatttagaagcactgacctctacttattcatgtattggtaacaaaaagaactttccaaagttttccaaatttggtatcaccttagaagagctaacctcattttacacttgaataacccagtatttcattaagcacttaatatgtatggagttcagttagctattgttcagtaatccaatagatgttattgatttttgggacttatcttgggggagataattcagagacaggacaggacaagaaaatattaaagagttaattaactagacagtgtaacacacatatagtaagtaccatataagtcaattaaatagcattgtaggacttaaggaaagtaagaatcactactagtgaaatattcttggatgacttcatggagaaaaaacaattgtgccttcgaagaagggtgtgatttagaatgttgaagaagaaattcgagtgtgtttcaggaattcattcatagcatgaagagaattaccaacagccacgacatgtttagagcaaaatgcagactccctttgataagggcggctgttcttatgggagtggggaagttgatagggaaattacagtttcattcagcatgtagagagccttaaatgacagcctaggcttttaagacaattccgtaagctgtgattggtgatatgataaaaggagtcattttaagaccatttatctaatgcgtatactagtgtgcaagatacgtttaaggtgggatgtactagaggcaggaaaccagctgagaagctaagagccaagcacaggaccctaacagccacagctccagtgacagcaacaggactggaaaagaaagaatggaagagtgacagttcaaaaagagagatcaggctgtgtgtggtggctcatgtctgtaatcccagcactttgggaggccaaggctagctgttcacaaagtcaggagatcgagaccatcttggccaacatggtgaaaccccatctctattaatatacaaaaaattagcctgacgtggtggcatgtgcctgtaatcccagctacttgggaggctgacgcaggggaatcacttgaacccaggaggcggaggttagagtgagctgagatcgcaccagtgtactccagcctggtgacagagcaagactccgtttaaaaaaagaaaaaaaagaaaaaggatggaagagtgacagtttaaaagagagatcaggccatgcaccgtggctcatgcctataatcccaacactttgggaggctgagtcaggtggaccgcttgaacccagaatgtggaggttgcagtgagccaagatcacgccactcaaaaaaaaaaaaaaaaaaaaaaaaggaaaagaaaatcagtggcactttttgaccaattggacttgaagagaggttctaaaggtgatttaaaccaaaacaactacaaaaatgagcccagaaataaaggcaattcatgtacaactcagagagttggaccagctgaccactaaggcctcaaacaaacaaagttccactccttgtgtctgcacaaattatgttcctctctctcccctttgcctgtccagttatggctgtgtattaagatctatttcaaatctctccactccttgaaaaactgcatgactactccctgttatgtgcaagatcctccttgggctcccgatacattcacttctcttccacataatcacgtgtgtcattgcatcctctttttgctacagtaattcttttccctatcaatccctccaccctcactagtttttattctatcttacaaaagctagcactgaattaaatatgaactggtataaaacacaaacttacagctagaggtaaaaaatcttaataaatgcatctcttttactagaccactagaaatgttaatacccaaaggatacagggaagcctattggcactgaatattcaaaaatttaaataagctcttttgaaacttgaagctgaaagtctttctagatattcaagtattatctatggaaataaatcaagaagccctggaaaagtgtggcaaacaccttccattgctaaaggaacaattaaaaagcctattctaagaggcacaacggagctaaccattttctatgtcgtgcaagcggaaataattcagtgatgtctttgtgcctctcagaaaatcacacaaagtcactttctgctttttagtttgctctttggccctatgtaaaatgttgccacagaaattgctttgtgctcagcaaaaactcaacctgttaaattccagtgactggaatcattgaaggtcaagaggtaaaactcacctgctgtgccacattttcacaattcagagggttcttctgcactcagcatttatgtgatggtttctttctgtggaacatgtattccattttcaaaaggtctagtcttgattaacttgtacttggttaacaaacatgtattgagagtcatttgggttctgagcacagtattaagggatttggaaaagagaaggtaaaaaaaattgtatacagagaagtcaacttaaaatcctgaaatagcaacaaatataccaaccttgacattgtagtttataaatccattttagaaaaacaaacatattgcagagagaaaaaaacagaaatgatgatctataaaacaacatatattttaaattaagcaaactagaacatcatgaaaatttcatcgtatgggctttaatatgagaacaggaatgcaatcagtactgaaaaaaggtcaaaagaaaaatctaaaggttcatttaaagcatagagcagaaaattctctgaaaatgttttctctatatctaaaatgataaatttcatcaaatttgaaatttgggtaataaaaatggactattcaatgataacattttcaaaatactttataatgccttatttatattagatctttgttcttaagtaacatcatgacaaatacgtttttctaaaatatacagttataataaattaatggcaaaaagtatgaatattgtcatagttatgtcataacttattgtcataagttaagtgggctcagactgctgggccttttatatgtcaatttccagcatttttgtccactcatagtatttaatggttaatttgccattcactgtagcctactaagaactaaatagtgcaaaggaaaatcatgttgttaaatcaattacatgacaacttttaagaaaaattcacagtcaataggctcttttctgagagcctgtgggaggttctgtgagtcctctatagtttctatctgtccattactatgtgtccaatacctgccacatcactggcaaccaatttaattgataacacaatgataaataaataaagcatatatatttgtgacttttttcctatattatttcaaatcttccatttatttttaagtctatgtctgcttggaataggttaaactgccaaaagtttgaatgccaaagtaactgaggtgctagctatcatgtgcatttttgatatttcatactaaaattaaacaaattttctttgtaaatttcttttcattgaaaaaaaatatcatgggatgacaaagatgttttgttccagtatcaaattctctttctttgtctttatttgaactatagatgtgtatagcaaattcaactttgaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaattcaactttgaataaaaaaagttatgttcttttttgcctcgctaagtattagtagcaaatattcaggtatagctaatattttcatgcatcaaacataaattagaaagaaatagtgttcagtataatcaacaggttcacaggaaaaaaagaaagaaaagaatggtgtttgattttacccatgtctggaaagacaacatcgtgttctggaaggctctctgatgggaagtcagaggtgcagaagtgcaggagagctgggaaacaggttgcaatatactgtgagatcctttagtttgtaaaacacaaaggctcagattgcagggaagatattaagcttcacatatttcatttgaagtgtttttacatttacctcctgtggtaaaatggccatagcatttcagggcaaacgtccttgatgtgaatgggagtcccagtgttgagtgctaccccacttctggcacacactgtatttgtttccgaagaatcaagcttgtgaggagagacaggacatacaacctagcatgtcccggggaagccgactttgtcatatatacacacacatatatatatatgaataatataaatgaatactcacctcccctaatgtgttcttttataagctaaaatttttatacaaagcaaaatctcatgggatgtcacttgaaagaaaaacatgttttatgaaatcaagatctctagaaaaaaagtaagtagacatcattaaaattgttctagtgatttttttcaaaatgatcagatatgccatttgataacatccccagaagttaagctattagaggatttcctgaaaaatgattaaatgttacccacttcaccaaggatataaatatcttacactttcaatcaatctttcacgcttttattaacaactcataattataattctttcagtgcttatgactctcccaacttgataaataaataaattgaatgtatctgccctgccctgaggtcaaaaatactggtgtgcacctcctcccttgtaagattcttgaacccacttaatgactctgcactctacatgtgggtcttaggagggactcatcatcatcactgaatggaccgtcaatgtggcaaaagctcaagatacttttggaagtcaatatttcgatactaaaaccaatatttaaaattgaaatataatttacataccataaaatttacccattgaaagtgtacaatatagtgctttttagtatatccataaggcattacaaacatcaccactatcgagttccagcacagttccatcaacccagaaagaaacaccctaggccgggcatggtggctctcgcctgtaatcccaacactttgggaggccgaggcaggcgtatcacttgagctcaggagtgcgagaccagcctggccaacatgatgaaaacccatctctactagaaatacaaaaattagctgggagtggtggcaggtgcctgtagtcccagctacttgggaggctgagtcaggagaatcgcttgaacctgggaggcagaggttgcagtgaaccgagattgcaccactccagcctgggtgacagagcaagatcctgtcaaaaaagaaagaaaaggaaggaaggaaagaaggaaggaagggagagaaagaaagggaaaggaaaggaagaaaagaaggaagggagggagggagggaaagaaagggaaaggaaaggaagaaaagcaggaaggaaggaagcaaaaagaaacataatccccattagcagtcactctgcactgcctctcccccagccctggcaatggctaatcaactttgtggctctgtggatttgcctattctgtacaccaacaccagttttgaaagagaatttttttcattagttcacttggatattttgtgctgctctattttctttcttaaaaaaaaaaaacatctagaggataaggaaaataaaactttgcagatttttgtcaaatactattcagtagaaggattattttcttaaggaaataaaaaatgaaacttagattcctgggcttagtctcttggaattcattatttcaattattttgttcatgctaccaaagaaaccttcttttttttttttttttttttttgaaacagagtctcgctctgtcacccaggctggagtgcagtgacacaatatcggcttattgcgacctccgcctcccagattcaagtgattctcctgcctcagcctcccgagtagctaagattacaggcgcacgcccccatgcccagctaatttttgtatttttcatagaaatgaggtttcactatgttggccaggctggtcttgaactcctgacctcagggaatctgcccacctcggcctcccagagtgctgggattacaggcatgagccactgtgcccggtctcaaataaaccttcttgaaaaaattatattctcataggaagcgcattagactaattatattttgtagataaataacactaaacatagcttacatataaaaatttctttgcttaagaattaaatgaaataattctctggaaaacattcaattactagatattttagcataattgctcaattttgtgaaagaatcaaatgcacatttgtccttaataatatgaagaatggaaattcagttttctaaactatctatattttaattaaaagaaattcactctctttgtaataagataataatgcggtattaaaataaaagcattctcaatagtaaaatgtttttgctgactagctttgttaataaaactatgttttgaacaatcactggattaatcctagtgacaatgtgtagagttttcaaaacaggaacattaacagactcttgtcccatagtcttggtacaatggtaggagcctggcttaaggtagatgggctagagagaaagagagggaaataggagattgtaatgaaatagagccaaccaaacgtgttaaattttacacaggagatgaggaaaacttcaagatggtgccataatttcttgcttgagtgactgcccgtggaagacagaatttatcaacatagaagatggggaggaattaagatcttttcttactgaaaagatcctaagtttggagcgttttgccctgtagctatttaactctcaaccaggtatttggatatacaagtttattgttcagagtaatagaagctagagaaaaatattggaaatggtcagtataaaacttgtggatagcagaaattctggttgaaatcacccaaagtgtttaaagaaaatagaaggtggttaaggacaaaactgatagaaagagaaggaaggaagggaaggacaaatggagacctgaaagtttctgaacaaaacagggaaatcggagaaaacccaaaagactgatgtggcaaaaaccaaagaactcaagttttaaaacagagcactggttaacagaaatgaatgaagcagaaatattcaatataagcaggactgagaggtgaatattggaattgcctatctggatatcactagaagaaaggtttcagcagcaagggagatgctaagccagcagttagacgcttgaggccaatgctgctaagctgaaaatgtgcacttagaactgattagtatgtagacagtatttggagccattaaatcagtgtgagatgacttggggatgagtgtgggtaaagagaagagaacctagaactaagaaagagacagagggggaaccagcaaactgagaaggagaggccagggagacgagagggacaccaacagcttgtggggccctgataggctttatgaacttgagtcaaagaggaccgggtggtcggctgtgtgaagtgctgccaccagatgagatgggcagttccactggaattcatactgcggaggttattggccatgctagggaaatgcctaacaggagccactcaaaaacatgtcaaagtcaacaaaggtaaagaaagcctaaggaatggttccagattaaaggctactaacaggacatgataattacatgtgacatatgaccctggactgcattgagatcactggcaaaatgtgaatgtagactacatattggatagtaatgtggtatcaatgtttagttttctgattttgataactttactgcagttatgagagagaatactctttttcttcggaaatatacaataatgtgcttcagaataaggggcatggcgtctccaactcactctcaaattactcaggaagaacgaagtgtgtgtgtgtgtgtgtgtgtgtgtgtgtgtgcatgtatggatagataatagaataataaagtaactagagcaaaacataaacaaatgatgagtctgaatataagctatagaatagtttcttgtactattattttaacttttatgtataatggaatgtagattttagaaattacagaaagaaaatgaggagagggagaaaaagggggagagcaattggaaaaagcaagtctaccaactctcgtaaaataaacacctgcgctctagagaaaagtaaggaaatggggtgggaaatggtggggaaggtaacatcaaaacaagattagggtttttttctccttacctgaccaaaattacagcacagtggcaagctgatgtcaatatgccagtggaaagagaaaaaaggttgaatagcagagaaataggggaaattgctggcatgatttcctttcatgaggagaagagggtgagtctgcatacaaatggagaaactggctctcctaggagtagggaacattcatctttggtaataagcagaaaaacaaagcatgagaatgcaattactggaaggtagaaaaaagagataaagagtgcctaccccactttttgccctgggggacctggaaagcacctcccttgaatggattcgtgggaagtagtgtttccaagggacaaccaggtttcagtctgagcaataaggtgaaaggaaagttcagagaatatcctaacaaatggcagagcttgcatttaagaagctatatacggagacacatggaaaatccagccatggtagtggatatacagatagcacaaggttgagggcctgcgtcatgatggatggcctgtgtttgaaatgctttttccttggtgtcataaagaaacagcacttgaacataaatttaattttctcagcaaggccatttcatactttctgcagaaagggtacagcagcagcagttttgccacaacggcacaccgaacaaaccggagacagggtcatttataacctgatgcatccaccctactgctgtgtccggtttccattggctggaatggggcctcacattctgtatttgtcctgattggctagtaacttagaaaatttttaaaaagacaaaggcagaggagaacaaaggaaggaggaagtaacttgtggcatgctgagaaaggtaaaaacaccttcaaataaggaagaggaacaggctatggcctaatgcttgcttggaccagtataagcatgccagggcaaatatttaggctaaactgtgggagctaagaacataaagtacattgatttctttattatggatagcagatatttaagaatgttagcacaggtctatgaataaattttgcttctaagagaagttactatgtattcctaattagatggggaggaaagtctttgaagaggaacctctactttactttttacacctgggacctggtttctgggtgaatgagggaatgaaggatgtgagcataatgagctcagtgctgattatttcctgaagagaagtgggcaaccagttcaagacagatgttatgggtccactggctgaccatgctttcctgcagaagccagtattacggcaaccaaggggagaaagagagtctccataacaattaatcttcctggaagctgaagcaccaaatggtttgagtgtttcttcttcttaaagggaaggtagtgtggcccatatgaaaagggtggcccattgtgaagcaggaggctagaaatgggctcttctttgtgggatgaactgtatagcagctggtgtgggagctggagcataagtggcttagaggcagcttcttctctccagcagcgggcaggttggctctgggatcacctcagtcaatggcgtcaccatccaattcaaagataaggatggaagcagttataagtatgtttgtacaggcttaattttctctggaaagtaggaatgggtcacctgaggataaaagggggaagtgaataaagtcgggggacagaacatctgaggtctcaagggggattcatgagattttggatcaagccactgagggcacatcaaaggttcatggacgaagacatggaagaattatagaacagggcccagggcccacccagtgttggagtttacaaatcagtcactacatagtggtcctggatctgttgaatagtagactcttcaaaacacactgataaatccctccctcttaaaagctgaagaattggccctctctgaaaaccacagcactgtctcgcattatagggattaacccaaactgctctgtgaagctcgtctaatctatgagcaatgagaaaggcagaagaatttgtaataataaagaaatgaaaactgagctgtagccttcgattacactgtgacatttggtgagttcactgtctttctttagtgtaagaatcaaggaacaaatttgttttattgtttggcgtattatataactcatttgacagtactgcttaagttatacaacaacccctaattcatatttttaagctcgtttgaaaaaaaaattaaaatgctctcaccttggagcattactttacattttgcagcacacatttgtagtttgggttctttttaggcagaaatctgaactaacaagtacttctattttttctccagattctttacatttctacagctttatttcacccttttctaacataataaaccatttctcagcaaacatttagataaaatgtcacagacttggagaaagaaaatctaaattgcagatcaaaaacaaggccatattaagcatgagaagtggtagtgggaatacaatttacaatgttttgatttaataccataaagaatgtccacagaatagactgcaggttggaattcgtggagatgtcttctttagtttatgtaatgaatgccattcttattcagtaagatttaatcaggctacttgagactgagatataagtgtagagaagatattggctttccttctccatatacttggaatgtaaaattacttaggaaattttacactgacactacatggtgaggagatatatatatcttaaatatatatatatatatttctttttaagattaagtatgagacctcaaaaatatttggactgcaaatactattttaaagtaataaaatattatttctgtgaaatagaaactaaaattgaaaagtgcttgaagtataaattctattaaattttagtgaaaaaatatcaagaaaatactcatcatataattaaaaatttattgtgtacaaatgggttctgctatttctaatatattttattatcaatgtattatattctgttatataactttatgatattcatttaatttcaagtactagattttgatatactactttaccatattttggtttctatttccttttatagacaggttcactccctaccactaaaaatgtttaaatacttaatttaatctgagacaacatctgcaacaaaaaaacagaactgctgttgtaagtttctgatattatatgtaaaatggcataacaatataattttatttgaaggtagactgtgttaacttaaatatatatattatcaatcctagagtaaccactttaaatataaagcagcatagctaatgagctaaaagaagacataaaacagaacactagaagataaccaattgaaactaaagcagaaaataaagagggttgaatgaagagaagatggcacacacagaaaacaaatagcaggatagtagatttatacgcagccataccaataatcacagcagatgtaaatcatctaatatttcaattaatagtcagaaattgacttccaatttctagtccggcataaaaggaacctgaaaatcatcactgtctcctaaccataagtaaaaagctgaaaaacttgataatcaacaagtcttctacatctatcagagaagtgagctcataggacaaactgcagccctcaaaactgaagagacactagtggatacagacaggtcccactcaccagagcagaaacctcatgggaacgaatactaggctaggaaaacctgaactgtaatctatacattgcacgaaacctcatgggaacgaatactaggctaggaaaacctgaactgtaatctatacattgcacgaaacctcatgggaatgaatactaggctaggaaaacctgaactgtaatctatacattgcgtgaaacctcatgggaatgaatactaggctacgaaaacctgaactgtaatctatacattgtgggaaacctcatgggaacgaatactaggctacaaaaacctgaactgtaatctatacattgcgcgaaacctcatgggagcgaatactaggctaggaaaacctgaactgtaatctgtacattgctacaggcttgatttggacaattctgagagttaaaatcggggtggggcagttttagggggacctccacacttttgagttttacctctagcagcaccaccagagtctcatagtgaaggttagagaagaagtctgtcttagtctgtctggactactataacaaaatactttgaactgggtgatttataaacaataaaaattgttcactcggaggctgggaagtgcaagaacgaagtgtgggcagatccagtgtctgatgaggacttgctctctgctttgaaaatggagccttctttctccatctccacatggtggaagggcaaaaggactccctcaagctgtataaggatattaatcctatttatgaagacaagccctcatgaccttattacctcctagaggccccaactccgtaccattagtattagatttcaacacacaaattttgggggttcagagagattcaacaatagcaaaactcctcatgcttttgacagagagagtagaaaaataactactttgaaatatgcccggagcattctgctctttttaacaaggcgtgccctcaaaaggacgtattttaccacagctagccccatctggcctttgacatggagtgaaaaaaaatacacaacttcagactgctctggccatcctgtcccacctaagtggaaagaagagagagactccaaagcatttgcgaaggtcacagcacaggaacacaagctcattaaaagactggaacctaatcatcggactacaggacactttccctcccactccaccttcccgccacatcactaatgacctatctaccacagttccttctacctgcatgttcagctttcaacaaaagttacaatgcacattaaaaagtagaaaacaggccaggcgtggtggctcatgcctgtaatcccagcactttgggaggctgaggtgggcgtatcacaaggtcaggagttcgagaccagcctggccaacacggtgaaaccccatctctactaaaaatacaaaaaaaaattagctaggtgtggtggtgtgcacctgtaatcccagctactcaggaggctgaggcaggagaatcgcttgaacctgggaggcggaagttgcagtgagccaagattgtgccactgcactccagcctggggacatagcgagactccatctcaaaaaaaaaaaaaaaaaaaaaaagtagaaaacacaatctgaagagacaaaacaagcaccagaacaaggctcagatatggcagggatgttggaaagttagagattgtcagactggataaaaaacaaatcttaaatccatgctgtgtgcaataaactaattttaaatagaatgatacatataggttaaaaataaaaagaaagaaatatcatgcaaacactaatcaaaaaaggtggagtggctatagtagcatcagagtaaacttaaagacaagaaatactactagaggtaaagaggaatattccataataaagaagtcaattcatcaagaaactataacaatcctaaatgtgcatgcatctaataacaaaacttcaaaatcataaaacaaaaacaattgaaaggaaaaatagacaaaaatccatatttacattggatagtttaacactgttctctccacaactggtagaactagtgaactatattcactaagaatatagaaaatgtgaacattatcaatcaacacatcttgactgatatttgtacaaaataacacctaacaacagcatactgcacactattcacatgtgctgtggaatattcacaaagacagatcatttgctgatccatgaaataagtcttgagaaatttaaaagaattgaaatcacttcagaataggttctctcaccacaaatgaattaaactagaaatcaataatgaaaaaaatatctgggaagccccaaactatttggaaattaagcaatatggttacaaataaccaagcaccaaagaagaaattaccagagaagtcagaaaatactttaaccaatgtagcagtgaaaacttaacatactgaaatatatggatgtcagttaagcaatgcaatgctgagagggaagcttgatctccatatggttatattaagcaccgtgaaaacaaataactataatatactaaaacagtatttattgtttttgtttgtttgtttgtttttttggcgacagagtctcattctgtcgcccaggccggaatgcacatggcagcaatctcggctcactgcaacctccgcctcccaagttcaagcaattctcctgcctcagcctcccgagtagctgggattacaagcacccaccaccatacctggctaatttttgtatttttagtagagatggggttttgccatgttggccagtctggtctcaaactcctgacctcagatgattcacccacctcggcctccaaagtgctgggattccaggcatgaaccacagcacccagcctaaaacagtattttttgttaatgagggaccatttaaaccttctctacttggaaggggcagggaatgaaggacaggtatgaggctcaacacagtaaaacctagggacgggggcgacatttaggctggacattgaaaaatgaagccagatgaggaatttctgtgaggcaggagcatgaggaaaggcagggcatgctgtccctgagatgctgtggatagaagaggtgtcattccagtgtggccggagggtaagatttctggaggaaagtgagcggggccgagaacatcaagctgagcgcgcaacagattgtgaagggcctcgtatgctctacatgtacatagaagtaaatgtgtgagtcagaattccttctgtggacatactcaacaatattctctttttgcttctctaaaggaaaaataactgactaatgcaacagtcagctcaatatgaatcataactattgaaaaagagaaagaagtttgatgaataccaaaattaacagaggcttttccatatgtatcctttgggtagcttcccagaaggaagaatcaacacagctacttggcaggtctacctaagctagccccagtcacacttcttcacaaactccagctggcatgcaaagtgtgagaaaacagcccagctaaaacacagtactgaaaagtcttgaatttacaaacaaaagattgctattaaataaagaaaatagaaaacaaaacacagcactgtgttgtgactgtgaggaatacttttgcaccagaagatataaaatgtgattaaacaggcgttgattgatttgggttcggtgggtcaaggcctctccctggatttgaacatttcagagtccagactactgactggctgtaatatcaaaacactgtataaaatgcttcgatttgtaacagaatttaacactgtcagaagtcataaggcagttttgtttttcctaattcacaattaagttataatagcagcaagctgactttactcagtcacagagccagaggatttgatgaggtgtacaattttccctcaaggataaaaatgtaattatgaaaaagtcctgaactgaaaaacagtattgtcagctatttccaagaaagataaaagatcatttaaaggtaaagagattacagataaaaggaatacaaaattaagttgaaaccaccagggtagagagaacaagttctaaacaagaaccaaacattaaaacattttattataacaagaaaatatggctttcgtttttctaaaaggacaataagtttttaaattcatgtctgattagttcatccagatgtttaaagataaatagatatcaattgatgattatactttccatgttgctgataaatagatatcaattgatgattatactttccatgttgctgataaatagatatcaattgatgattatactttccatgttgctgataaatagatatcaattgatgatgatacttttcatgttgctgataaatagatatcagttgatgatactttccatgttgctgataaatagatatcaattgatgatgatactttccatgttgctgataaatagatatcaattgatgatgatactttccatgttgctgataaatagatatcaattgatgatactttccatgttgctgataaatagatatcaattgatgatgatactttccatgttgctgataaatagatatcaattgatgatgatactttccatgttgctgataaatagatatcaattgatgatgatactttccatgttgctgataaatagatatcaattgatgattatacttttcatgttgctgaagaagcgaaccctgaatgtgcctcagtctgtcaaactgacagtcagagggaggccctagtcagagggaggccctattctacactcagtaaccaggggactccttttcataagttcatgtaaactgcaaggggtacttaatagttttgttttcatttcttaccccaaaacctatctcccactaagccctctctataaaatgaaaaaattaatatctgtttcaacaggattgctgggaagatcaaggaagagaaaatgaataatatatgtaagagaactttgcacactacatagccctacacagaacgcattattaccaagtattttacatttataaagtgcttttcaaagcactctccacttaaaattcaattcacaatcaccagctaaggctgaagattcagacacaaaatccccgcctgcatgaagctcatgttctggactctagaggaatcaggtaatcctgtctatacctgtggaaaatgctgtgaaaacataggatgttgctacaaagaagttggcgtccaaattagagaaatgagtgcatcgctcctgttctcaggactctggatttctgcaaccttcttaaaatctttaatgaatatttgaaattatctcattgcacctgttatcaatcctctgataggaaccaagagagatatatgttatttctgagaaaagtgaggcttcgaaaagataaacaacctcattgtgattcaatgacttgacgttcagctcacagtctagaaaatggctaagtggcaaaactggtcttcagactcaagaaatgttcagtattatacaatagagtgcatttggtgtttgcagtcatggaaatggaatgtggggtcttattggaaataagctactccataccagacacgtattttaaaagaagaaatcatgattcttagaaaatcgggtgtcatgactatacatttaaaattctgtcaaaatcagtaaaacaaagtaaacagccaatgtgtatgcaaatgctttacatgaatagactatctagtctcaaatccaatagctgttccgggaggaaaaaatctcaatttgtttgccgtgagaatgtcaaactgatatttctgtaacagttagcatggccacagtgctccacagagagtgcaaagatcctgcatactgggtggccaatatgggtttaaaaaagaaggaatttttattgccctctccccaacaatactgtgcgtgcacacacacacagacacacacacacacacacacacacacacaatgcagcagcaacaacaggtgcagggaaaggttccagcaaccctttctctgctcctcagggaggatattctggagccttttcaaaggctcttccagagctgattgagaaggttttcttcgtcaataaacagaggtcaaggaatgcctctttgccatggagtctggtcaaagttaagtgtcccacttgtggacaggaacggaggtaggagctggatgcctgtcgaaaacaaactaaattccagaaaataatcttagtgttcaacaagaaagaaatgttttcaataaatttgtgttcatttacaagactggaaaactgtttaaagtagactacaagattggtgataattacttaaataagcatttatggaaaattgttgttttatatatttttataaattttatatttatataatatgaaaattcatattatatatttaaatattgtcatatatttaaaattcatatatattttaaaattaaatattaaaaattaaattatatatttacatttaaatattaaacctattaaaattggcattgaatttcttatatatgtcatgtatattatatatttaaaattatatattatatattatatatttataaaaatatattttttattttttataaattttatatttttataatttgaaaattcatgttatatatttacatattaaatatattaaaattggcattgaatttattatatatgtcaggaaaacaatgacaaagaaatacagcaacgttagcaatcagttttttttctcatacttttttttaacttttattgtgggtttgggggtgcgtgtgcagtttcgtgataaaggtaaactggtatcacgggggtttgttgtacacattatttagtcatccaggtactaagcctgatacccaaatagttattttttctgctcctctccctcctcccaacctccaccctcaaggaggccccagtgtgtgtgttgttcccttctttgtgtccatgagttctcatcatttagttcccacttataagtgaaaacacgcagcatttggttttctgttcctgcattagtttgctaagtaatggcttccagctccatccatgttcctgcaaaaatggacatgatctcattctttttaatgactgcaagcaatcagttttaagcatggtccagtattaaccacaatgaatatttcttccatattaataataaaaaatgtaaaataaaaaataatttccctattaaagataaaaaattggaaataggtattaaccttcctctcaagtctcaataaaaataacaataaaaataacaaaaagtgttctgttttgttttattttaagttgtaaacccataagagcagaaatatcaacagaggaaacaataacaacaaaataatgggggtggaaagcaaacaaatgagcaatcatggactaagagaccagttcaagcataaatcaaggctggcgatgggaaagcagagaagcaacatggtttacagcagaaaacccacagagcctcagaaacgagcagcaacagaaaaacaggctgttaaggaagcaggtcaacagctcccctaccgtggtcctcatttccacaccatcctgcatgccatggaacgatccgtcctccaccctggagaagcttagagcttattctgtggaatgggagaaacggagagtccctgtaatggagataccaagaaggagaggcgggtcatatactggaaacaagagaagcaaagttgatgtaaggaatattgagactacaactggatctttccttctgtggctcctaaaatgcaggtggcagagttgtaccttccatgcaggaaataagagggtttttctagggaattgagaggatctccagatagctgggcctatttaaatgagagtgaagcccaagctgatgtgaagcttgcacctagaatttccaatcaatcttctagggcctcactcttaaatataagcagacagctaaggatcaccatcctttgataggattaagaatgagcaaacactggaaacatactgaaatacagccggctgtctaaaacagaagatatagaatataatgaaagaccaaaatggatatgtgtagagattacacagggaagatagtggaattgacaactctggcagcaacgctgctaaggacaggatgaatatgaaaattgcttgaagttcaacaataaggagaaaggaggttgccaaaaagaccaggagaggcaagaacaaggcctgtcataaggttatagtgcatgaatggcctatcggttaagaattaattcagcagaacataattgaaaatacattttaaaggagcatgaataatatttgtattttctctataacaaggcaggttagttcaaatgcatcatgacgtcttcaggaacccacacttgtctctctttattgaacccacactcttctctttctattgatcccacactcctctctctattgaacccacactcttctctctgtctctcttttgttttgtttttgttttttgagacagagtcttgctctgtcatccaggctggagtgtagtggtgcaatcttggctcactgcaacctctgtctcccaggttcaagtgattctcctgcctcagcctcttcagtagctgggattacagccgcccgccaccacacccggctaagttttgtatttttaatagataccgtgtttaatttcaccatgttgaccaggctggtcttgaactcctgacctcaggtgatccgcctgccttggcctcccaaaatgctgagattacaggcatgagccactgtgaccagcctcttttctctctattaaacccacaatcttctctctctgttgaacccacactcttctgactctattaaacccacattcttctctctcaactgactcacactcttctctctctattgaacctacgctcttctgtctctattgaacccacactctcctctctctatggaacccacacttctctctctattgaatccatgctcttctctctctcctgaacccacacttttctctctctattgaacccacactcttctctctctattgcatcaggcttctcctgcgccttttcgtctcatgacttttcacctcattgttgaacagtgtctgctttaccttcaagttctgggtaggaagaagagcaaagagaaaaaggcaagaagtagttgccagtgtccatatctcttttaagagctctcctagaagccctacctagtgacttctgattatataatagcttcaaggagtatgtgggatttggtggttgttttaagctggactcattaccactgtgaaaaaaaatcacattgtatatttaagaaagaaagagcaaatgtatattacatagagaaccagcagcatacatcgctgattatttttgaaaattaaaatgttttagtaatgggcttgaaattcaattccagtcatcaataaattaaatgtatacaatgaagaagacttgtaatttaacaatcattctgggttgcttagtgggtgtgcaataatgacctttgaagaggggaacaggccgggcacggtggctcatgcctgtaatcccagaactttcggaggccaaggcaggcagaccatttgagatcaggagttcaataccagcttggctaacatggtgaaactccatgtctactaaaaatacaaaaaattagccgggcatggtagtgcacgactgtagttccagctaatcctgctgaggcaggataattgcttgaacccaggaggtggaggttgccgtgagctgcaattgcatcactgtgctccaggctgggcaacagagtgagtgagactccatctcaaatttttttttttaaaaaagaagggaacaaacaaaggaaatttctgggagagagaaaaatggaaaatgagtagctgtctcccttctttcaggtaactgctttcaggtcctccagaatttttattaatataaaacaacatttgcattatcctatcaatattgtagtttgtgacagtaagtcaaaatatacttttcactgggcaaaggacatgaacagacacttttcaaaagaagacatttatgtgtccaacaaacgtgaaaaaaagctcaacctcactggtcattagagaaatgcaaatcaaaactacaatgagataccatctcatgcgagtcaaagtgatgattattaaaaagtcacgaagtaacagatgctggcaaggctgtggagaaataggaacacttttacactgttggtgggagtgagtgtaaatttgttcaaccattgtggaagacagtgtggtgattcctcaaagacctggaaccagaaataccatttgacccagcaattccattacgggctgtatacccaaagtaatataaatcattctattataaagatacacgcatgcttatgttcattgcagcactattcacaatagcatatatatggaatcaacccaagtgcccatcagtgatagactggataaagaaaatgtggtacatatacaccatggaattctatgcaggcataaaaaggaacgagattatgtactttgcaggaagaacatgggtgaaactggaagccattatcctcagcaaactaacacaggaacagaaaaccaaagactgcattttcacacttataagtgggagctgaacaatgagaacatatggacacagggagtggagcaacacacactggggcctgttgggggcacaaggggagggagagcattaggataaatagcgaatgaatccggggcttaatacataggtgttgagttgataggtgcagcaaaccaccatggcacacgtttacctgtgtaacaaacctgcacatcctgcacatatatcccggaatttaaaataaaataaaataaaaatttaggtatatatatatatatatatatgtatacacacacacacacactttttacttggtgtatctaggaaatatacaaaagcttaacaataaactacccaagaatcaataaaaactaaaagttaaatataaaaaatgcctttccattgcataaaaatgtaatttcaccagcccaatgtatgtatcacttgaaaaaatgtcgttgcaaaatgcaatctcttttgtgctttatactgttgattttaaaatttaaagtcaggagagcaaagcacatataaattggttccttcttttatttctcaagaagtcactctttctttttcattaccatctgctctgactgctattacaatttttatcccaaaaggtgatgctgacagtgtaaaggtggtataattaacaaaattcttctctcatgacatttctcacagaaaactggaagcaagaaaatataattgcaccagcagatatgtttcaaaaccaagtaaagagcttatgaaaaataagaactcttaaatgcaagcactacagattgcctagatcaagacaatatccatgaattgaataggttttccagataataaattgatagaatgcagcacatatctccatttcttaagagagaaaaattttgtgtcaacatgtagatgcacagcatggtctgacattgggactgaattattctcagttaatcaatagcacgcatgtgaagtagccattcacagactcggctgctcactggcatgacctggacgacatttccctttacagattccttgacccactcccaagggtttggattcaatagggtttgggttgctctgggacctgtagttctttaaagccctcttgatgactgattaacaccaaggagaagattgacaaaaatctgtaatagcggaagcatttactacaagtaaaactccgtgtttaaacttgggggaaaggagtttatccttacgtagcttattatctagcacagtgattctcagctgagaataaatttgcctcctggggggcatttggcaatgtctggagactttttttttttttgagctggagtctggctctgtcgcccaggctggagtgcggtggcgcgatctcggctccctgcaagctccacctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgagcccggccgtctggagacattttaggttgtcactattgtggggtggagggtgggggtggggaggcggtcctactggcatctaatggtagagaccagggatgctgctgaacatcccacagtgcacagggccgtcctccaccaccaagaattacctggctcaaaaggtcaataccggcaagagaaaccctgatcccaatagggggaataagaaaatacattaaactatataatgaatggtgtagagatttaaaagttattgcaaagatatagatagatgctatcacaattcggagcagggtgagttagggccagcagagaaaggatcttaggctctggaatgaagtctatgcctcttcctacagccttactacttaagtgttcaacactagcggaacacttgcagtttcgagcatttgtgcatatggtaattaagctaaataaagttcctgttctccttgaaggtcacattctagttggaagaatcaggcagaacatccaaagtttaaaaaatggaaaaaacaagtgttggcaagcatgtggaggaagtaaatggaacacccatttctagtgagagtgacattggttcaaccactttaggaaactggctagcagtatctaccaaagctgatctacatgccctgtgattcaacacttctacccctaggtgtttgtttaacagcagtgcatgtgtatctgtgccaaaagacatgtacaagaatgctcatagtagtagcatgtgtaacagtccaaaactaggtacaattaaaatgtccattaggccgggcgtggtggctcacgcctgtaatcccaacactttgggaggccaagccggctggatcatgaggtcaggagatcgagaccagtcgggtcaacatagtgaaacaccatctctactaaaaatacaaaaaaattagctgagtgtggtggtgggtgcctgtaatcccagccactcaggaggctgaggcaggagaattgggtgaacccaggaggcagaggttgcagtgagccgagatcatgccgttgcactccagcctgggtggcagtgtgaaactctgtctcaaaaaaaaaaaaaaaaaaaactctattaataaaatgaatttttaaaaccaaggtgtatttttgtgtatacaatggaatactatatgcaattcagctgaatgtagtactgctacacaaaaatatgtagatttatctcacaaatgtaacattgagtgaaagatgtcagatatgaaaattatatatggtatgatcccattatataaaaattatatagagataaaattaatgtattatgaatcaaaacagttgttgtatcggaggaagattatgagtggggtctttctggaagtcatctgggtgctgtaatattcaatttcttgatctgagtagcagatctggtaatccatattgtctttgcttttttctgaataccacattttgataaaaatatttacttaatagagcaatgacaagtgctatgaagaaaagtaaagctgggtaagggacttagagagtggcaggtcagtgtcatagatattatttatagcagagatccacaagctttttctgtaaagggccagatagtaaatattctaggctttatgagcctacaatctgtttcacaatcattcaactctgcggttgtactgcaaaagcagaaatagacaataagtaaatgagtgaatgtgactatgttccagtgaaagtttatttgtggacactgaaaattgaatttcctaattttcatgtgttgcaaactactatttttgctttcgattttttccccagtcacttgaaattataaaaaatatccttagctcacaggccataaaaaaacaggcattgggtgaatttgacctgtgggccatagtctgcaacctctgaggtagaggctagtgggagaaagcctgcccaaggaggtaactttgcacagtcctaagcaaattgagatagcaagtaatgtattgatccagggaaggcgttttctctggggaggggagaggaagtaggaaggccatacggtggaagcttgctgagtgtgttcaaggaacagcttctgtggctagagaaaaatgagtaaatggcgacactggcagcaacaagccatggcccgagaggctcagagagagatgctctaaaacggagagctggtggcgatgaggaaggtgaaacagagggaagaaatcctggagcaaggatgcaagccagaagtctgaatctctcagagaagaccggagacagaactagcatgtggaatggggtggagaggaggaggaggcagggaggcagtcaagtgtctttccgtgcccaagctgcacaccacgcacaccaccaccaccgcacagacacacctcagagttatttagttcaagcattgtaagactggataaaggtgtatttctttctgtctctttttttctttactttctttcctcccttttttgtttttttcccagagaattcacatcaaacagcattatttataatgatgatgtccttctaggtaaactcagattttccaggtgaaagagaatggcaaccaacagtggcagcgattttttaaatgcgacatgttggccgggtgcggtggctcacgcctgtaatcccagcagtttgggaggccgaggcgggcggatcacctgaggtcgggagttcgagaccagcctgaccaacatggagaaaccccatctctactaaaaagacaaaattatctgggcgtggtggcgggcgcctgtaatcccagctacttgggaggccgaggcaggcgaatcacttgaacccgggaggcggaggttgcggtgagccgagatcgcgccactgcactcgagcctgggcaacaagagcgaaactccgtctcaaaaaaaaaaaaaaaagagacatgtcttcaggcttattgatgtatctgcccctggctggaagatttctcgaagctccaacataaagtaggacctaatgtctggcactgcggttgaaggaatgatttgcctactgggtgttttacttagcaacaactcagctttttatggaattccagttctccaatgtttgttctctgatgtattgttgcctcttttataacagtcattaaacactgaaaatgtctgatgcggcaaaacttaatggacacttactggttataatggaatgaagagtgaggtggaaaaaaaaagatgattacccaaagctttcataaaatttcttgttatcttttcacatcttttatacagacaatttatcttgggtaataggctatgcccttttgatctacagactagaaacacaagaattgtaatagcataatgttgtatcaggtatgccaaatacaatattttacctaatttcttgtattactttgcttcataggtcagggaaaagaaaacacatttaaagcaaccattaagataagaggacagatgcaaatttaaaatagttgaatttaggtaaacagaattaattaaacccttaatttcattagtatttacagagtgcctgccatgtgtcagacactgcctagattctaaatgactaaatgcataaatgagtctgtatagataaataaggcaggttaatataaataaatgaaattatatagtacctatctcataataactgcttaataaatgtcagcaacaaatattgttataaaactgctatgggatcttcacatttggtataattatgttaactacacgtatgaaaataagagtcattaatacgaaggcaactgtactaggggtagcatctcatggtgatgataagcatctgtgactagccaaaaagtgcttaatcaccccaaaaggcactctatgatgttggctaaataaatatcaacaacaaaaggcgtttctcaaattagttctagataagttgcatgtcacctgattctatgactatcggtcccattggtattctaatttcttttttcaaggatctttcctaaaaaatattattgatgccatcattttgacaaaaacttgttaaagtattattaaaactggcataattgaaatttatttttgtgattaagattgaaaattaaaaaggcacaaaatagtagcaaatataacttgttctcattatattgtttatgacaataaattccctggttaagcttacacatggttctctcttctaactctgttttcagttccttgtaaaagattattctttgaagctgacatttcttgtctcttatctataacaaaggttaataggtatattaaaatgcagagaaaacattcacattttctcctagaattaaagttttaaaaaagttcaagttttatataaatgtttggaaatgaattataggtagctacaggcaagacatgttgtcaaataaataccttcagataaatgttgaaaaagctatttctaatgtgaagttttaaatatgcttggaacataattggttagacactgagcagaatgaaaaatctaattatcagcaaagggaggagtctatccacaaagatgtaagaaatattttaaacttagaaatcaaaacgttctggagttttttagtcaaacttcctactgttgaacttaaatatgcagaaagtcattttatctatctaagtgagatgtggaccaagattaaaagagtattaaatactaaatatttcttccttttatcttttattaaagttaaatagaagtaagatgtgcttacggatgccaagagaaaatataatacaacagagattcctcgtgcagcaccatcagaatgtcatcacagtaggccatgtcagtctccacttaactttcacacattctgatggacaatatccataagtttgtaaaatgactgtttacaaagtatactctgttctacttttctcaatttaatgctgtgtttatctgcctgggtgttttctttttttcctctctctgtgtgtgtatacatgtgtgtgttgatagtgagcagaacatagccaggagcagcaaactgtttttggagaagaactcatttttaatttaaatgtgggctttatagacaagaataagaagctctgattgcagctaatttcagcaaattaaaaagagcctgcggggaaaactgactggtaatgatgaaatgcaatcaagtgagcaacagtatcgatcttcaaacacaaagctgagcagataataaaatacagtttgaaaaaaaccattcatttttattataggatatagcagatgctggtttaagtactagaataaaacaaaaagcctattgattattacagcttgtactgacaacattgtatatacatagctggcatcgtttgtagcagtttgctcgtgtcctcaggcagggtactaacccagaatgggcacccagccactttcttctgaacagaatctcatgcattaaatatttatgtttcagtgagtaaggaaaagagaaggaaatcaaacattcctcctgcgtgtgcgtggaacttttgtcgaactataaacacagcatgagcacaaacccttctactacgcccttcaatacttcccttgtctttgtttgattggcaaaatgtctcctagcaaggagtttctgaattaggccaaaacaaagacttgaaataaatgttatcttaactcttaaacagaaatattatttttaggattacttcttacagcagagcagaagcttgtttagtagagaaaaggatgctgtcagattctcagggtttagaagcaggactttagacagaaggtagaactatttagacagaggaagtataaagggttctaaaatgaatgggaatgaggcagggtgatttcaagaaaaaaatactgaacttatccctagagaatataagcattttcattccttccttcctttcattccttccttcctttactcattcattcaaaaaattgtatagattcccagtagaggcataaccaggctggaaccttcaaagtcagaagtctggcagggcctgggtcactgttggtgagagaccactcttctgtcttcttgacatgttcctggccttgtttccacactgtttcctgttacaacctttcatcaaaatcttttttttattatttttttattaccataggttattgggaaacaggtggtgcttggctacatgagtaagttctttagtggtgatttgtgagattctggtgcacccatcacccaagcagtatatacactgcacaaaatttgttgtctttaatcccccatccccttcccacactttccctctgaatccccaaagtccattgtgtcattcttatgccttttcatcctcatagtttagctcccacttatgagtgagaatatatgatgtttggttttccattcctgaattactattacttagaatagtagtctctaatcttattcaggtctctgtgaatgccattaattcattcctttttatggctgaataatattccattgcatatatatactacagtttacttttccactcgttgattgatgggcatttcggttggttccacgtttttgcacttgcaaattgtgctgctataaatgtgcatgtccaagtatctttttcatataatgacttcgtttcctctgggtagacagcaactagtgaaattattggatcaaatggtagttctacttttagttctttaaggaatctacacattgtttttcatagtggttgtactagtttacattcccaccagcagtgtagaagtgttccctgttcaccacatccatgccaacatctgtcatttttttgattttttgattatggccattcttgcaggagtaaggtggtatcacattgtggttttgatttgcattgccctgatcattagtacattttttcatgtgtttgttggccatttgtagatcttcttttgagaattgtctgttcatgtccttggcccactttttgatgggactgttttttcttgctaatttgtttgagttcattgtagattctggatattagtcctttgtcagatgtatagattgtgaagattttctcccattctttgggttgtctgtttattctgctgactgttctttttgctgtgcaaaagctctttagttcaattaagtcccagctatttataattatataattattataattgtttttattacatttgcttttaagttcttggtcttgaaatccttgcctaagccagtgtctagagaggtttctccaatgttatcttctagaatttttatagtttcagggcatagatttaagtccttgatccatgttcagttgatttttgtataaggtgagagatgaggatccagtttcattctcctacctgtggctagccaattatcccagcaccattttgttgaatagtgtgtcctttccccattttatgtttttgtttgctttgtcaaagatcagttggctgtaaatatttgggtttatttctgggttctctattctgttccattggtctatgtgcctattgttataccagtaccatgctgtttcagtgactatggccttatagtatagtttgaaatcaggtagtgtgatgcctccaggtttgttctttttgcttagtcttgctttgactatgtgggctctttttttggttccatatgaattttaggtttttttttctagttctgtgaagaatgatgttggtattttgatgggaattgcgttgaatttgtagattgcttttagcagtatggttattttcacaatattgattctacccatccatgagcatgggatgtgtttccatttgttggtgtcatctatgatttctttcagcagtgttttgtagttttccttgtagaggtccatcacctccttggttaggtatattcctaagtattttattgttttttgcagctattgtaaaaagggttgagttcttgatttgattctctgcttgttcgttgttggtgtatagaaaagctactgatttgcatacattaaccttgtatccagaaacttcgctaaattattttatcagttctaggagctttctggagaagtctttagggttttctaggtaaacaatcatatcatcagcagacagcgacagtttgacctcctcgttactaatttggatgccctttatttctttctcttatctgattgttctggctaggacttctagtactgtgttgaagaggagtggtgaggtgggcatccctgcttgttccagttctcagagggaatgctttcaacttttccccattcagtattctactgactgtgggtttgtcacagatggcttctttacattgaggtatgtcccttgtatgccaattttgctgacagttttaatcataaagggatgccgggttttgtcaaatgctttttctgcatctatggagataatcatgtgatttttgtctttaattctgtttatgtggtgtatcacatttgttgacttgcatgtgttaaaccacccctgcatcctagtatgaaacacacttgatcatcgtgggttatctttttgatatgttgttggattcggttagctagtcttttgttaaggaattttacatatgtgttcctcaaggatattggtcggtagttttctttttttggttatgtcctttcctggttttggtattagggtgatactgacttcacagaatgatttagggaggactccctctttctctatcttgtggaatagagtcaataggattggcaccaattcttctttgaatgtctggtagaattctgctgtgaatctgtcttgtcctggacttctttttgttggtaaattttttttttttttgagacacagtctcgctctgtcgcgcaggctgttgtacagtggcatgatcttggctcactgcaacctccacctcccaggttcaagagattctcctgcctcagcctcccgagtagctgggactacaggcatgtgccaccacacccagctaattttttgtatttttagtagatacagggtttcaccgtgttagccaggatggtcttgatatcctgacctcatgattcacccaacttggccttccaaagtgctgagattataggcatgagccaccatgcccggcttggtaatttttttattgccatttcaatcttgctgctgcttattggtctgttcaaggtatctaattcttcttgatttaagctaggcagattgtatcttttcaggaatttatctgtctcctctaggttttctggtttatgtgcctaaaggtgcttatagtagccttgaatgatcttttgtatttcagtggtgtcagttgtaatctctcctgtttcatttcttattgagcttatttggattttctctcttcttttcttggttaatcttgctaatggtctatcaattttatttatcttttcaaagaaacagctttttgtttcattgatcttttgcatttgtttgttcatttgtttcaacttcattaagttctgctctgatcttggttatttcctttcttctgctgggtttgagtttggtttgttcttgtttctctagctgcttgaggtgtgaccttagaatgtctgtttgtgctctttcagactttttgatgtaggtgtttagggctataaactttcctcttagtattgcctttgctatagcccagaggtttgggtaggttgtgtcgttattcattcagtttgaagaattttttaatttccatctcgatttcatttttgacccaatgctcactcagaagcaggttatttaatttccatgtatttgcatagtttcgaaggttccttttggagttaatttccagttttattccactgtagtctgagagagtgcttgatataatttcaattttcttaattttattgaggctcattttgtggcctatcatatggtctaccttggagaaagttctatgtgctgatgaagagaatgcatattctgtggttgttgagtagaatgttctgtaaatatctgtcaatatccattttttccagggtatagtttaaaaccattgtttcagtgttgactttctgttttttttttttttaagagggagtcttgctctgccgccctggctggagtgcagtggtgtgatctcggctcacagcaacctccacctcccagattcaagtgattcttctgcctcagcctcccaagtagctgggatcacaggaatgcaccaccaagctaatttttgcatttttaatagagacagggtttaaccatgttggccaggctggtcttcaactcctggcctcaggtgatcctcccaccttggcctcccaaaatgctgggattacaggcatgagccactgtgcctgacctgactttctatcttgatgacctgtctagtgctgtcagtggagtattgaagtcccccactattattgtgttgctgtctttatcattccttaggtctattagtaattgttttataaatttaagagcaccagtgttaggtgcatatatatttaggattatgatattttcctgttggacaaggccttttagcattatataatgtccctctttgtcttttttaactgctgttgctttaaagtttgttttgtctgatataagaatagctactcctgcttacttttggtttccatttgcatggaatatctttttccacccatttaccttaagttgatgtgtctttatctgttaagtgagtctcttgaaaggcagcagatagttggttggtgaattcttatcaattctgcaattctgcctcttttaagtggagcatttacgctatttacattaaatgctagtagtgagatgtgcggtaccattccattcattgtgctatttgttgtctgtataccttggttgttttttttttaattgtatttttgtttgataggtcccgtgagatttatgctttaaagaggttctgttttgatgtgtttccaggatttgtttcaagatttagagttccttttagcagttctcgtagtgctggcttggtagtggtgaattctctcagcatttgtttgtctgaaaaagattttatctttccttcatttatgaagtttagtttcactggatacaaaattcttggctgataattgtttttgcttaaggaggctgaagatagggccacaatcccttctagcttgtagggtttctgctgagaaatctgctgttaatctaataggttttcctttataggttacctggtgcttctgtctcacagctcttaagattctttccttcatcttaatttagataatctgatgacaacgtgcataggtgatgatctttttgtgtttaatttcccaggtgttctttgtgcttcttgtgtttggatgtctaggtgtctagcaaggatgaggaagttttccttgattattcccccaaatatgttttccaaacttttagatttctcttcttcctcaggaaggccaattattcttaggtttggtcatttaacataatcctagacttcttggaggctttgttcatattttcttcttttttctttgcctttgcaggattgggctaatttgaaagccttgtcttcaagctctgaagttctttcttctgcttgttcgagtctattgctgagattttccagagcgttttgcatttctataagtgtgtccattgtttcctgaagtttcgattcttttttatttatgctatctatttccttgaacatttctgccctcatttcttgtgtcatttctttgacttccttaaattgggccttgcctttctctggtgcctccctgattagcttaataactaatcttctgaattctttttcaggtaaatcagggatttctccttggtttgaatcgaagtgagctagtgtgattttggggggtgttaaagaaccttgttttgtcatattaccagggttggttttctggttccttctcatttgggtaggctctgtcaagagggaaggtctagagctgaaggctgttgttcagagtcttttgtcccacggggtgttcccttgatgtagtactctcccccttttcctagggatgtggctttctgggagccaagctgtagtgattgttatctcccttctgggtctagccacccagcaagtctacccggctctgggttgtctgcagagtcctgtgatgtgaaccatctgtaagtctcccagccgtgcataccagcatctgctctggtggaggtggcaggagggtgaaatggactctgtgagggtccttatctttggttgtttaatgcacgatttttgtgctgtttgggctcctgccaggaggtggcgttttcaagagcacatcagctgtggaagtatagggaggaacaggtggtggtcagggccctggaactcccaagaggatatgccctttgtcttcagctacccgggtgggtagggagggccattaggtggggacacggctaggcatgtctgagctcagactctctgtgggtgcgtcttgctgtggctgctgtaggggatgggggtgagattcccaggttaatggagtgatgttactaggaggattatggctgcctctgctgtgtcatgcagcttatcagagaagtgggggaaagccacagtcacaggcctcatccagctcccatgcaacccaaagggccaatctcactcccaccatgcccccgcaacagcaccaaatctgtttccaggcagtgggtgacagggctgagaactcgccccaggctccccacctcccagctgtgaaagcaagtagggctttcatgcttcccctactgtggagtctgactcgcgccctcccccgggttctggccaggagacttctccatcagctcaaattgttacaaagttcagctggaggtttccttctccctgtggccttctcccagtgcctctggcagccctcctcaaggcccccgtgaggcagggcagaaatggcttgctacgggacccatcgagcgagcccatagggctcttcctgctgcttcctctacccctgtatttcacttggctctctaaattgactcagctccaggtaaggtcagaatcttcttccgtgatctagaccttcagggttcccagtgaaggtgtgtatttgggggcagacaatcctgctttcccacttccgcagtttgggcactcacagtatttgaggtatctcccggctcctgcaggagcaatccacttccctcagagggtctatgggttctgtcggctttcctgatttgttcctgcagtcgctctggagcaagtgttcacagtgcaaggctccacatgctgctctgtctgtctgagtggaagctgcaatctagtcctgcctcccgtctgccaagatcctcccactttcatcaaagtcttaaaacatgccgcgtgcctgtagtcacaactactcgggaggctgaggcaggagaatcgcttgaacccgggaggcggagcttgcagtgagccaagatcacgccactgcactccagcctgggtgacagagtgagactccgtctcaaaaaaaaaaaaaaaaaaagtcttaaaacaaacatcacatcagcaaaataccgtgcatttgtagagtaggtgagccttttggaaaatgtgttcccccatctaattacattcccagcactagctgtcacaatgccaccattaaaatggggaaagacagagaatttaaaaaacaaaaacaaaccaaaaaaaacccagatttttaaaatgtgatcagttctgacactgcaactgctataaaaccaataaaaaatacaatagaaagagagcgggtttggcatgaagggctgtcttagttgtcacagatgccctctcagatgatgagcagaggtgttgccctgtccagatctgagcatacagctttctacataaaggaaacagtgggtgcaaggccctgaggctggaacgagcttggcatatttgaggaaccacaagaagactggggtagttggagaatagcaagctatgacagagtggaaggactgtgacaggagatgaggttgaagagagacaagaactagaaagggagaactcacaagtcatagcctggagtttagagttgatgctaagggccatggggagtcactgaaagtcagggatgtgtaagtaattaattgggaattttttaagtgaatatattgtccgcaaaaagtttgtgaagcagcttatatccactattcactttttacttaaataaatttacgcctatttttttttcttttttgagatggagtctcactcttgtctccccagctggagtgcaatggtgcgatctcggctcactgcaacctccgcctcccaggttcaagtgattctcctgtctcagcctctccagtagctgggattacaggtatgcaccaccacgcctggctaatttttgtactttcagtagagacggggtttcaccacattggccaggctggtctcaagcttctgacctcaggtgatccacccgccttggcctcccaaagggctgggattacaggtgtgagccaccgcacccggcctaattcacgcctattaatgtatttttcccaaatgcaaatagctctggttttcattttcttataaaatacctgagattctttcactgcgaatccttccaagtacctatgtttttataataccctatgtttctttaccacatcaattatagttacggttataaacaaattaataattggaataattatctatttttgtcttttcttacagactgtaagctcgtgtgtgcagattgagtgcttgaacactcagcacataactgagatgccagaaaatactttcattaaataattactataatcatataagctttattcacttactataatatgaatatttctcatatcaccaaacttttgcgttctacacttttgtatagttgcaatatcctgctgttgactaatgaagttcttccaagtttcaagaatgaatttttattctacataaaaatgttcctatttgcttaaatagttaacttacagggatttcttaggtccctgggctgctgtcttatctcagtgtaaataatagtgaaatggagtcttttaaagtgtctcctaatatgttgtgagttgatttatgtccctgaaaaaaggtatgttgaagtcctaacccctggcaccttagaatgtgaccttatttggaaatagggtcatcgcagatgtagttagttaagacaagctcatactggtgtgtaggggtgggcccttaatccaatatagtaacttgaatccttatttagaaagagaaggcatgtgaagagacagacacatacacagagagactccctgcaaggactgcagttatgctgcctccagccaagccactaccagaggccaggagagaggcttggaagagatcctgccccaggatcctcagagggaacatggccctgctgactccttgatcttggacttctggcacctccataactgtgagataataaattgctgttgctctaagccacctactttgtgatactttgtgacaatggtcctaggaaactaatccatcgtcagagacagctaaactacacttgctcatctgggcagaagttgtgcagatccatcttaatcataccccagagccattgctgtgatgcccacaaagctggatctcaagtcacagggacaagagataaaggggtaatttacaaaattaaacacagcctgcccagttacagttcaattttaggaaatcatattatataatactggaacatacttatacttaaaaaaaaaaggtgttgttcaaggtcaggagttcgagaccagcctggccaacatgatgaaacccccatctctactaaaaatacaaaaattatccgggcggggtgacaggtgcctgtagtcccagctactccggaggctgaggcagggaatcgcttgaactcaggaggcagaggttgcagtgagccaagatcgcaccactgcactccagcctgggtgacagagtgagactctgtctcaagacaaaaaaaaaaaggtgttgtctatctgaaattcaaatataactgggcatcctatgtttttatttgctaaatctgacaaccctaggaaggcgaccagcaggaggtaaacatgcccttgggacgtgctagggcaggcgatgtcttcacttctgagcactcaccctggcggtccacacttaacaggagttggcccagagagacggaagcaatccatgcaaatcccctctcaggctcagtgagatgcatttggaaaaggtgaaaaagatgtgcctcagagaatcagagaagcaaaaagagtgactgctagaagactgttgtaaaatgagtgggtaaagccctgttggaaatggaagaagataagaaaataaaaacaaatcctcctattgccattacttgtgctttgtgacattgtttattaaccaagtagaaatattaccttaaaataccagagattataactaagacactggaagagggatgtaagaaagaatgtttagtttctgtttactactagaagaggctcaagaaaatgttgaagtgtaacacagaaatgaaaatgtattttaaggctgagtgcggtggctcacgcctgtaatcctaccactgtgggaggccgagtagggaaggctgagtgtggtggctcacgcctgtaatcctaccactgtgggaggccgagtagggaaggctgagtgtggtggctcacgcctgtaatcccagcactttgggaggccgagtagggcagatcacctgagtcaggagtttgagaccagcctgaccaacatggcaaaaccctgtctctactaaaaatacaaaaattatctgggcctggtggcgtgcgcctgtaatcccagctatgccagaggctgaggcatgagagtcacttgaactcgggaggcggagcttgcagtgagccgagatcgtgccattgcactccagcctgggtgacagagcgagactctgtctcaaaaaaagtaaaaataaaaataaatatttgaagagggctaaacaaattacagcaaaatttcctggcattaatataagagcagatgaagatgtccactctcatttgatgtttgtgatagagaggatgatggaagggcccaaagttagataaattcaagaagctcgcaaaagaacgtgcacttctgggtgttcagacaaatggatctggcagacacaaagcccagaggctgcaggtgaactagcttgaggataatgaatagaaaatgcaaactacccccaaaaagagtgacacaaggaaaatgacgttctgaagtaagaaaggggccaaaaacaggaaagacggaagcaggtaagtttgataatgatgctgaaaaggcctaaacaggattttgacgcaagagatagaattactttcccaaattgcagggttcagcatccagaattcagttgtcaaggttgaattcaaatttgggttaggattatcccaaacaaaaatgataaggaacactcctacattattgtgggaataaatccaagggaatttacttaggctggggaaagtatgtttaaaactcagtagctcccatttcaatggcaaagacacagtaattttcctaaaacaagaggcctgctgtgcattttctagtaagaacctacaaaactgaagctggtgaataaatcatttaaatcaaggaaaggagatacgctgcaacgcttaaagcatcctagaggagtgtgactgtcaaaaataccttctgattatgtgacgtgtttaagactggagctctcacgaaggatccatttgaccactgtgcaatctaagcgtgaggagagtgtgaaggtcagtgatctttctgctaatactgaacatgtctcagactacgccaccggagacagggagttgcatcaggaaacaccaaaggaagagcaaaaggagaagctgaaaacacaagaaaaccaaatgcatttataaaaaaaaaaagaagaagaaacatcaagctgccttcttcaggtctaggagactgtgcattgaatttgcacagaagtttctagcgtgatggatgaaacctggttgccatccaaccaggaaaaagaaaaagcaacattaaatgtcgccagggccttttccctgcagtaataacacaactggcaaggatatcctgaatatagcacataaatatgttctttctgcttcttgctagcaggagatacaaacagcctcttccacgttttcatgttcatgtttattaaagtcacagacataaaatgttaaggttctaaagaatgaaaatgtcagtgttggtataaaagtatgaacaccttgcacaggttattttaggaggaaaatttgatcatggcaccatatattttcatatatattttaggattatccaccaccataaatgacatttctcagacaactgtaaatagatcactgcacattgcagtcatttgttcactgagcatgcacagccaggtgctgtggagggaacaaacatgaaaacaaacacacacaaatgtggggcccgcctgccttcaagctccaagagccagactctctaatgagccattaagcatgatcagaaacacaaaacggaaacaaaaccacaccgtaatttaagataaaaagtgattaagtgtcattagagaagcagaggtaaactgtaaccagagttctgagaagagtgtccagggacaagctgagaggccgtcagcgttgcacgaagccttgctgcctgcttcaaggacatctggtctgccggcatctgagggaagaggctgaacaaagtatttccttagcacaaacagaaaaataaatactttgagttatgtaggatattgacattggtgttcatgtacttagtaggtctcatactgttttgctgtaataaccccagtggtgaagaaaagcaaatgtatacccctagtcaatgtggggtgacggcccaagcatcctgtctcaaacaaaacatgtttttgctgtctcttttgttgttgttgtttttgagacacagtaccccaggctggagtacagtggtgttatcatagctcactgcacctcaaattcctggattcaagcaagcatcctgcctcagtctctcaagtagctaggactacaggcatgcactaccatgtctggctaattttttcattttttagtagagatgggggtcttgctatgttgctcaggctggtcttgaactcctggcctcaagtgatccttccacctcagtctcccaaagtgctgggtttacaagtgtgagccaccatgctgagtgaatgtttcacatttaatctcaaaaattcatgtaaattgttcattctactgcatatcatatcctagttcagttaaaatggaatcgttagttatcaggaaaataaaaataaaaaccataataagataccactttataaccactagtatagctataataaaaaagacagataataacaagtgttggcaaggatgtggggaggttggactcttctcatacattgcaggtgggaatgtaaaattctgcagctgctttggaaaacagtctagcaattccccaaatggtgaaatatagacttaccatatgacccagaaattccactcctaggtatctacccaagaaaaatgaaaacccatgtccacacaaaaacttgtatacaaatgctcatagcaacattattataatagccaaaagcggaaacaacccaaatatctatcaactgactaatggataaacaaaatgtgatgtattcacatgatggaatatgatttggctatgaaaacgaatgcttcaacctggatgaaccttggaaacggtaagtgaaataagtcagtcacaaaggactgtatattttatgattccattcacgtgaaatgtccggaataggtaaatctatagacagatagtagattagtggttgcctagagccagaaagaacagggaaatacagaggtgatgaacaaagagaataggtttctttttggggtgatgaaaatgctctaaaattgaatgtggtggtgattgcacggctctgaatagactaaaaatcattgaattgtacactttatatgggtaaattgtatgatgtgtgaattctatttcaatacagttgttgcaaaaaaagaaatttatatttttaaaattttgtttttagagacagggtctccaatctgtcacccagattggagtgcagtggcgatcatgacactgcagcctggaactcctggccccaagcgatcctccctccccgctcagcctctcaaagtgtgattacaggcattagccaccttgcctggcctaaaatggaatttttaaatcctatgcttaaaaaaaaaaaaaactgcaatagcacatgctaagcttgacaaaggcgactaatagaaaaatttctgaaggaaaacaggcaagtctgccatatcccctcccccgaggttattaaaagttagcagtttggaacatacttgccagcctttttctatgcttttacctactaaatgtgcacttagacgtttatgtacgtgcatttatgcaaccttgtttctaagaaaattaaataatttgctgccagcatactcataacctccccattctttctgcgaagtggctacttcctataccactggaacaaaagtcgtgtgcgtaacccaacatgagaagcgcacgatttagttcagtgttctccgtcctccacggttcgcagttgtcacctccaaggcctctgaggatgaaggactgggacaggcagaggcagagcccctgccgggaagcagagaacattaaggtggcagcctcagccctgcctctccacttgcccaggccagcgttctcagcgcacctgccgcgccacaccccccgtgccacacccccctgtgccacacaacccccgtgccacacaacccccgtgccacacggccaacacacgccacacgcccccgcgccacacgcccccgcgccacacggcccccacgcgcctgctgctgcttcctgccctggcacctgtcctccgctctcttctctctgtgccgccctcttccattgagtgctgccgcttacccagagccgaaacgtcatctgcccctgggatttccgtggctgttctgagtcccacacattcatctccctccagtcctggaggcctctaggactgcggtagggaggggaaagccgccgcgagtgggccagcttgtcagtcaccaaaccccctgcattaggactaattcttacctcatatgacttgtttccttttgcttttagagacggagtctcgctctgtcgtccacactgcagtgcagtggtgtcatcgcagctcactgtagccttgaacttctgggctcaagcgatcctcttgcctccgcctccccactagctaggactacaggcaggcaccaccacgcctggccaagattttattttattttttgtagggatggtctcactatgctgcccaggctgtgtggtccaaactcctggccttaagtgatcctcccacctcggcctttcaaggtgctggggttccaggcatgagccactgcagcttgcctgttttgaggattactcgcatacacaaagaggcatgcagacttcagcaaggtgatttttattttcaagatcacagagctaatcaatatcggaatctggattgtgacacagatcccttcctccatgtttaatacactttccactctacttctgatatgctttaaacagtattccaaaatgattgttaaagaggacattttgaacatatgtcagtaaaataattgtattacaggaagcaaataaggaggcatgattgtggcattctcagccatttttaaaaaaatagttcatgtttcctcttagcacttccattgtgtgagcagagtctgtaataacgtgctcagtctacaacatcacttcatatttttcatttcatatgagttcattttttgcaggtataagaaactatcttcaggtttcagataaaattgcaactgaacttttaaaacctaagtttttgttgagtccaggccataaaaatctatcagaaggacctaagccatttaatcatccagattatcagcacttctacaaaaaggttttaaatggcaagaagataaaatgttaagtgaggatagtaattatttgcctttatctcttgtgccaggtttcaaacctcaccatatgggtgtttgtgcaagattaaatagctattcaagtgtgtaatgaagtatagatactaaattgaaccaaaagatatagcatggaataggtcagagaagatccactctgcagaaatggactatgaaagagttgattgatagatattcatgattccaatccgacgtgtactttgagggccttttaacaaaatagagaaaattcttctttttaaattatttcctataggaaacaaaatactacgggggaagtagcaaggaaatttggggtgaaaaaatagactgccatctgcaaatatcctccagaagtagactgaatgaataacttgatttgctcaggatggcccagtgtaagcattaataattaatgtcaatctccttttactcttagaaatgtcctagtttcataaattacggtcactctatctggaatgatttttgagagctatcgtcagagtcaaaaaaacttaagcatgaaacttgcctccacaataagtcactaaatgtgctttcaagaagacacttgagaaggaaaggggttataaaaggtttagaaaatctgagctatactctaggaatgtgatagtcaacgtgtgtgtgcatatgcataacagggagagggagattgggaggccgaggccggtggatcgtttgaggtcaggagtttgagaccagcctggccaacatggtgaaaccccgtctcaactaaaaatacaaaaaattagctgagcatgatggcacgcgcctgtaatcccagctactcgggaggctgaggcaggagaatcgcttgagcctgggaggcagaggttgtcacgagctgagatcgcaccgctcaactccagcctggatgacagagtgagactctgtctcaagaaaaaaaaaaaagagagagagagggagagagagatggagagataagcaacagtttaggtcatctgatgcaggatctgttcacccttcactcagaactcaaacaatggggaatggtaaatgtatcaagattcatgtaaaactggaataaaatcaatatattttagaagcaagatgtgaatttttcaggaaacacagaaaagcaaataggatgaatgctttcgtttgtaaaaatttccaagatatactattagatagcaaaagcatacagcaaaacataaagtgtgattctattttttgaagacatattaaatatttgacatgctttagaaaatgtctgagggactacataccaaacagttaataatagtgttgtaaatgggtaattgtttctatctgggttaaatgtgattacatgcttactgcttcccctctgtgtgtgtgtgtgtgtgtgtgtgtgtatgtgtgggtatgtatgtgtgtgtgtatgtgtgtgtgtgtgtgtgtgtaagtgtgtctctccgcctcagtcacaacagaggtttcttcttcagtgtgaaccctgacatgagaaaacacgcagagcccagcagagattcagctgcctagcagccgcgtgcagtgtgaagaagaaatcaacagagggtttcggttacagcacaaagtgactaatacaagcggtcataggtgaagggcaagattcctaaaaagcgtttttccgcatttatttctatgatgaaagactttcttatagccagtactaatgatgaagctgtgcaacaacaatgaaaaaaattcaagcttctcatttattcccttcttaccccctcctcattcacagccacaaaggaagtactaccaccaccaaaccaccaaaaggcaaagggtagacaatgattttctgaggtttctttcacctctaagttatatatatatttttttgagacggagtctcgctgtcgtccaggctggagtgcaggggcgcgatctcggctcactgcaagctccgcctcccaggttcacgccattctcctgcctcagcctcccgagtagctgggactacaggcacgcgccaccacgcccggctaatttttgtatttttagtagagacggggtttcaccgtgttagccaggatggtctcgatctcctgacctcgtgatccgcccgcctcggcctcccaaagtgctgggattacaggcgtgagccaccgcgcccggcctctaagttataatttttattgtaaaaaatagatgcatatttagatatgtgtgactttgggggttgtgttttaaatagcagctgattttgttttagtctatattagcatctcaggttcttttttaaaatctaagcaaatcaaaatgacttttcagaccaaatgtgtaagttttaatccatcctaatttcatgatgaactaaaaagcacaactgggtcatagtggaatcaggtcattcaatataaattactacataactaattcagttgcaactcaattgaaaaggtaaatagtcatgacaaccaagctaaacaattcttctaaggtagtttatggaaacataggcaaggcttcttttcatgaattttaaaacatccttcctttgtagagatggtgaaatatgtgccctccttttcccctagtttctcctcagataacctcattcaacctcatggttttaaataccttctctctgtggctgctgatgaccaaatttttaatctagccctgaaacactcttcaaacattcagacttcttgaaatcaaaacgctttcttgaaatatctcataggaaccttgaatcaatctcaaccaggaggaactgcctgactttctccagcatttcctacttcaggaaatgccattgttaaagacatgttcgctgaataacctcaagggttgagaattcaagtgaaatactaaaattcagtctgctgccattttaagtagccataaaaaattaggtcccctatataaagaaatacatcaagttcaaaaatctttaaaattaaatggaaaagatattgacatgtcttaggatcccatcaaggtttgagttttataacctgtattctggataacctcgtttcactgagatggtaaatctttttcagtaggctatctttccacatgaggaagattaagaactacgtgaaaatgtttaagagaatcaaagccaagatataatattttgtattaaaaagaatccctctctacttggtactttatgttataatgtttaagatcatttgaggaattacaatgacagccttttaactttaatttatgtacaaattaataatctgtttagattaatggcttctgttattctctgtatcacagtaacacaaatgcacatctccacatacaattttttctcaaagttttatacaatcaactgcctatttgacatctccactggaatgtctaaacagaaaccttacgtgttaggtgtccaaaacccagtcctgactttccccctaaacctgcagccttccccatttcagttgatgacaagttcattcttctctattcctgagaccaaactccctggaagtcatattagactctgcttttctcactccccacatccaatccattatggaatcctagttacctgaagtttgcacatatcccacatctgacctcattcacttccaccaaagtgacttctgcctcctttttgccctaaagactgttctaaacatagcagtcagagtgatccaggtaagacctaaatcagatgctgtctctcagcatcactcagaataaaagacaaagtccacacaaggcctgaggagctttccctccccattaccagtttaacttaatctgccgctgccctgcccctcaatctcctcggacaaagttggcacgctctctgcactggctttgcactggctcttctcactgtccaggacttcctttccccagatcaacttggcaaattccttcacctgcttcacattgtcacttaaatgcaccgtcccaataagactcaacctgtccatcctgtttaaaattacaactcattttaaattcccaattgctctgatcatgttctattgttttccttcttccatagcaggtatgtgcgtatcacctaattatcacatcatttactgatttgttacacttatcatttttatttattggaaacaaatgctttctatttgactgtattaataagttccgggaggaaaggggtatttgtggatgcttcccaagtgcttagatcagtgcctgacacatagtggccactcaatacatatctattattgctgacttgcgactttcagtaaacatcacactaagttaacaacaatatcatatattaacacatgaggaatattccaaaaaatacagattttccgcctctcagaccagattgctgcttacttggtgttttgtttgtttgttttgtgttttttgtttgtttgtttgtttgtttgagacggagtttcgcccttgttgtccaggctggagtgcagtggcctgatcttggctcactgtaatctctgactcctgggttcaagcaattctcctgcctcagcctcccgaatagctgggattacaagcgcacaccaccacacccagttaattttttgtatttttagtagagacgggatttcactatgttggccaggcccagttaattttttgtatttttagtagagacgcggtttcaccgtgttggccaggctggtctccaactcctgacctcagtaatccacccgcctcggcctcccggagtgctgggattccaggagtgagccaccacgcccggccctccttgggatttttaaggtagtgcattacggtccatctcactcacctaccagcttcttcaaaacatcttcaagaaacaaattcccattttggttgaagattgcactttgacacacgcatttaagtataacagtatattctatagtaatttgagaagtcctgttggggttaaaaagcaaattctttatgtctccaatgtactttctccactatgatcagtggcttctcaagagtaactccttgaataagtcacacatttctgccagtttaataccagtcttggcttctctctgcctcaggatgcagccaatactcctgaatgtggctaagaaagtccttcataagcacgtttctgccattcctttagaatcctcttttgacacaattccctctcagcagaaacataaactctacctgaacctaccattttctgcctttaggttttaaatatgctactctctttgcctacatcacctcattcgctaatgcctactcaaccacttgatcacattccaagcttttagttttcttccttcccaaagacttccttaatccttcaagaactggataaagggttccctgagttctcataacttctcataatgacccgcatctttgcactgttccctccagtgagctaacacagtgttgggatgagggaggcgctaaagagacacttgccgaatgaacgagtgaattttctgaagaagcagccagtgaatcggagccggcaatttctctctcaacaatgctctctgctgtgccattcaacgaggccacaatgccattgtgtgacaatggtatgatgacactgcttgggccataacagaataattctccagataacatatgcacttgttatgcagctagatgcttttatgattgcttttggaggtgatgtggcaaataaattttttacttttataggactgctgacatctcacagaaatttttgacaaatattcaactcagatatgattttggttctactttatggatttcctgatcctttatatactacattttatttctttatgagcttactctgtttcatttttagccctcaaattcaatgaccaagataatgtaacagcatgagcacagaatatgacctctgctcagaagaattccatttccatgtaatatatgtacagggcttggtgaaggatgaagctgctcttcagcctccctctagttatcaactaacacagcaatttctgatgctttattatttttttcctgaatggctttttctgtagtacccattcatgccttctgatctaattagtataattagccttggacacataagaaacaaagcaacaaataaaaaagcccataaaattccatttcaataccctgcctttcatagactttatggaactaagtattcagctgtcttcatagctcataacctttaatcctaacatcaatctcagtgttctattcaattacaactgctgtctattgagaagtagcaaaggttttgaagagtttgtgggaacgtggaagttgccccattcattttcattagtaaactcaggagacacaaatttcactaaaattgctgacactgttcctgctgtgtctggatgatttattattagacttcatatttcttccaaaatatggtttaaggaactcaagaaaatcatgcgattgttttacctgaaatatgatgtaattttatcacctgtgcactaaagttgctgactgcaacttggacagaatagcacaaaaggctttgcatggctggagggaaaggaaataaagagtgagacccataaccagcacagagtacagcacggttagttcctatgacagagacaacagaggagaaggtgtatgttgtatttgtttttctgagacaggatcttgtatgttgcccaggctggaatgcattggcatgatcacagctcactgaagcttcaacctcctgaactcaagtgatcctcccgcctcagcctcccaagtagctgggactataggcatgcaccaccatgcctggctaatatttttttaaattttatttgttgtacagatgtggtctcacgatgttgcccaggctggtctcgaactcctggcctcaagcagttctcccacttcggcctcccgaagtgctaggattacaagagtgagctgccacacccggccaaagtgcacattttaaaaaggcaacttgctgcacctagaaaaatagaaaacaattgttatttaaaaaccaagtcatgaccttttgaggcaatatcccagcgctaaacggcaaatgttatcacttgtaaaagcaattaagaaaattgttaggctgtggtgacagtgtcactgaggagcttttaagagttattttcctaagaacaatatgcaagaccttgcacacctagcccagcttacttgtcacggcttataacccgaatgccatcccactgtccacacttaaggaacacagtgctggcccagcatccccattcccgggtgcactttaggaccaccttgggagctgttaaaaattatggctgggtgcagtggctcacacctgtaatcccagcacttcgggaggccgaggcaggaggatcacctgaagtcaggagttgaagaccagcctggccaacatggtgaaacctcatctctactaataatacaaaaattagccgggcatggtggtgcatgcctgtaatcccagctactcaggaggctgaggcaggagaatctcttgaacccaggaggcggaggttgcagtgagccaagatcacgccactgcactccagcctgggtgatagagcaagactccatctcaaaaaaataaaaaataaaaataaaataattatgcctaggacccagcccagaccgactgagtcagaatctcggcggggagcattccgggtgattctaaggtctgggctctgcggggagcattccgggtgattctaacgtgtgggctgtgctgagaaccacggctttcaccacatcgagcgactgaccttgctccagtcaaagaatcttttccccccttttgctcatgtcactccctcaatctgcttttatgcagttttggctttgtctctccaggcttcacttaaatgctgctttcctaaagcaatctccatattcttccagcttttcctaaaatccactcttggatcagctagatcagctgagaatcggaaaccggcgctgaactgtactagtatcctacagaagcttcttgacctctccgcatccaggcttccacatgccaccaccagcctatttgttcttacaatacatgacccagtcacattcgtcctgttgaggactctcactaactcagaaggtattttcaagcatgtggagtacattacaattttctcttcatggcaaatttccaggagtaatttcttctgattcttaaaggagtgacatttgtctcgagcaataaggattttttgttatcttgtggatgttaggaagcatgtaactaatccgttttctctttatgagtttgctgctacaaagtttaaagccaatctgtgacccactggtggaagatgtggtcattatctgcatgatttcaaatgatttctggctttcttttctatttccaacccacatttttcattatttgctgatggcaagtttaatttgtgctatcttgttgtgcttcccctactaatttattttaccttacattgtttattgaacaatatggtgcaaaagttaaattaaaagcaaatttctcttgagttgtttccaatatttgtgtcaaaattatcccctaatctgtgcttctatagtcttttcttttttcccagatcgcaaccctaatgttattctactttgcttcgtagttagctgtatctcctctttccaattctaagtatcttggaagataatgaacatatatcttatgaattttgctaaaatccataaaaaataaatagaaattggttaataagtgtttatcattgcttgctgctaagaatacagagctaataatacttgctttgaattccaagttcattatgcaccaactggagaccttaagcaactgaatctccaagcctcttttttctaattatgaaagaggaaaaatcgaaaatactgtttacctcacaagattgttaagatgccgaaataatttttgttaagttactttttaatggcgaaatacaacccacatgactagtaaagaaaaggtctagaaagcctcatctgtgacttccttatatacacatgtatacacacatgcgcacacacactgagtctcagacactaggggaaagcttcggcccatgggtaaagaggtaggcagaaatgagattcccgcgaggtcttcctagccaggacgaaagcttccagatcacaatctaagaacagtgggataccactgaaggattttaagcagatgtgtagtgaaattgcatatttcagtcttggaaagtgactctggcttttgtgctctagaaagcatatggatacggggaacgtgacagtgaaggaagcagggatatctgctaagcagctactgcaatagcaaatgggaaagcaagatcagcttaaggcaccctgacatcatgaggtagccacactgagatccaaagctatgttctttcttttttattattattatactttaagttctagggtacatgtgcacaacgtgcagctttgttacatatgtatacatgtgccatgttggtttgctacacccattaactcatcatttacattaggtatatctcctaatgctctccctctcctctcccctctccccataacaggccccagtgtgtgatgttccccaccctgtgtccaagtgttctcattgttcaattcccacctatgagtgagaacatgcggtgtttggttttctgtccttgcaatagtttgctcagaatgatggtttccagtttcatccatgtccctacaaaggacatgacctcatcctttttcatggctgcatagtattccatggtgtatatgtgtcacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatgctatttctagttctagatccttgaggattcgccacactgtcttccacaatggttgtactagtttacagtcccaccaacagtgtaaaagtgttcctatttctccacatcctctccagcacctgtggtttcctgactttttaatgatcaccattctaactggtgtgagatggtatctcattgtggttttgatttgcatttctctgatggccagtgatggtgagcattttttcatatgtctgttggctgcataaatgtcttcttttgcgaagtgtctgttcatatcctttgcctacttgttgatggggttgattttttcttgtaaatttgtttaagttctttttagattctggatattagtcctttgtctgatgggtagattgtaaaaattttctcccattctgtaggctgcctgctcactctgatggtagtttcttttgctgtgcagaagctctttagtttaattagatcccatttgtcgattttggcttttggtgttttagacatgaagtccttgccatgcctatgtcctgagtggtattgcctaggttttcttctagggtttttatggttttaggtctaacatttaagtctttactccatcttgaaataatttttgtataagctgtaaggaagggatccagtttcagctttctacatatggctagccagttttcccagcaccatttattaaataaggaatcctttccccatttcttgtttttgtcaggtttgtcaaagatcagatggttgtagatgtgtggtgttatttctgaggcctctgttctgttccattggtctatctctctgttttggtaccagtaccaggctgttttggttactgtagccttgtagcatagtttgaagtcaggtagcgtgatgcctccagctttgttcttttggcttaggattgtcttggcaatgtgggctcttttttggttccgtatgaactttaaagtagtttttttcaattctgtgaagaaagtcattggtagcttgatggggatggcattgaatctataaattaccttgggcactatggccattttcacgatattgagtcttcctatccaagagcatggaatgttcttctatttgtttgtgtcctcttttatttcgttgagcagtggtttgtagttctccttgaagaagtccttcacatcccttgtaagttggattcctaggtattttattctctttatagcgattgtgaatgggagtttactcatgatttggctccctgtctgttattggtgtataggaatgcttgtgatttttgcacattgattttgtatcctgagactttgctgaagttgcttatcagcttaaggagattttgggctgagacgatggggttttctaaatatacaatcatgtcagctgcaaacagggacaatttgacttcctctttttctaattgaataccctttatttctttctcctgcctgattgccctggccagaacttccaacactatgttgaataggagtggtgagagagggcatccctatgttgtgccagttttcaaagggaatgcttccagtttttgcccattcagtatgatattagctgtgggtttgtcataaatagttcttattattttgagatacatcccatcaatacctaatttattgagagtttttagcatgaagggctgttgaattttgtcaaaggccttttctgcatctattgagataatcatgtggtttttgtctttgggggcagtctgtccgttctcagatctcaaactctgtgctgggagaaccactactctcttcaaagctgtcagacagggatgtttgacgttctttcattttaaagttattatataatcatggattcatttgtctctttggaagcatcttctctgtataagtaattaaaatattttcaagcaaagtactttcacagttctgcaggctgtgcaggaagcatggaagcttctgtttctggggaggcctcaggaaccttccaatcatggtggaaggcaaagggggagcaagaaatctcacatggtgggagcagaagcaagagagaggtgggagagggaggtgctacacacgtttaaacaaccagatctctggcgaattcactcactaccatgaagacagtatgaagaggatggtgctaaaccattcgtgaagaatctgcccccatgatccagtctcctctcacgtggctccacctccaacattggggattacaagtcaacataagatttgggtggggacacagatccaaagcatatcattctgctcctggccctcccaaatctcatgtccttttcacatttcaaaacacaatcatgcctttgtgataatccccagagtcttaactcattctagcattaactcaaaagtccaaagtctcctctgagacaagactagtccctcccatgcatgagtctgtaaaatcaaaaacaagttagctacttccaagatacaatggaggtacaggcattgggtaaatactcccattccagtaggaagaaattggccaaaagaaagaagccacaggccccatgcaagtctgaaacccaacagtcattaactcttacagctccaaaatcgtctcctttgattctatccctcacatccagggcacactgatgctaggggtgggctcccaaggctttgggcatttaacttctaaagctccatatctaaaattaaagatgaatggataactttttactatattagtttttattcttaatgtatttctctttttgtgttttgttttgttttgtttgagacaggatctcgctctgtcaccatggatggagtgcaatgacatgatctcagctgtctgcaccctccacctcccgggctcaagcaatcttcctgcctcagcctgtcccaagtagctgggacacagggcacaccaccatgcccagctaattttttgtattttttgtagagacagggtttcaccatcttgcccaggctgggctcaaaccgttaggatcaagcaatccacctgccttggcctcccaaagtgctgagattacaagcgtgccatctctcctggccctaatttctctttataaaatcagattttgttggaagtatcctgtttgctaaaaccttgatatctgatgcacttagcatagaaatcaggctggaaaaacgaatttgtaatagatatctaaaactaaaaaatgtaagagtcagaagcttaaatttttacctctttttggacggatgtttttctaaaataaacattttcctgccttttcaagtaaaaacattgacaataataaaaatgtcccttaatcatcctgaatcattagatattagttttattcttcatgtaattgactcagtggtgtttaggactagtggtctctaacttcaacaagtgtgggatggtccatggcgtgaaaagagggatagggtttgtctgaccctctctagtggggatgacccacggcctttgctgatgcctgaagcctacagcaaggcaatgtgtacaaacagtggcttcaccttccagaacattttctttctctctgttcttagtagttttgacttgtccacaccattcaagctaagtgtcctttataacaataaagttgaaactagcaaaaacgtccaactctgtgtggttcattaaatactatactgttgtgagcaaggatgtaatttttgtcagggatgggcttcccccatgccccctctaagattacataatacccaaaattacataagattacacctaagattacataatacccaaaagaaagggtagccctaaaatagtgatgctgaggagatactagttacatgaaaaatgatcacaaaaacaataagaactcacatgacagatttttcacttttaaaaatgtattttacataatagtttgatataaatacattctatgggagaataatatatatatttatatcaaatatttaacgtctagatttttttaagttaaaataacctccttgagcacccagttacactttctttccttccatatcttctttcgattccacttccctgaccatatgtgagcactgtttgtgctttccaaacattttcctagacatcagcacacacacacacacacacacacacacacacagttcaaatataaaatgctgctttttccaaaaatgtgatcatatcctattaaatgacctgccttttttccacttatctgtgaaaactttttatgtcaatacatatatatatgcattatatatatgcattttatacacacacacacacacacacacacacatatatatctgcctcggtctttttaattgctgtggtgtattacatatcatgtgtaccataattttttttttgagatagagtctcgctctgtcacccaagctggagtgcagtggcatgatctcagctcattgcagcctcttcctcaagttcaagtgattctcctgcctcagcctcccaagtagctgggattacaggcttctgccaccatgcccagctaatttttatttttagtagagatggggtttcgccacgccggccaggctggtctcgaactcttgacctcaagtgatctgcctgcctcggcctcccaaagtgctgggattacaggagtgagccaccgcccccagccttcagacagtatatatttttgttaaatccaattcttcactgttaaagaatactattttacattaatctttgtatatacatgtgactataatgaatatcctttgtacataatatgtgctctttctccctactcatacgtaaaattactgggtgaaaggttacattatatttaaatctgacatatacttgcaaatgccccaccaaaaaagccctgaaatttgaattcccactatcagtttttgaaagttcctattctcttacctcttcctccatgctgaatattatcagtctttttcatttgtcctcatctcatgaataaaaattacatttgtcttaatttaatctgccttattaactagttttatgtgatactaagtataattttctgtcattacatgttttctatcagatttgttatcttttattgatctttatgtgcttgatattatcatagagattaatgctgtattgtaaataattttcccatgatttttcattgtactttttcatgtgggtttttgacatagatgctttagatttttatatagacatatctgtcatttttttctttatgaattcttagcctatgtttagcatagatttttccaatgttgagattaaaaatattttctattctcatgaaatttcctttaacattgttataattttgtaatctatttttatctctataattcatctgtagtttttctggtttgaggtgggaatctacccttaattttttgtttgtgtcaattgataaccagtagtctcaatcataacctttccttattgacttgaaatataatgcgtaacagctgccaaaatgtataggtctataccaattttcttctagactttctattgtcttcctttcatttatttattaatttttgtaccaatgctgcagtattttaattatgtttgtcttgcagcatattctaatctctggtaggacctttccttttactatttaatttttttacttttacctcccacctcaacgtcctgagtagctgagactacaggcatatgccacaacacctggctagttttgtttgtttgtttcgagctcctgtaaaaataataactattatttattggaaaatctctacacctcagggactatgtgaagcatttttacatgaactattttatttaatcctcataatggccctctgagaaagtgtaatgagttgaatgatggccactcagaggatatgtccatgtcctaactgctagaacctgtggacgtgacttttgttgggaaaagagtctgatgatgcaattaaggatttcaagatcatatcatcctggattatccaggtggatcttaaatccaatgacagttgtccttataagagaaagtcagaaggagatttgatgcagaggtgattgtgtatttagaaaccccatcgtctcaacccaaaatctccttaagctgataagcaacttcagcaaagtctcaggatacaaaatcaatgtgcaaaaatcacaagcattcctatacaccaataacagacagggagccaaatcatgagtaaactcccattcacaatcgctataaagagaataaaatacctaggaatccaacttacaagggatgtgaaggacttcttcaaggagcactacaaaccactgctcaacgaaataaaagaggacacaaacaaatagaagaacattccatgctcttggataggaagactcaatatcgtgaaaatggccatagtgcccaaggtaatttatagattcaatgccatccccatcaagctaccaatgactttcttcacagaattgaaaaaaactactttaaagttcatacggaaccaaaaaagagcccacattgccaagacaatcctaagccaaaagaacaaagctggaggcatcacgctacctgacttcaaactatgctacaaggctacagtaaccaaaacagcctggtactggtaccaaaacagagagatagaccaatggaacagaacagaggcctcagaaataacaccacacatctacaaccatctgatctttgacaaacctgacaaaaacaagaaatggggaaaggattccttatttaataaatggtgctgggaaaactggctagccatatgtagaaagctgaaactggatcccttccttacagcttatacaaaaattatttcaagatggagtaaagacttaaatgttagacctaaaaccataaaaaccctagaagaaaacctaggcaataccactcaggacataggcatggcaaggacttcatgtctaaaacaccaaaagccaaaatcgacaaatgggatctaattaaactaaagagcttctgcacagcaaaagaaactaccatcagagtgagcaggcagcctacagaatgggagaaaatttttacaatctacccatcagacaaaggactaatatccagaatctaaaaagaacttaaacaaatttacaagaaaaaatcaaccccatcaacaagtaggcaaaggatatgaacagacacttcgcaaaagaagacatttatgcagccaacagacatatgaaaaaatgctcaccatcactggccatcagagaaatgcaaatcaaaaccacaatgagataccatctcacaccagttagaatggtgatcattaaaaagtcaggaaaccacaggtgctggagaggatgtggagaaataggaacacttttacactgttggtgggactgtaaactagtacaaccattgtggaagacagtgtggcgaatcctcaaggatctagaactagaaatagcatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtgacacatatacaccatggaatactatgcagccatgaaaaaggatgaggtcatgtcctttgtagggacatggatgaaactggaaaccatcattctgagcaaactattgcaaggacagaaaaccaaacaccgcatgttctcactcataggtgggaattgaacaatgagaacacttggacacagggtggggaacatcacataccagggcctgtcatgtggtggggggtggggggaaggatagcattaggagatatacctaatgtaaatgacgagttaatgggtgcagcacaccaatatggcacatgtatacatatgtaacaaagctgcacgttgtgcacatgtaccctagaacttaaagtataataattaagaaaagacttagaaaaaaagaaaacgtgctacatatatgccatggaatactatgcagccataaaaaaagatgagttcatgtcctttgcagggacatggatgaagctggaaaccatcattctcagcaaactatcacaaggacagaaaaccaaacatcacatgttcttactcataggtgggaactgaacaatgagaacacttggacacagagtggggaacatcaaacaccggggcctgtcgtcgggtggagggagaggagagggatagcattaggagaaatacctaatgtaaatgacaagttaatgggtgcagcaaatcaacatggcacacgtatacctatgtaacaaacctgcacgttgtgcatatgtaccctagaacttaaagtataataataatttttaaaaattaaattaaaaattttctattcagtaatatagacactagataaaagacacaaactatcttttaatgaatggctggtctttggaaattgtaagggaaagttccaggggcctacagaaaaaatagtgagctgaaacaagacagtgcctccaaactagaagacttcaggaagggtatatgattttgtagtctgggctcaaatagtttaaggtagaactttctatccaggaacttgttggaactggacaaaccttgtgacatgtgtttcgggactggtggagaaagcaaggcaaggtcttttagtattgatgaacacaatgttttggtgagaatcaagctgtttttcctaataagcaaaggatttttttctgacaaacaaattatttgcccacataaattgatttgaaataatttcctaaagcaagtagtgaagttatttattggtttgcagacttatctttctggggaatgaatttcccagagaaaacggtaaagttttattaacagagaaaataagaaaattgtttgctcttccatcacatttaaaataatatatatttaggcccagatgtagtgcctaacacctgtaatcccaatagtttgggaggtgaggagttcaagaccagtgtgagcaacatagtgagacccccatctctaaaacaaacaaataaaaacaagaatacatatctaaactggtgggaataaaaataatgagaatacatatctaaactggtgggatgcagccaaaagcagactttaaaggcagactcatgcactcaaacgcagcgacgaggccaggtgcagtggctcacgcctgtaatcccagcactttggaaggccaaggcagaaggattgcttgagtccagaagttcgagaccagcctgggcaagagagtgagaccctgtctccacaaaaaaaaattaaaaaataaaaataaagctagccgggtattgtggcatgtgcctgtggtcccagctactcgggaggttgaggtgggaggattgcttgagcccacaaggttgcggctgaaatgagccaagtttgcaccactgcactccagcctcggtgacagagcaagaccctgtctcaaaagaagccaacaagccaggtgtggtgcttcacgtctgtaatcccagcactttgggaggcaaaggagggtggctcacttgagctcacatgtttgagaccagcctggacaataccgtgaaaccccatctctacaaaaaatacaaaacttagccaggcatggtggcgtgtgcctgtagttccagctactcaggaggctgaggtcagaggatggcttgagcctgggaggcagaagctgcagtgagccaagatggtgcaaatgcactccagcctgagtgacagagccagaccttgtctcaaaaaaagcaaacacaggaacaaatacagagatgagaaaagaatcagagactgtaagtaaattactttaaatgtccaaatttagaagttaagtgaagaagaagaaataacctaaagagagtaaaagaaagaagataacactaaaatcagaaattaataaaatataaagccaagatataattagcagagacagtggggcaacactaattccttgagaagactaataaaataaaattgtttttaactttattaatattagtaagggggtagcgaaacaacaaaaagaaatataatgtctgggtagtcccatgaccattaggaaatgtggaatttttgagaaacttatcacaatgaaaaaattagactcaaaaggctttttgttttgttttgttttttgtttttttactgtggtaaaatacgtaagaaaagttaccatttggctgggtgcggtggccgggtacaggatcacacctataatcccagcactttgggaggctgaggcaggcggatcatctgaggtcaggagtttgagaccagcctgaccaacatggagaaaccctgtctctactaaaaatacaaaattagccgggcgtggtggcacatgcctgtaatcccagctactcgggaggctgaggcaggagaatcgcttgaacccgggaagcagaggttgtagtgagccgagattgtgccattgcactccagcctgggtgacaagagcgaaactccatctcaaaaaagaaaagttataattgaatcctttttaagtgtacatttctgtggcattagacacattcgcattgttgtgcaagtataccaccatccagaacttttccagctctcccaactgaaactctgtacccattaaacaccaactcccaacctcccgtctcccagcctctgacaacccctattctactctctctatgaatctcactactctaggaactttttatgaatggactcctgcaacatctgtgcttttgtgactggcctatttcacttagcataatgtcttcaaggtatatccattgtgttgtggcatgtctcaaaatgttctttcctttaaagggtgagtgatattccattatctgtatattctatattttgtatatccatgcacctgtcagtgggcacttgggcagctttcaccttttggctattgtgaataatgctattatgaacatgggtgtacaaatatttgtttgggtccctgctttcactttttttggatgtatactcggagtggaattgctggatcatgtggttattctgtgtttaactttttaaggaatggccatatagttttccacagtagctgtaccatcgtacattcctaccaacagtgcacagggattccaatgtctccacttcctttgaacacttgttattttctgggttttgatagtagctatcctaatgggtatagagtggtatctcactgtagttttgatgtgcacttccctaatttagtaatgttgaacatccttgcacgtgcctattgattatttgtgtatcttcactgaagaaatgtcaatgtgtgttctttacctatttttaattaggctgtttgatatttgtgttgttgagatgtgggagttctttatctattctgtatagctatcaatctcttattagttatatgactgacaacgcccagagagctttaaaggcaagttctaccaacttttaattgcaatcttacacaaattagttcaaagaataaaaaaaatggttaccctgaaactcattttataaaggatgtatccatcagggtttaaccagagaaacaaaatgagtaggagatgtacacttagaggttgattgcagggaactgacttacatgattgtgggcgctggcaaggcacatcggaagtccacagcacaggccatcagaaagaggagggtgggattttaggggtgaactgaaattgctgtccataggcagaatttatgttttctcagggaagcctcagttccgctcctgaggtctttcagctgattgaatcagtctcacccaggataatctagaatagtgagacaataaatattttacaataatcttcttaagtaatgtcgactgattgtagaattcggtcacagccacagaataccttcacagcatcacctgatttagtgtttgatggaataaccgggtaccagcgactggccaagtggatatgtgaaactgatcatcgcaaaagtcaaacaacctatgcaaaggccagaaaatgacagtttcaaaaactagcagccaattttagtcactaattcagattagaaatccccccgcaaaactacacataacaataacaaaaaaggccgggcgcagtggctcacgcctgtaatcccagcactttgggaggcagaggcgggcggattgcctgagctcaggagttcgacaccagcctgagcaacattgtgaaaccccgtctctactaaaatacacaacaattagccaggcatggcggcatgcgcctgtggtcccagctactcaggaggctgaggcaggaagaattgcttgaacctgggaggcgaaggttgcggtgagccgagatcacaccactgcactccagcctgggtgacagagcgagactccatctccaaaaaaagaaaaaaaaaaaaaaaaaaagtaacaaactagatccagcaatatgtgaaatggaaaaaaacaagtccaaaatataaatatttatcttgtatgaaattctagaactaaaaaacatttgaccccttatctctttaaattgtacttcaaaaaatatataataggggctgtctttataatagagtaatatgtttattgtatctgttttgaagatatactctgaataatcccttgttccacagttcaaatctgaggtaacactgaagacagaaaacaatggtgacattatccccactcccttaaggccagccctgcaatgatccggcattggaaatgctgctgctttacttcactaaatgatactttgttttgcaatttactgtgaattacatagcttaatctacgcaataacaatcctgaaaaaagaaatgtttctggtttatttctggaatttaaatgaaactggtgcttttatattcatatttgtgttaatgttttctagcatcaaagtacaaatccatttatcctttttaataatactcataaacatgaatatctgaactaaaaccttcacctataaaattagacaaatgggggaaaatattgtaaaagcaataatagttaaagagatattgaatttggctgggtgcggtggctgacgcctgtaatcccagcactttgagaggccgaggcgggtgaatcacaaggtcaggagttcgagaccagcctgaccaacatggtgaaaccccgtctctactaaaaatacaaaagttgattgggcatggtggcgccttcctgtaatcccagctactcaggaggttgaggcaggagaattgcttgaactgggacccgggaagcggaggttgcagtgagccaagatcgcgccactgcatcccagcctgggctacggagcaaaacttcatctcaaaaaaaaaaaaaaaagatattgaatttaaataggatttgtcttctcaataactaagtttattattgccaaagtggtattttagttgaagaattagaataagaagaattcaaactaaatagggcaataattgtctagaatactgaaagagaaaagtgcttattcaacaaatatttatggaatgatttttcttagtgttaaggacaacagattacagacaaataagatataattctctttttaaagatctcacgagtctaataataatctaaagaccagcatataaacatacaatcatattactatgtaataaatggtataaaaatatgcacagggtgttataaaaacatgatcatgtgggaagaagataaatcagtagcaactcctgaaggaaatgataccaaatctgtatcttgaggagaaatcacccgctagctcagtgggaaagtgggagacgttccacacaaaaggaacggtttgaaaatgagaggaaagtggacgctggagaaaattttccaaaaacattttatctctgtagaattgggtatgtgtggcgttttccaggcaaagtgtttaatcaaatggattttctgaagattgttaaactttctgtttatgttatgctaacaaagaatgcagtttcccaactgttccacaatatactacttactgagagggtgtctctccttatttctctcgtggaactagtacaaggttaaacctaccattttctgtagtgggcacccagtaagttgtctcactcccctgggaactgcactcccttcccctcccattctaatgcggctcacaggtgctactgtgttctttgaaaacccaaaaccctggccagaattcaaagacagcagtatgggcaactgactgtagccgggctaatcacaatacttcagtccttgtcgactggatttgcgatgggaacttaggctaaactgtatcaagaaagcccttttccagatttgtttgtttggaacccaaaaaaatcaagcaaatgcctttctcgtgtctgaagctctacagttttcctgtgagcataaacacagctacatagagagaatgaacttacagagacagaaacagaagaaaagaatgccaggatcagcttcatcccacaagacggaagtctattccagcaggaaacatctggagtcttcccttaaacctcccttttttaaatgttgtgagttttctttctttagctttattcattcaactagcaagcaaaacctctgaacatccagtttcaaaggtttctgccaaatgccctggctgtttagcttttctttcccttccctcattctgtctagctacaatcctcttgacaaacagagaagaaaggactggggtcacacgggagtagatgttcatttattacaagggtaataatgaaatgaatgatgagaataattataacttacatgcccatactcagaaatgatatgagctaaaaaaaaaaagtgaaattgtcagaatatgttctgtatgaacagttacccttccggttcttggggaactagcagtcacccggtgactagcctttggttgctcagagaacaatattgtaattctgtaatgaattctgtaattataatattgttctctgagcaagcaaaggggagactaaatgtgtatggtctccttggaagcatctcaacttctaatcatttaaaaattttacttcctcactgagaatgtaacctgtttgtttcccagtctttcgaagtgttaactgtctatctgctatgagccagttaatataatacatgtcaaatttaatgtgctaaccttgtactcaatataggagagacaattaaggttctccagcagcagtaagacattctctgagacagcaacagcccagtcaatgtcagctttcaagctggtgctggcctgatgctggctaaccacctgagagaaagctcgccaaggagaggtccacagtgggaggcaggtcatatcagatagcctataagcttttctcctactttcagataaagactcaaatatttattgattggcatatattttataaatatatatatagctagagagagagagagaatgttactacacaagggaacaatttatcaaaaagctgtcctgaaatcttcaaattatgcaaaggagctggattaactttgctggagcctaggatcaatcccacccaggtgacgtgtcctacactcagtgagaaatttttatgataatcttgtttcgatcattataattactggaaccttaataacaatattcaagtagtattcatctcttattacaatgcatgactggggtgctttaattggggcaaaaagacttgagaattctgaacactgtctctgtattgacggttatgtacagcttcttgcatgccatcttccacaataaatagactggatttaaagttatttataatctcaacttatagttccttcattctaagaagctagtaacaatacttagctactctagttataacaaaataaccttcatgctggtcaattctatatgctcttttttccatctttgcttcctttctatattattcaggactccttagacagcgcaggatagaaatatacattaaaccagttcaagcaatagaatggaagttggttggtttgcaggactaaaaggaatactgatgaagctcacaaaactggaagaagccctgccaaaaatcgaggcttggaaggcagagttcagtatggccaggagctgttatctggtgcatccacctcacatctctgcttggctttatgtagattgactttttccaatgacaggaaaagcgagtgctggtgacaacaaatttacagtctcccagctaagcaacacagaagaaagatgcccggaaaagccctggctggccctggttggcctgaacgcccaccccgtaggccgataattgaggtcggtgggatgcagtcatattcctcactaggctattttgttgggggcaaaatgctctggggataagactggggaaagatgcatatcgtacagggaaactagaagcaatacatgaggccaggtgcagtggtgcgtgcctgtaatcccagcacttcaggaggccaaggtgggaggctcgcctgagcccaagagttcaaggctagcctagctggctgtggtggcatgcacctgtggtcccagctactcaagtagctgaggtgggaggatcgcttgagctctccaggttgaggctgcagtgagctgagatggcacctctgcactccagcctggatggtagagtgagaccctctctcaaaaaaaggaagaaaaagaaaagaagcaatgcatgagggcagtttaagagctatcatcttggccctataatactgctcaaaatacaatctttgtgcacagaggtttgatccattggcttctgtggctttattgcctccaacatatctttaccatcgtgtctgccattggatatagattgctgcaattttctgtcccatcaaaacaaatgctggtttcgctgcaccctttccacagaaatgaatatcactggaaacttgaaatggtgtatgagagattctacaaccctttgccactttcggctgctcattagaaatgaaaaggggcctcttttatgcagtactctggcacatcaggtataataccgtgaatgttcttccagcacgagtagcttaggacattaatgcttaaacacatcatgctcagtatcttgtgggtaatattcaagtttaatgtaacatctcatttgtggctgtctaattgcatgacattttccatttctttcctcagttaatactgtgatacagagtgtcttctttttatgggacaatctctcctctaaactcatgaacaatgtgcttattgtttgtgttaagataatgcttttccctcccagctgtaacattccgattgttttattctacctcggaaggcctaagatgacctcttcgcgtgcagatctcagtccttcgctgtctgcggacctgcctaccctttgctgccttatgagagacttgaccttcaacgcctcgttagcattatgggtctctagtccaccaccagcatctaatccccaatagcttatctttgccattctatgacctagtagctgaactttctcactgtggctgccctaacagagctaaactcttgacaaacccataaagcaattgatttttttgtttggttttgtttcttagtggttctctgcttgaaataaagacatttaagggtattcatctttctctgtccaaaagcctagccactccgataatctcattttaaggccaggcacagtggctcatgcctgtaatcccagcactttgggagactgaggtgggagaatcacttgaggccaggattttgagaccagccagggtaacgtagcaagagtctgtctccagaaaaattaaaaattagctgggcactgtggtgcacacctgaagtcccagctaccctggaggctgaggagggaggatcccttgaaccaggaagttgaagctacagtgagctatgatggcaccactacactctaagcagagtgagaccttgtctcttaaaaaaagaaaaaatgaaaaagaaaaaaaaagaattttattttaaacacccttgttacaacatatcaacatatttttgtattttgtggtttttaacctccttttgttgccgcctactaatagatttaaaaagttctggtactgtgatcaaaattccttagagaagaagaaataaaccaacgctgtttacttgtaaatccactttgcaaagggagaatgagaggatacactttaaggacttagaagaaaaaggcaataattatgtttgttttacatcagcatttaaatcaaaatgaaaatgttgctttcataaaaaatgaaagcaataatgttttaattaacgggaataccaattcttctaaaaataaatatttttctgtaattactgttaatttttttttctttaataactttcttagctcagaaaggagcacagttatatgctggatggtttataagcacagctttaaaatgtcatgattttttgcagcactgtaacctacaaaaaaaaaaataataaattgtattgacaaggttttcatgcttaaacctacattttattgtaccattatccctgaacaaattgaggcacaatatttcattagactggacagatacattattgaacatacaagagaatattaaaggccattcaatagttttagcaaagaggatcagtattaggttttgtaagtttgtgtaaaagaataccttctatatcatggctatatcttttatattaggttagttttttgttttgagacagtcttgctctgtcacccaggctggagttcagtggcgccatctcggttcactgcagcctctcccacctggattcaggcgattctcccgcctcagcctcccgagtagctgggattacaggttcccaccgtcacatccagctaatttttgtatttttagtggagatgaggtttcaccatgttggccaggctcgtctcgaactcctgacctcaggtgatttgcccaccttggcctcccgaagtgctgagattacaggcgtgagccactgcacccagccttaggttcatttttaaaacacctaaaatgaatttattttaaaggaatgtattttaaaggtatttttttataaggactttaatatttagagtcattatatttagaaaagaagaggttcatactcatatttacaaaatacatctcagaaatggattctgagacagttctaacaactgttctatgaagttatatattacttattataatagatggcatacaatttagtgacagtaaaatatctgggattgaaattccacccaaacactcccccattttctgccattagagatgttcatttgtcacagagaatctaaaggtttataggacttttataagaggaaaaactgaatatttcatgtaaatattaatcataactaactggagtggctatattagtatcagacaaagtagacttcagaataggtaatattaccagggataaaaagggacattacatgatgataaaaagggtcaattcatcaagacaaggtagcaaccctaaatatatgtcaactaattatagagcttccaaataaataaagcaaaaattgataaaaatgaaagaagtcagcaaatgcagttgttactggagacttcagcactcatctcagtaattgatagagcagacagaaaatcagtaaggatatagatttgaatggcagtaacttgaccaacctgacctaaggtgtctgggtagaaggttccactcaatgtcaaaatacacatacttttcaaacgcacatggaacatgcaccaagatagatgagcagtgcctctccaactgtggtcgggtatttaaacctaaatgttcaatactgatatgaaaagtatttgttcactggacaacagcaaccgatgatggatatccttggattccagttgtttctaccaatcttgacctttactcctttgcttccaagtggtcttacaagtaaagcaaatctcagacatgcttggttgctccgacagatatctaatagcaagtaagcagtaagacagccatatagcctcttaaccactctcagtcctcagatgccctgacaagcacatcaaacaaaaggttcactccaaggcagatgcaatgatattttgttgataggatcagaaaacttcctgaggttcaatagtcatccattgagggtgggatcacaggattgaagggagcccgaccccaagggactacttggatgtgggtcttaaacaggttcttataactcctttcttcaagggtagtagagcctgtaaaacctctctttcccatcacatgtctagaagtttgctaatttcaccaatgaaatcatttttcctctattccttgtgctaattcacaatgcctgtggtttagatttagacatcaatatttgaagtcttgctgagtctacctctcaagtgtagattgccaattgaggcagttcaaatgctaatcagccatctataaggtgtagattaaagttaattcacactgacacatatgccacactctatactaattatcaatacattccatcagatgaatcagcagtatataaatcagtatgctaaaatatattaaaataatttaaatcaatttaccaaaaaaaaaaaaaaaatctcagagcagtcaaacaaatttatgttagcaaaaggaaatcagaaatcatgagattttcaacaaaccaacattggggtaaaaaattttcttttcacattttttttttttaccatttcttaataattattctctaactaccactctagtttttctaataacaaagagcaaattggctgtctgtacgcaatagaacttacctttttttcttttattctttttttttttttttttgagacagattctctctctgtcgcccagactggagtgcagtggtacaatctcgcctcactgcaacctccacctcctgggttcaagcgatcctcctgcctcagactcccaagcagctgggattacaggctcacaccaccacacctggctaatttttgtatttttagtagagacagggttttgtcatgttggccaggctggtctcgaactcttgacctcagatgatctaccagcctcggcctcccaaagtgctaggattacaggcgtgagccactgcgcccatcctagagctcacctttttttaaaacatgtattacaatgctgtgtttgataaaggcaataaaaatgtttaaatcaacatttgtttgacagtagaatttcaattatcttaattttaggagtataggaaaaacattctcattgcaccatgtacaaaaaacatcctattaacataggacatattgttagatgcaatagggttttatcaatttttttttatttaaatcatggacggttacatcattaaattgtattcactggattgaggcgttgaagaacttgtaacctcccacatcccaattttaacacctgctctttgctcttcattttgtgtatgccaaggttagttcatcattcaacttccacagcgacttatctatttataatgcttggcaaattttccaaggatttcctctagtggtacagtaaaatatgctatcacaggcctaatttttctttgaaggcttctattttatcttaaaaccccgtgtgacttttgtatgtaaatacacaatgtcttcttcgccagaaccaccgggttggttgccgtctgagctgtgcctcctcgtcaccgccaccgctatgcctggaggtcggcttcttggggacgtggctcccaactttgaggccaataccaccgccggccgcgtccgtttccaggactttctgggaaactcactgggcattctcttctcccaccctcgggactttaccccagtgtgcaccacagagcttggcagagctgcaaaactggcaccggaatttgccaagaggaatgttaagttgattgccctttcttttttctttctttttctttttctttttttgagacggagtcttgctctgtcgcccaggctggagtgcagtggtgcactcttggctcactgcaatctcggctcactgcaatctctgcatcctgggtttaagcaattctcctgcctcagactcctgagtagctaggactacaggtgtgcgacaccacgcccagctaatttttgtatctttagtagagatggggtttcaccatgttggtcaggctggttttgaactcctgacctcgtgatctgcccacctcagcctcccaaagtgctgggattacaggtgtgagccaccacacctagcggattaccctttcgatagaccgtgttgaggaccgtcttgcctggagcaaggatatcaatgcttacaatggtgaagaatccacagaaaagttaccttttcgcatcatccatgataagaatcgggaccttttcatcctgttgggcatgctggatccagcggagaaggatgaaaaggacatgcctgtgacagctcgtgtggtgtttgttattggtcctgataagaagccgaagctgtctatcatctacctggctaccactggcaggaactttgatgagattctcagggtagtcacctctctccagctgacagcagaaaagagggttgccaccccagttgattggaaggtggggatagtgtcatggtccttccagtgattcctgaagaggaggccaaaaaacttttcctgaaaggagtcttcaccaaggagctcccatctggcaagaaatacctccgccccacaccccagccttaagtctcttggagaagttggtgctgtgagccagaggacatccgctgccaatcatgttttcctgctgcaattccatgaaaacatcctggtgtcatcacaccaaggtttttaggttgctatactactggcttattaaatgaaaactggcactaaaagtttcttgggattctttacactctgtcttcaccagcattcaattctgttcatacatcagcactctctactggttctctttgaaatatgttctgtatttaaaactcaaatcttgttggatctctgcagggcttgtgaccaatgaggtcatatttgttgatggttgagaaagcttgcttccctccatcagagaatgactatccctccatcagagaatgactatcaatttttttaactgtcctattacatcctgtcttcagtcacccattttgaagagtggcagaacttgaggttcaactcctctgtaaatatccaagtataaaacccaggaacttagagtaacccagatgttctttaatactgtttggatcatagccgggggaaaaaaaactttttaattctgtacctttctagtagataactgaagaacaagggaagagacctttaaatattttgctataaaaaaatttttttgtggccaggcgcagtggctcacacctgtaatcccagcactttgggaggcagaggggggtggatcacgaggtcaggagatccagaccatcctggttaaaacggtgaaaccccgtctctactaaaaatacaaaaaattagccgggcgtggtggtgggcgcctgtagtcccagctactcaggaggctgaggcaggcgaatggtgtgaacccgggaggcggagcttgcagtgagccgagatcgcgccactgcactccaacctgagcaacagagtgagacttcatctcaaaaaaaaaaaaaaaaaaaattgtgataagtttctgtcaaaatggggagactgcagaaaaggcttcccttggcttccaaggaggtgtagcaggggtgagcaatcctagtgccatgtgcctttcacacagggtttgcctttatcagtctgctttctgatgacgtgtacatgaaagagtacaccatgagacaggaagagagaatgactgaaaatgttttattgtagaactcttcttgcagtaggttttgctatgttctggattttactttttagggaacaacaaataaaatcctttgttaaaactgaaaaaaaatacacaatgtatcaatgtctattttgacgtaaatgttaatatttaaaattgcggttgcctaaatcactttcagtttctgtatgtgttacccaaactaatttggaatcaggaacttagaggatacttctaaaaaagacatgagaggtcattgtgaaggatgagaaatgttccatgaactcactggtttttactggtagccctaaggggccgtatcattctgtttctcaatgcctgtctcagtaagaagcagaggaattttgtaaataaatatttgctccatcaatagaagcaggattaattctatatggaacaacccagtgcatgcaaggatctgtggagtttcctttattcctaaaaagccagtctgcgggcactgtctcccaggtttagacctggaagttttagaaagctatgaagtctcccactgtagaaaatagaactgtttaatgcaatctgttgctcttttgtgataaattgccttcttggaagcaaagcaagagacacctggatgagggactacaaaagctgcagaagacaatgtaacgttagttgcccttgggaagaaaactagatgacttgaggtcaagggtaaaagacttccttttaccattgaccttgtttcattttactgtttgtaccatttacatgtattatcccttttagaaaacagattcataataattttaaaataagttattttgtgacttcagaaaagagcagcaaataacatttttgtctcatttatcataatttaagccttgagggtctcacccaggcagctctgatggagctcaaagtccagctaaacaaagcttctatgcctgacactgcttcacaattgagcgtccacacagtcagtccttgcagcagaaatgagagaatgtatacaaatggaaaggttggggtcaagggacccacagccttgaacaagctccctttcgtgagacagagaggggacagaatatataagtatttactcatatatgcagaaacagtccttggaaattatggatgcctaagacctacagtaactgacattatattcacagcactgggttgcatttaataagtggaaaccaagcataatttgcttttcaacttacttatattcattgaaggattatccaaattagcaaaaggagcatccagtactaaattaaatctattaatgcctaccacaacacacacgtatttgtttgagatagaggttaggccgtgatactctaacttctaggtagaggctttgcagtattcttttcttcccttgtagaaatggaggatgagttattataggacattcatcagaatcagttctagagccttcaaacagaaactcaaaaactataagtgaccttttaatagtagaagaaaagtaggacaatattctctctctcctcacactcctctaagtgagcaagaactttcaaactgtggccacttgtatcccctgaagtaggcctcttcatgtgatcagttgttttgtggggtggagggttgtattcatacacttgctcagattagctctatgcaacaaagctagtgaaactcattgcgttgatcttagacatccatccacctgccggctctgttgactaacccatgtggctgtaggttggtgttacggatttgtaaattaggcaatcctaagacatgggtgctaataagacgtagttgaacttgggctgccttcccgtgctggtattgagaaagcgctgtagccaagactcaggttcgcgacgtttacgcccacgaagactcgggttcgccatgtttaccctcacgcatctacaacagtcctggatttttatggatcactgttcgcaatgtttacactcacgcatccacaacagtcctccatttttacggatcgcctggattttattaaaatgcagattctgattcagcaggtcgagggcagggtctgcatttccaacaagatgatgctgacacagctgggccatgacccacacttttagcagggctgagcccctcagatggtgtctggctgcagagactttcatacattttgaaatttcaggcatgagattttgaaaatttgaatacatgtaactatactacctatccaaaaaatagcaaaagttatacaagtgaaataatttttgttgaaaccccagtattctctaagagtcaggcagctgagtgaaaacatgggtaagatgagcagtaacaggccctctgtaggaatcttgcctttgagttggaagctttttatcatgctcatcaagaaagtttcctctcctagcacctctgcccagccgccccgtctgggaggtgtacccaacagagacagcgaccatcgagagcgggccatgatgacaatggcggttttgtcaaatagaaaagggggaaatgtggggaaaagaaagagagatcagattgttgctgtgtcagtgtagaaagaagtagacataggagactccattttgttctgtactaagaaaaattcttctgccttgggatgctgttaatctataaccttacccccaaccctgtgctctctgaaacatgcgctgcgtccactcagggttaaatggattaagggcggtgccagatgtgctttgttaaacagatgcttgaaggcagcatgctcgttaagagtcatcaccactccctactctcaagtacccagggacacaaacactgcggaaggccgcagggtcctctgcctaggaataccagagacctttgttcacgtgtttatctgctgacctttcctccactattatcctatgaccctgccacatccccctctccgagaaacacccaagaatgatcaataaatactaaaaaaaaaaaagttagtgtaaaataaagtagtagctttccaatatacaaacaatcaaatgatagatataatgatgtaacaaaagatgtacataacagtgattaaaatattcttaggaatatatttaacaataaaaaaaaaaaagaaagtttcctctcctgaacctcggctacaccgctcttcacagaccaaattgaagcttcactgagaatggcttcagaggatttcctgaacacaataatcatttttttctattttagatgttttgcttccagaaggcaaaaaaaaggactaaatgaacctccgagcagagcctatatgatgattttgcaggaatattaagatgggcccccccccactattattcttagcaaactaaagcaggaacagaaaaccaaatagcacatattctcacttataagtgagacctaattgataagaacatgtggacacaaagaggggaacacacacacactggggactctgagggtggagagtgggaggagggagaggataaggaaaaataacagaatctccgcttagttcctgggtgatgaaataatctgtacaacaaaccccgtgacataagtttacctatgtaacaaatctgcacatctaccctaaatctaaaataaaagtttaaaaaattagaaaaagaaaaatagccaggcatggtggcgtgcacctgtagtccagctactcaggaggctgaggtgggaggatctcttgagcccaggaggtcaaggttgcagtgagccatgattgtgccactgcactccagcctgggtgacagagtgagaaattacctctaaaaaaaaaaaaaacgagaaggtgggcctccccgtggcatgtattagaaaaagtgcgccctctggatggatgaggcccctggatagatggtgctgaaacaggtcagggacactggtctcattgtccaaggtgttatccaagctcgttgtctcacaaccaaaagaattaaggagcgtggacacagagtgaggttggagcaaaagtttaatgagcaaaaaaaccaagctctccactgtgcaaaggggagcctgagtgggctgccgtttttacagttgagtccaaaagcttttagaagaaactcctctcatctatgtagctgtttgagtaacttctcttatgtgaaaagctgtctgtaaaccccaccccttatccacgtagttgcggatatgactctaggcaagcacaatgcaccgcttctcttgtccgtgtaactgtgggtttgttttagggaagccccctcctctctgtgcaagttcccacggagcccaccgtgtacttgtctgaaaagaaggggaaacttttccctgggagctggttaatcacacgaagaacaaaaggcttctgtgccggaccttgcgtgcttgcctgtgcaggtgcagcctcagttttccccaggctgctctatttttgcctgtagctgcgatttttcaggcaggctgcttctccaaggaccagccttaactgtttacctaactgatttttcctttgcttctccctcagtgctttacacgaagaaaaagatgcccttcctcacaagtgtacctggcccacagctcaaagagcagagcttgggttggatttgtgaagggcaccatttgaccaccaccggggcagcccatctaaaactctcccagtcagctcatactaataaggaaatcttgtagaaaatggacagtaaattagaggcaagtgttcacaggaagcagtcttcttatttgcttttctaatccctctggtggcaagagagcctgagtgccgggagttcagggaggcggagaggctgacagtggcgcaacatggggctccattttccctgactctgccttggaagtctgccgcttggtgtctggtctttatacctgatacagtgtttgccttgtgttatggctgagttatatcccctcacccaaatttacatgcagaagtcttaatctgctgggcatactggctcacgcctgtaatcccagcactttgggatgccaaggtgggaggacggctcaaggccaggagtttgagaccagcctgagaagcatagtgagacctcgtctctacaaaaaaaagaaaattaaatttctaattcccagtgactcagaatgtgtctgcatctggcaataagatctttaaagaagtaattaagttaaagttaggttattagggtggtccctcatccaatctgactggcatccttatacgaagaggaaacagggacacagatacacacagacagaggactgagtggagacacaaggagaattcggccatctacaggccaaagagagaggctggagaaggagccaaccctactgacaccctgtcctcagtcttccagctccagcattgtgaggagatgccattgtgtgatgtaagcctcccagtatgtggtaatttgttatggcagcaggggggactgaaacaccttgccgctagaccttgataatttataagaaaagtcagaggtaaatgcttgtgagattatcgggaaaggatgcaccatgattagacccacaaaaggtcctctccactcccccacttcccctccccagtgcaagtccacccaggttgacagcgtgggcttgagtggaaagtcggcagcagcaacggaggcttgaagctggccttcctaacttgagactctccatgttttgattcaaagccaggaggattcaatgaccgcagtcattgcagggtctgaatagccaagaaatgcttggcttcatacaaagcactatatacggacctgtgtcaggcgaactgttgaaacagaagagacactgggagaaggcttttcccatttctccaaccactgcttcagaaaatctctgatatgcagagagtgattatttctccttggtctttctgggatgtttgaaggagaagtgaccactcctcatgcatttttcattctatagccatttaagtctattgctgccaggaaaatgagggaccgactaaatgacttctaattaaaaatataggaaagcttcaagtgacttcatgaagaggtcatggcaatatagtgcattagtaaatcaccgcaactccccagatctaggcaaataagcatagatctatttattcttgaatttttttttcaggatatgagtcctctgcccaaatccaaaggcctacttgaacacagtttcagttcctttcttctttcccagataacatcagtgaaacaatttatgttcttcctcaacaagaagaaagccaaactcttctgatactatttcaacaacccttattgctccactcacagcctccctcaggtgaagttttttctccctttctccaaacctttgccttccttctgcctcctttgtggctaaaattaacgtactgcctagaaccagacctgtcaccttctgactcacattctcccataaaggtactgaaaagccttaagaagattcatgaagcatcattagacaattaaaactgtcaatatgaaaaaaaaatgtggccagacacggtggctcatgcctgcaatcctagctctttgggaagccaaggcaggtggatcaccagagatcaggagttcgagaccagcctggccaacgtggcaaaaccccatctccactaaaaatacaaaaattagccgggcagggtggctcactataatccactgagagaatagctttgctgtcctcctttctctatggaatgccaaacacctgtgctatcttagactagtcacaggacttgaaactagcccaattgtcttatagaactgatgcttacggtttcttttgaatccacatagaaattgaccttcccagtcttaaaatttgagacagtcccatttgtcttttctgagttcctttctcaggaaaccaaccatcaggcttcctagatagtatcaaggagctgaaactcaccagatcactgcctcttgacaatgagatgccagacccctcacccatcatgactacctaaacggccaccggcttcctgttgaccaactctctctacttatcctttcctaactcctgttctcccacacagggttacatttcttccttgctatataacctccagctttggttggtcagggagacggatctgaggctgatctcccatctcctctgctgcagcacctgattaaagcttctttcttggagatactcatcgtctcagtcattggctttctgtacagcgaacagcaggacctacactgaagccctggcgttttggtaacagattcaatgatgtctcttcaaccaagttgcttattttcaccatgcagtaaaaataagtaccataggctgggcgcggtggctcacgcctgtaatcccagcactttgggaggccgaggtgggcggatcacaaggtcaggagattgagaccatcctggctaacacggtgaaaccccatctctactaaaaataaaaaaattagccaggcgtggtggcgggtgcctgtagtcccagctacttgggaggctgaggcaggagaatggagtgaacccgggaggcggagcttgcagtgagccgagatcacgccactgcactccagcctgggcgacagggggagactctgtctcaaaaaataaataaacaaataaataaaaataagtaccatataagccttgtttagataacttgtttcctttaacccactctttatgggttaaaggacaccccccactctcagcttcaatctttgccccataccactctcattatccactcttactaacagccatttgtttcactttattggattcagcttctctatccatagacatggtttctactgcatggctcctgaaacttaaatgtgcatatgaattacttgggtattttattaaaattttaatttacttcagtaattctggagtgaaggctgaaattctgcattcctgtcaagctcccaggtaatgtcagtgttgctgatctgaaattgtacattggtttaaaatagtctattgtaaccctttgtagggttttcaggttccaaacacaggctctgggagttaaattatactagtaacttatatatcacttctgccaaataaatagccaaatcaatccatcaatgaatatttgttgaatacctactccaaagtcccctgtaaaatattttcttcttagtttggtagatagtttcgaaagcatttaccatttcaagtgtttgtttgtttgtttttgcaacagagtctcactctattgcccagactggagtgcagtggaatgatctcggcttactgcaacctctgcctcctgggttcaagagattctcttgcagcctcagcctcccgagtatctgggataacaggcgtgtgccaccacgcctggctaatttttgtgtttttagtagagatggggtttcaccatgttggccatggctggtctcgaactcctgaccttaggtgatctgcctgccttagcctcccaaagtgctgggattacaggtttgagccactgcacccagccaccatttcaagttctaaaagacttatctctaaacctttcataggcagtcagtattcttcccctttctccttatctcctcatcaccaaggtttttttgttttttgtttttgttcttttgcaacagagtcccaatctgtcacccaagttggagtgcagtggtgcagtcttggctcactgcagcctccacctctcaggctcaagcaatgctcccacctcagcttcccaagtagctgggactactgacacgcaccaccacacccagccaatttttgtatttctagtagaaatggggtttcaccatgttggccaggctagtctcaaactcctggcctcaagtgttctgcccacctcagcctcccaaagtgctgggattacaggtgtgagccaccacccctggcctaccaagttttaatataagatttataattcaattgtctgaagatgggcttcagagccaaagaacatttccagtgttctcaagctacattcattcattcattcaataaatatttactaagcacacactacatacttggcactgtttcatgtactgtttactgataagcatagaacacaagacaagcaaggtccctgaagctacaaagctcagaccccaaaagggtaggaaatgaacaataaaaacataaaaaataaataatttcagagagtcaaaagtaaatgacaaaaataaaacagcataattcaatgggactaagaagcactactttggatagggtaactggggaaagcctccctggagtgatctcatcagagctgagatgtaaatgacaagaaggtgccagcctcagaaaggtctgaaagaagaggttctaatgatctaatagtcatgatttgctctgtagactgctttcctgagagttgcagttgtgtgttccgtgttccctgggtctcactgagcgtgtctgaaaaggccactttgcaaatacagtggtgcacaattacctcctgtttttgtcatcatttttagctctttccaaaaaaagattgatggagactgcctgcatgaggattggcttatcggggatacagggcagacagtcagtatagatttccatgatccgggagaaaattatctgtagaacattacaactaatcatttattcctggaaaggagggaatattttctttgataagcacttactgagcacttataacatgagaataaatgtttatatgtgtataaacagatgaaatatgggtctgtagagatgaatatgacatggattttgttgtcaaggagcttacaaataaacacaaagtaaaatggaaaaagtgagaaactggaagtacagggtaacgaaaataatcactttgaaggaagggtgactgatcttggccaagagaatctgtaaatgttcccatgagcagtctgtatttgaactaaggcttgaaataggaaacagaggagccatatccatagacagtacgaaaggccatagaaccgggtaagacacttagggaggaagtggaggaaagaagaggctcaagggctctgcccctgcacaacctggttaatagccttgaaggtgataatgcacaagaaatgcagatttcaaccatgtcagaggacgcacaggtccagcaagatgaacaacaaaacctgacctttggtttgaacattgtggaggtggtgtggtggctgggagcacagatgtttccgcgaaggggagaaagaaaaggtttatcaaagtggattcaagagaaatatgcaaggagaactgaaaattggcaccacagcccagggcttctcaaactttaaagtcactgtgaatcctggagatcctgctggagtgcagtttctgatttataggtcctgggtggaaactgagagtctgaatttctaccacaatggcgggtgacattgatgtcactgatggatcacaatttgaatagcaaaggaagagagtatttcaggagttttatattaaaaggagcaatgaaaaggactgggtgagcaaagtaactagaggaggatgtgggaccaaggatattatttttaagattcatgctatcgcagcattgtatgccaatggggatgattcagcgttcagagggggaaagtcaaaatggggagcgggataactgaacatcgtccttgagtagcgtggagaaaggggcacgcagcgatcagtgaaggggcagctctggagggaagcccagccagttcgtgcatgttaccaggggcagcagaaagctcctgcgcatagaggcaggtgagctggacgctgcacaggggttctcttctgttgttatttctcaatgcagtaaggcacttagctgctaggactgggaagaggaagaggcagcagtatgaaagaatcatgaggaagtaaattgactagggcagtggtcctcaaccccatgagacccatgaccctttttgttttgtttttgtttttgttttttgggacggagtttcgctcttattgcccaggctggagtgcaatgacgcgatctcggctcactgcaacctccgcctcccgggttcaagcgattctcctgccccagcctcccgagtagctgggattataggcatgagccaccacacccatctaattttgtatttttagtagagacgaggtttctccatgttggtcaggctggtctcaaactcccgacctcaggtgatctgcccacctcggcctcccaaagtgctgggactacaggtgtgagccaccgcgcccggcccatgaccctttttataacacatgcttttaacaaccttgctaccattgtgaaaataaaataatagtttatgtaacctacctacacacacatttttgaatcaacataattccttcaccgtaatgtaaagaaagaaaagaaaaatcgttcaggcgtgagtgtactgttgtgttaggaaggcgaaagcatctccacaagcactgtgagtgcttctagaaggcagcgagaatatctgaggcttggtgagacgctttcatcgccatgactaagggtccacccgcagttaccggttatgatttcatgggagactctcagttgtacattttgttcagctgcttggatgcaagctcagaggtggcagagttgcatttaatcaggctggcagctttactggggagtaaatggactgaaaatggtgcaaggaagcttaaggtccaggtctacaatctctatgtgcaattccaaaatccaaaagagctttgaaaatacaagttggttgttggtggttatccaaaactcatttggcagtgaaactcagcctgaatagacacaaagctatttagagcctttactgatcccacttatttgagatactacataacagtagaactgattatctttctacaatttttttaaaatctgaatttggaaacatctgtgcccttagagcttgggataaagcattataaactgtacatgtaagggaattaataaaatgacgggccaggtaagccaaggcaggtcagataggaaataaagacttgagcagttaagacacagtgaaaaaaattgggccaccggattccgggtccctgtatggcagattgtggggtggaagtgctagaagtgagacaggaagcctgggagatacagagctggatgctttcaactgagaatccgaatggggtacagttacagataatgacgagtgcagaccctacagtagctgaggatgtcaaggtgaggacgtcaagaataatccatcgcccagggatggcggcccatgcctgtaatcccaacactttgggaggccaaggtgggtgagtcacctgaggtcaaggagtttgagaccagcctggccaacatggtaaaaccccgtctctactaaaaatacaaaaattagctgggcatggtggtgcacatctgtaatcccagctactcgggaagctgaggcaggagaatcgcttgaaccctggaggcggaggttgcagtgagccaagatcacaccactgcactccagcctgggcaacagagactccaccaaaaaacaaaaaacaaaaaaaaaaaacaaaacaaaaaacaaaaaaaaaaacacacaaaaaacaaaaaaacccagaacaatctatcagaagaaggatccatgtggatgtgagattagcactgggcatttaacatgtgactgcctcaaaagggagtggtggccagtgtcgtctgagagcttcagctgccgacgagctgcctgctgacaggtgtaggaagcagaaaggtcgagcgtgaacaatgggaacaacacttacccatgggggtgacatctaaagagaaagcagcctccacccgaccctgcttcaggggaagccacgtcctcgggtcggttaggaccaaaagatgaagaatttagggatgcaaaatattttgctgataactgccaaggggatcagaagacacagaggaagaatttgggggattctgcagggttttgagcctgggtcatcccaggaaatgtacagagccatgtgaggatgagactccagtgtgggaggatgacctgggggtgtctgcctcgccacctgccatgactgggataaaatggagtaactggctcagtcctaatgatacgtaacagcagcatttttgcaaaaagagctagacctgctcataagattgagtagttcagaggtcagttaactctttctgggccagataataagtattttagattttgtgtcacaattcctcaactctaccattgtagcaaaaaagcagatatggccaggcgtggtgctcacgcctgtaatcctagcactttgagaggccaaggtgggtggatcacgaggtgaggaatccaagaccagccttgccaacatggtgaaacaccatgtctactaaaaaatacaaaaaaaaaaattagccaggcgcagtggtgggcacctgtaatcccagctactcaggaggctgaggcagaatagcttgaacctgggaggcggaggttgcagtgagacgagattgtgccactgcactccagcctgggtgacagagcaagactccatctagaagaaaacaaaaaaaagcagatatatctcacagataaaggaatgggcatggctctgttcaataacatcttatttacggttactgaacttttaattttatataatttttaatgttatgaaatattatttttcttttgattttttgttcaaacatttaaaaatgtaaaaacttttcatagctcatggcaggccaactttggaacatctgccatagattgaagacctctggcatagtttaatatttagcgggaaaagcggaaaaagagattggaaccagattagtgtggttgtcaaaaaaaaagctaaagtgtttggacggggggtgtgggtacgtatgctttagaatccattaaaaattgttaacggaggcaaaagatacgatctcattagtgttttaggaaaataggtggttgcaataaaaatgatggattggaaagataagaaattagatgtgaagagtcagcttagagaccttggcacttctatagggggacatatcaatgcctagagacccctttgcttgagaaagcataagccattgaatgttattagaaataattaaagtggtaacattgaaaagatactaaatatacaattttactttctctccgaacacactgtaagtaggaaaaagcatattaacaaaaacagcaatctaatgtcctgaaatagacctgtgaaaaggcttgcaggtaaaagaaacacaaggaagacacagagacaggaaggaaaagaatatttaggcacattaaagagatttaacccacaggactaggactcacacagtaagaatatgatgctggtaaagaaatggggcttcacacaggggaagagttcagaaaaaggactgagggttgtggtccaagatggaaccagagaatttgagaattcttttctatgacaatttcaaaaatcactttcccttcttgaaatgtatgattgacctttctgggtgaaaccctacgggctgggggaaggagaatcacctcctaggggttatacccgggaaggcacaggggagacgcattccaagtcctgaagagctcctggattgggccagcaagacatacttttagcatccttccatgacagtggtttcttgactcttttttttttcttgactctttcttaagaaaagaataaaggtacacccagaaccccattggatacctactccttgtttgcattcattagagaaaggactctcagcagtggtgaagctttatcagtaccctgcagaaaatccactgaaaccaaggtccctgcctcttagttcacgataggcacagtcctccaagcctgtttgcgcctctcttgcattctgatttactgcttgctcctcacttacctcctcctttgtcctttgctgttcaaagactgcacttgtaaattgggtaattcgagtttgatcctgggctgccctctcttctacctatactcatccccaacattagggctactaataccatctgtagtgaaaagggtcacgaagaaaataagccaaggggatatgatagagattgactgagtcaactcaggcacattggccccgatgtcacacttaagctgagatcagaatgcttggaataatctgggacatagaatttcagacagaagaaagacaaatgcaaaaaccctgttgccagttagaaagatggatgtagctggagaaaattctgacatagttcattactgcttcactgcatcactttcctggggatgggacagcacggcatgcctgaagagctgaggggctgcactggtttctttatatcgactacatcacctaagtcaacctgttctaaggcacatttggtggattctttcagctaaaaaaaaaaaaaaaagaagaagataaaatatttaagttccaaatcaaatatggtttgagtccctgatgctcacatatttactcatattgatccatttccaattacacacataaacacatttttcaaacctttctgaccattacaaaatgctggtcactacccactaattggttccaacttataatgaaaatcatagatttaaatcctaaaattaaaagaaaactatacataactgtgtgtcccacaactgcttattttatacctttttctttgcccaaataaggtggaacctgtattatttacaggctgatatcatttgttctcatcatttcagacataatataaaacaataaccagttctacaatttccctatttagactatatagaccttgtaaaacctggaggctccaatgtgcctcaatgatattttcctggacagatgtgcattttaaagtattggtttaaaatccacattatggatacaaaagacatctaaaggctgatgatatgatataaaatacatccctaaaagccaagtaattccatgtaggaagggataatattgaagtttctgaaagaaaggctttcttacaagcggtgattcttgatttgagtcttgtaaaaggtataaacttggaatgggagggtggtaaattttatagaaagggtgatattagcgaggatatcgcaaggcgtaaattatactttctaggctagaactggaatgagattgtggagttcatatctgtgcattagctgtgtcctaaatgcaaaatggcctcctggatcaaatcctagaagaaataaaaagtacatgagtggaaaagcatgatgaagaccaaataaagtctggagcttggttgacaggattgcaccattgttgattctgtattttgataaatgtacattggttgtgtaggatgttaacattagcggaaactgggtgaagtatatatggaaactcaatgtactatctttgcaactcctctataaatccaaaggtatgtcaaaataaaaagaaaaaaagaccacaccgtctgaggttgactcaaaagattttgagggaaaatttgagtgatggtctaaaacaaaatggagcaagctcagaaaatttactccagataagcccaattttagtaggtttcttagcagaaaggcaaggggtgtttggggaaagggaggttatgggaatagttgtcttagtctgttcagcctgctataaaaaaaaatttgagtaattcatatttatttattatctttttgagatgaagtttccatcttatcacccacgctggagtgcgatagcacaatctcagctcactgcaacctccgcctcccgggttcaagcgattctcctgcctcagcatcctgagtagctgggaatacaggtgcctgccaccactcccggctaatcttttgtatttttacaaaagattgtctctttagtagagacaaggtttcaccatgttggccaggctggtctcaaactcctgacctcaggcgatccacctgcctgggcctcccaaagtgctgagattacaggcgtgagccactgcccccggccaagtaatttttaaacaacagaaatgtatggctcataattctggaggctgagaagtccaagatcaaggtgccagcagatttggtgtctgccgagggcccactcctcacagacggtgccttctgtgtgtcctcataagatggaggggaaaagggctcccccacgcctcctttataaggacaccaactccattcaccagggcggagccctcaggacttaactacttaccagaggcctcttgataccatcacatcggggcaggtttcaatgcatggcttttggagggacacaaacatgtaaaccatagcaacagtccattcttaaaaagaagaaaaaatctggccaggcgcagtggctcatgcctgtaatcccagcactttggaaggccaaggcgggtggatcacctgaggtcaggagttcgagaccagcctgaccaacatggagaaaccccgtctctactaaaaatacaaaattagccaggcatggtggcaccgcgcttataatcccagcttactcgggaagctgaggcaggagaatcacttgaacctgggaggcagaggttgcagtgagccgtgatggcaccactgtacttcatcctgggcaacaagagcgaaactctgtctttaaaaaaaagaaggaaaaatcttatgaaactgccaaacataacattaacaaatcactgtcaaagtctgaggagaatctggggtctaaaaaatagccttaggccctatacttagacccactgctaaattctcacagataatcaaatgagaccatatttatatggttatagctttcatgtaaagagcacaaaagtttttgaaaatatacaacaggacgataagtctcattcttctcagtgtgaagtaccaaaaggcttccatgtagattttagattctacttagattgttttttgaaaagcagagttaaatatgccttttaaaaatcatactctactaagatatcaaattccaagtggaaacatacattactgactggtgggttattctttttttcacagaaactctaaaaatatgtttaacaagctctttaggccagttatggtggctcacgcctgtaatcctagcactttgggaggccgaggcaggtggatcacaaggtcaggagatcaagaccatcctggctaacatggtgaaaccccgtctctactaaaaatacaaaaacttagccgggcgtggtggcgggcgcctgttagtgccagctactcgggaggctgaggcaggagaatcgcttgatcgcttgaatccaggaggcagggaggcggaggttgcggtgagccgagattgtgccattgcactccagcctgggagacagagccagagtccatccaaaacaaaaaacaaaaaacaaaaaaacaaaaaacaagctctttaaacaactgactgaacttggcaaattaactttatctttacattttgtatcaggatagcaagatttgggttctaaactctgctctgtaaactaatacctatagggctttgaataaggcatttgtcactactgacttcacatttcctcatctataaaatggataataacaatccctaaggtgctatcaagatcaaacaagcatgtaaaaaggcattacaaatcatagccaataataacatggagagatttcttaaatgaaaaatacaactacagagtttgcaaaataccttaatgtaaaatactatattagaccacagtgacgcatatcaaaggagcaagatgggttcttttgttgttgtttttgtttcatttatttttttatttttttattttttatttttttatttttattttttttttattgatcattcttggatgtttctcgcagagggggatttggcagggtcacaggacaatagtggagggaaggtcagcagataagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttagtgcagaacaaaatggagtctcctatgtctacttctttctacacagacacagcaaccatccgatttctcaatcttttccccacctttcccccccttctattccacaaaaccgccatggtcatcatggcctgttctcaatgagctgctgggcacacctcccagacggggtggtggccgggcagaggggctcctcacttcccagtaggggcggccgggcagagacactcctcacttcccagatgggatggcggccgggcagaggctgcaatctcggctctttgggaggccaaggcaggcggctgggaggtggaggttgtagcgagccgagatcacgccactgcactccagcctgggcaccattgagcactgagtgaaggagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcacgcctgcaatcgcaggcactcggcaggctgaggcaggagaatcaggcagggaggctgcagtgagccaagatggcagcagtacagtccagcttcggctcggcatcagagggagaccgtggaaagagagggagagggagaccgtggggagagggagagggagaccgtggggagagggagaccgtggggagagggagaccgtggggagagggagacggagagggagaccgtggggagagggagaccgtggggagagggagagagggagagggatttttgtttcatttttttcgtttgtctttggagatggagtctcgccctgtcgcccaggctgcagtgcagcggcacaatttcggctcactgcaacccttgcctcctgggttcaagcaattctcctgcctcagccttccgagtagctgggactacagacgcccgccaccacgactgactttttttttttctttttttttttttaattttattagagacagggggtttcaccatgttgcccaggctggtctccaactcctgagcttaggcaatgtgctggcctcggcctccaaaagtgctaggattacaggcatgagccaccacgcccagccaacacttgggttctaatctgagtttagaaacttattcctgtataaagtttctttgtgcctcggggttattttaaaacgcaaatgaaattataataacagtaataataactattttagaaatttgatttcagataaaatgagactgtgcgtgtattcaatttatattagctaaatcaaatagaaataagctgaagctctaataatgaaataatgttttacaagtttaaggttaataagcatttatagataaggcatgttttcttacaatattccgttcccagggctcctggactgaagatcgaagttcttcccatggcctacggggtcccagagtctgggcctgcatagcctctccacactcgcctccactcatctcaggtccttccataactattccctctcctgtcagggaggctctgccgtccacgctgattcctgcagatcagggaaacctcccctaacttcccggctctcctatgtggctcccacagcaccacgcacctctccttcattgtgctaataatagctgcattgtgacacttacaatcatgattatttggctggtatcctctgactgtctttatttacaatgtggatattttgttctctataaattgttgcgttgattttgattcttttacatgccaggttaaaatattactaatactgattactgagggtgttttgtttacaagtgagttactcacctcaatctagttcttaccctcctgttctgacctggccattccgcattcaaaccccaggaggccaggaatacgtatccaccagggcctagaacctccgcctgtgtaggggagaaactcaaatctgtatagagtgaattaatgcatatctatagtttttgcattttaagggttttaaggaaaatattgatttgtaacacagataaaatggtcgaaatacaagtgttttaagtgaccatgatgttactggcagaagaatcactatgactaaaattccagcaatggacaacactttttctatgcataacctctttgtggtcaatttcaagacagcccacttctgtttcacggtttaattggttctcgagctcatttaggagaaattcaatttcctttgagctgagttcatatcacaacagatgagttcattcgttttggtttcttcttcaggcccatggaaaggaaagctaaacgataatgggagcaaaaataatctatggaagaggtggagtgtgaaatgtaaaattagattttctaaacatgctgtctctaatgcccaaacagagccacacccaagcgatcaaatggaatcagtggtaggggaggcgattataaatcaatctagtttatgggatgcactgtgtgaatggttaagggagtgataaagggtggtttccgacaacccaaagaaaggatcctcggcttgagctaagtgtgtgtgtttccatctagtgaggaaaggggctttcaatgacattgccacttaaaggcttacaaagaaggttctggtcaacattcttcggttcattgaagtatttcttatcgaaacccaaatgttaacatttttatctccaagggaaacaaaaaaaaaggctggtggaattcccctgtagtttctaaagaggccacagcaaggcgccatagagacagaaggagggaagttgagggaagtccttctgactggtaaatcggctttctgaccctcgtctgcaaataatacattctaaggtaaggaactaaggaagctttattgaaatcggatttcaaatggagaggtcctgctatgcctactggaggagatcagggaataataaatatttccttcattgaaaattatatcctattggccaggcgcagtggctcacgcctgtaatcccaacactttgggaggccgagacaggcggatcacctgaggtcggaccagcctgccaacatggagaaaccctgtctctactaaaaatactaaattagccgtgcgtggtggtgcatgcctgtaatcccagctactggggaggctgaggcaggagaatcacttgaaccaaataggcggaggttgcagtgaggtgagacggtgccactgcactccagcctgggggacagagaaagactccgtctcaaaaaagaaaaaaaaagagaaagaaaagaaaggaaggaaggaaggaaggaaggaaggaaggaaggaaggaaggaaggaaggaaggaaaattatattttattggccaacctcaaaattgaagcttattcagaaacagatttaaaaaaagaaaaaagtggagaactgctcccagatatatatgcagaaaagcttcaagtcaacatttaggaggtttttaaatatcgatctgggtttcgttctaatggtctgggtgtacttatacgacctattacatttcactagactgtagccaatagtgagcgttgactgaccattgctttcaaagtgagttgtgttgcctttagcaatacagtcacattaatggccagaaaaagaaaaaagaaaacaaacactgggggtgtttgaaacaactgggggtagggtggggtgggaaaggtgtgggggtttgcgttcgagtcaacctctatttcggggggtaaaaactgcctcctccgcttgatttttttcctcgatctgcaaaagcgtaaatgttttgttttgttctattgagatggagcctcgctctatcacccaggctggagcttagtggcgcgatctcggctcactgcaacctccgcatcccgggttcaagcgattctcctgcctcagcctcctgagtagctgggattacaggcgagcaccaccatgcctggctaatttttgtatttttcggtagagacggggtttcgccatgttggccaggctggtctcgaacgcttgacctcatgtgatccccccgtctcggcctcccaaagtgctgggacgacaggcgtgagccaccgcgtccggcctaaaagggtaaatgtgattacacccacgcgtatttgttcaacagacatttattgagcgctcaccacgtgccaacgccgggcgtctgggctctggaggcgctgccacgtggcggatgcgcagtgcccggcggccgggctgaggggtgaacgcgggggtcagggggccccgggctgagggtttgcgtgcgggccgggtgcctgggggccccgggctgagggtgagcgcgccgcccaggtgccaggcggctccgggcagagagtgaacgcgcgggccaggtggctccagggcggcgccccagggcggggccggccacgccctccctaaccctggcggagctgatgggtggctgtagcctgattagaccgcgtcagtccggagggtgggtcttgggagggggcgcagggcagtccacgtttccactgcagtttctcctttgttttacgtttgggaggaggtggcattggaaatagcagagtgcttcgcggtaacaggggtgagtcttgtttcatggaacttttttcaaatggggagaagggggttgtgttgctcactacttggaatgtgtcggtcaaaggggttagatagtcagggaggggaagcgtgttctcatcctgggaccaggccggagccggcctcgccgggagacttgtagccctcgccctgcggtgacccgtggctggccactggcctcaaatgttgaaaacgggcagatgggcaagtaatacactctcaagaaagcaagtgtctggcggtgatttcctaaattgcattttttattttatttcaaaacttcatgtaaatatgtttccttacaatatctggctaagtcttttctatattaacatgcttacattgtgatcaagacaccagtctcttccctttcttttcctctcctcttatctctggagatggcaatacccccaactcaaattactctagcaaaaaacctaggagactctttcttttcttttttctttttttttggagacagtctcgctctgttgccaggctggagtgcaatggcgcgatctcggctcactgcaacctccgtctcccgggttcaagggattctcctgcctcagcctcccaagtagctgagattacaggcgcccttcactgcgcccggctaatttttgtattttagtagagacggggtttcaccatgttggtcaggctggtctcgaactcgtgacctcagatgatccgcccgcctcagcctcccaaagtgctgagattacaggcgtgagccaccgcgccgggcgagactcattcttgattcctgtttcccttccgctcttcatccaatccaccggcgagctgcagggcgagggggtggttctttctcctgttttcccgctctccctgcatttcatctcctctgccgccatctgctccaaacccctggcagcccttcgcgggattcccaaatctaatagatttttctgttctccccaaatccattctccatgcagctgtccggcccatcttctaacctaaaaaaacttgctgtttgcttgttggaagccctgtaatggtttccttgggacctgggatgaaatgcaaatggtcccggggctcaccgtcagccccgcgcctgggcctcgccccagcccccaccttcctgcccgccatagctgtagggagcatggagcatggagcgtggagcgtggagcatggagcatggagcgtggagcatggagcatggcctgcagcccccggggagcgccggcagcctggaaccagcaggcttcgctcgtctcttcccacccccgtgcacttttcctcctgcccacatctggctccgatggccccctccttgggggccttttccagacattcatgatgaaggtggcgtcctcggttacttcccctctcatattcttttttttttttttttttttttgagacagagttttgctcttgtcgcttgggctggagtgcagtggcacgatctcggctcactgcaacctccgcctcctaggttcaagcgattctcctgcctcggcctcccgagtagctgggactacaggcgcccgccaccacgcccgactaattttttttatttttaatagggtttcaccatgttggccaggatggtctcgatctcctgacctcgtgatccgcccgcctcggcctcccaaagtggtgggattacaagcgtgagccaccgctcccggtcccaccccgccccgaccttttttttaatagcatttttctcaatctgacattttttgtttatttgccctttactgtctgtcccacaccaaactttgtgttaacgaggaactttgcatctttttccctaagttcagcacctagaacgaatactaaatgtatatgaagatttcgtccacatccgcttttaccagtatgttttccatgtacagtcaagttccatataaggccgtttcagtcagtgagcaaccccacgtactatggtggtcccataagattataaaagagctgaaaaatccccatggcctagtgacatcttcatgatcctgaatttgtgtaggcctaggctcatgtgtgtgtttgtctcttcgtttttaacgtaaaagtttttaaacagacaaaattttacagaataagaatataaagaaaaaatatttttgtacaggtgaaaaaatgtttgtgttttaagctaagtgttattacaaaagagtcaggaagtttgcacatttttaagtttataaagttaaaaagagtctgggcgcggtggctcacgcctgtaatcccagcattttgagagcctgaggcaggcggatcgcctgaggtcgggagttggagaccagcctgaccaacgtggagaaacctcatttctactaaaaatacgaaattagctgggcgtggtgacacatgcctgtaatcccagctactcaggaggctgacgcgggagaatcggctgaacctgggaggcggaggttgctgtgagcggagatcacgctgttgcactccagcctgggcaacaagagggaaactctgtctcaaaaaaaaaagtaaataaataaatgaatttaaaaagttacagtaagctaaggttaatttattattcaggaaagacaaatttttaaataagttctaaaatttgcctaagtgtacagtgcttataaagcctacagttgtgtacagtggcgtcccaggccttcattcactcaacactcactcactcactcatccagagccactaccagtactgtgagctccattatgggaatgtgcctacacaggtgtaccattttttatcttttgtacagtatttcttctgtttggatatgtttatatgcaaatacttactgttgtgttacagttgcctacagtactcagaactgtaacatgctgtggagatttatagcctaggagccatgggccctactgtgtaacctgggtgagttgcaggctgtgccattcgggtctgcgtagctacactctgtgatgttcacaggatgacacagcaacctaaagatacatttctcagaacatattcctgtcttcgagtgatgcatgactagttatttctgctaacagaaattggcttgccatataaatagttttcttttagtaaattaataaattaccatttcaatgttatatgtcatcctcacaagcttgtatactgctatgagaaatagcataatgctcggagatctgacaaataagaatttagcttagaaaggtaaggaccatacttgaaccttagtaaattcataaagaaaacacctctcttaggagatgcctttcttttttttctgtcacccaggttggagtgcaatggtgtgatctcagctcactgcaacccctgcctcccaggctccagcgatcctcccacctcagcctcctgaatagctgaccaccagcacactaggcaaacccaccccactcacggcctcccttgggaattcagacctaaccatcgctgagctgaagtgtaggtgtggtctgattagactcattttttcttttttgtagagatggggtttcaccgttttgccgaggctggtcaccaactcctgggctcaagggatccacccacctcagcctcccaaagtgctgggattgcaggcatgagccaccatgcctggccttaggaaattcctttctatgtaacaccctgcatcattaatagccagcttttttgaaacttctacattaaattgtctaaactctcaaataaattcctagtaaagtaattatatagggttgttaaatcagagatcaacagcacaatgactaatgcatactcatgatttcatctcactagacaaatgtactgaggctggagcctgtgtgaacagaacagaagaggccttcactctagtagtgctcacagtccagcaggtaagacagacttgaagcaagggacaccagagctctgatcagtgtgaaatagggagctaggagaacgtttagctttgggactcaactgagctgaagaatccagggaagcctgcctgaagaggtgatgtttgcgcatttgaagtatggatgggaagcaagcctctgtgtgtgtgttggaggataggtggtattttagtgagaaaaaagaacatttgtaatggactgatctgatgctttactggagaaagtttattatggctgaatagtgaaatacaagagctatagatggcaggaggtgagcttggagggaaaagcagcagtcaattaaattgcagttacaggttgagtattttttatccaaagtgcttgggaccagaagtattatggacatcagatttttttgaatgtttgagtatttgcaaaatacccaatatgagcatcccgagtccgaaaattcaaaatccaaaatggtccaatgagaatttcctttaagtgtcatgatggcactcaaaaaggtttcatactttaagcatttcaggtcctagattttcagatttgggatgcacaagctgttttttaaatggactaattggggagagcagctctgtgtttaatcctagtaattaccctccaaaggtgctaatattgtgcttcataaatattttgagatctccctggttaatttcacctctatatttttgttttctttttttttcttttttttccgagaaagtcgctctgttgtccaggctggagtgcagtggcacaatcttggctcactgcctccgcctcccaggctcaagtgatctcctgccagtagctgggattgcaggtgtacgccaccacatccagttaatttcttgtatttttagtagacagggttccgccatattggccaggctggtcttaaactcctgatctcaggtgatccgccagccttgtgctcacaaagggctggcattacaggcacgagccactgcacccagccctaatttcacctttttaaaggacacaggcctggcgcagtggctcacgcctgtaatcccagtactttgagaagccgaggagagcagatcacctgaggtcaggagttcgagaccagcctggccaacatgatgaaatcccgtatctactaaaaaataacacaaattagctgggtgtggtggcggggcgggggggcgcctgcctgtaatcccagctacttggggcctgaggcaggagaatcacttgaaccccagaggcggaggttgcagtgagctgagattgcgccattgtactccagcctgggcaacaagagcgaaactccatctcaaaataaaataaaaggacacaaaaaataacattagtagcatataacatatatgtattacatatttttaaatacattttaagaaatcttaaacttttcccctacagttggaacacattttgtttttattatatgtatttgttttttaccaaaagtaaatgacatgcttctgttgaggtgttttttttttaatgtggttattttaattttcatccaacaacttttacctttgcctcttttttaaaggcatataatttttcttcctacagaaagacatcaggacaataaatagggagatcttttctcaggcacacaattgtaacattaagtaagagacttttatagtcaaagcaataacatattcatgctataacttttataacgtcattgctgttaaatgtttaaggaaatgataggaaagtcttcagggccaagctaccccgtgcctttattttggcatggattcctaaaagtgggagcaccattaatttcatgtgtcttattctctggatccccattttttagaacaatgagtgggcacacgatggcccatgggccagtctccctgttttactggaacacagccaccctcattcctttatgtgttatctgactgcttctgtgccgtgctacaacggcaaagttgaatagtttcaacagacaccacaggacccacaaagctaaaatctggccctttgcagaaatagtttaccaccccagtctagaaagaacctggcgtgtagcaggatgcaacatatacttgtagaatgaataaaaaggtaataaaataacacgagctcacatagcggccagcatttgctgtgcaccataatccgtgctaagcactttgcatgcgttatttaatttgaatttcataacagtattacataagaaaacaatagggccaggcatggtggctcacgcctgtaatcccagcactttgggaggccgaggcaggcggatcacgaagtcgggagctccagaccagcctgaccaacatggtgaaaccccatttctactaaaactagaaaaagtagccaggcgtggtggcgtgcgcctgtaatcccagctacttgggaggctgaggcaggagaattgcttgaacccgggaggtggaggttgcaatgagctaagattgcaccactgcactccagcctgggcgacagagtgagactccgtctccaaaaaaaaagaagaaaaagaaaagacagtattttgctccctcaccgccttcaggcttttaaccaactgccacttaccaccctagtgaaggtttgcccgagtgccctatttaatattgcaggcttctgtttcctaccagcccctttgcttactctttcacacttagtcaccttctaacgtggcatacattgcttattttctatgctcatgagtatgtctactccatggaggcatagatgtttgtatgcctgtttactgatggatcacaaactgtgtagcctaaaatagagctagcacatagtcccacccaacacgtgtcaggtgagcaattagatatagagggttccaataacttgtggggacacccagataagatctgtttatgactcatgtcttacacagagctcattcttggtctcttggttagtttatcagagaagacaaatgtattattggaaaatgtgtcttaggtcattttttgacagtggctctaatactggaatctattttaactaaaggttattatcataaagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaatatgccaagtctgtattttaaaaaatcaaagtctacattgaaaagagataccatttatttgttcttaaaacttagcaaaattcaacagactgatgttcggtataggtgagatatggcgggaagttgggcttacgtgtggttggataagggataaactgtcacagccagtttggaaataaattttgtaattgtgctatattcgtttttgagctgccgtagcagtactcccaagctaggtaacttagcagaaatgtattgtctcggttccagaggctagaggtccaaaacccaggtgttggcagggttggttccttctgaggctgggagggaaggactggcccaggcctccctttttggctttaagtgactgtctcgtgttcacatggcattcaccctgtatccccacatcccttcactctgcctgtgtccgaacagggacaccagtcatgtgggattatcacccgtgctgatgacctcatgttaacttgacaaactctgaagaccctaccttcaaataaagtcacattctgaggtactgaggttatttgtactaatgtacaaagggatctgttcaagaatgttaactgaatagtatttttaatagtgataaacccataacgtaaatgttcattaaggggatatgggctgcataattcatgccacttttgttcaacagcaaatgtgcaagtctccttcagggagagggtcacagctggaggcaagccacaaagaggaagtttcttgttactaacagatgagacgggatctggtgtattttcttgctgtggaaggaaattcagagaaagtagttacatacggataaagggagaaattgtctgaaggtagctgatctaatgtaggggttaactcatttttatcattattaagtgaatccctgattggaatcatctcataatggccaaaaatatgctgccatcaaacttgaaatgcttatttgattttaagatttaagacatctctggaggtagtgctaagtgtaccattaatttaatggcttttcaggaaataacaataccacactaagtaaatatatcaaacttaagattaatcttgatttctaaaatgccaaagtctaaaatatgtctttaaaacaagtaaaaaaaatcaaaggcttacattttgacgtcagtatgagctaattgctactatggactatggaaattacttcttaatttggtctagaatttctagtatcatttttacaggaatgtgggtactgagtgaggaacactgggtacataatccatttgtaagtggaatttcctccaaatcaaacacctgagtatagaacttgagatgggaatttggtatttgatcaagatgacaaagcatattctcagctagttttgctttcgtagcactgtgtttgatttgctcttctgtgggtttctacttcagagatgaattagcacagagcacctctgaagaccaggcaaaaggcaggactgaatagcagccctcaaggccagaggaagtcaggggcagggtttaggctgcaagctggagagccgagatgcagggcaccgagagggatggatggagatgcttcttcctgaaccatgagcatttctaaaaggtagatcagcctttacatagcgggagccagtctccatccctcttgctgttctcagatggctgttcctgttcagctcttttctagagctgaagggtccgaaactccctgttaacaactctaaagcttaaatgtgtaagaaacagcaatctgagaaaatgcttgtgtatctggatcccaaggcttagttaaatcctgactgaggaatagggtgctacttagctagcttcctagctgttcttgtttttgcttttcttccaaaaaggaaccctaaaactgctaagaatgtaagaggatgcatgtggatgcaatgtggatgtaagatgcatgtggatgcaatggaaacaaaaaaaaaaaaaaaggaaaaggaggttagctaatgaggatatatgaggatatgtcacctgaaatcctttgtttatggttcaggaagaaatgtacatagactctccacatttgtgttttaagtaagaacgaacacaagataacctgaacacatacccagagaaaactgaaaaaaagtctcagttcatctagcttttcacctttccaggcactggcatttgacagaccccaaatcctgataaatgaataaaatgtttttcggttttcaagctggcatttggcttcatggcccataaacaacaaacagaatcttacatgtgtagggttttttacattttttatcatgtttgtttaagatgtatgtgctgggccaggcgcagtggctcatgcctgtaatgccagcactttgggaggccaaggtgggcggatcacctgaggtcaggagtgcaagaccagcatggccagcatggcaaaactctatctctactaaaaatacaaagattagcctggtgtggtggtgcgcacctgtaatcccagctacatgggaggctgaggcaggagaatctcttgaacctgggagggtgaggttgcagtgagcagagatggtgccactgcactccagcctgggggacagtgtgagactcttgtctcaaaaaaaaaaaaggtgtgctgttttgatatgcatatagtgaaatgattactgtcaggaaaattaacccatggcctggcgcggtggctcacgcctgtaatcccagcactttgggaggccgaggtgggcagatcacgaggtcaggagatagagaccatcctggctaacacagtgaaaccccgtctctactaaaaatacaaaaaattagccgggcgtggtggctggtgcctgtagtcccaactactggggaggctgaggcaggagaatggcgtgaacccgggagacggagcttgcagcgagctgagatggcgccactgtactccagcctgggcaacagagcgagactccgtctcaaaaaaaaaaaaaaaagaaagaaagaaaagaaaattaacccattgtcccctttttcagttatcttttgtgtgtgtagtaagcacctaaaatctactttcagcaaatttttggtaatgaatactacattattaactgcttcttcatgctgtgcgttaggtttctagacccatgctatctaactgcaagcatagacccttgtctgttgctccctatttctccctcctctacctctgcattcctggtcactaccatttctgcgctgtttctatgtatttgccttttttgtttgtttgtttagtttccacatatcagtgagattatgtagtgtttttctttccatgtttggtttatttttccagtttatgttgtagcaaaggcagttatctccttttttaagtctgaataatattccgttgtacgtatgtgcaccacgatttccttattcatctgttgatggacatgtggattgtttcatttcttggccgtggtgaatgatgctgcaatgaagatggacgtgcagatagcttcgtgcggtggtgatttcatttcctttggctatatgcccagaaagggaattgctggcccatatggtagtcgtacttttagtgttttgaggaattcccatcctgctttccacaatggctgtactaacttactttcccaccaacagtctgcaagaattcacttttctccacatctttgtcaacacttgctgtttcttgtctctttgatagtggccattctgacaggtgtgagggagtgtttcactgtggtttggtttgcatttctctgacaatgagtgccgttgaacacctgttcatatatttgtgtgtcttttgcgctatgtctgttcaagtcctttgcctttttttttctttctttttttttttttttttttttttgagagacgaggtcttgctatgttgttcaggctagtcttgaactcctgacctcaagcgatcctcctgtctccgcctcccagagtactgggattacaggtgtaagccaccatgcctgaccctttcaccatttttttaatcaagttgtttttttggggggtgagttgtgtgggcaccttgtatttttttaatattaactcctatcaggtaaatgatttgcaaatattttctcccaacccataggctgccttttcattttgtggatgttttctttgccattcagaagctttctagtttgatgtagccccacttgctaatttttgcttggagttggtttttgtgtgtatggtgtaagataatggtccagtttcattttgcttgtgaatatctagttttcccaataccatttattgaagagagtgccttttccccattgtgtctttttgtttttcttgatgaaaattcttatatatgcttttgggttaatttctgggttctctgttctgttcctttcatctgtgtgtctgtttttatgctagtattgtaatattttgattactgtagctttgtaatataatttgaaataagggaatgtaatgcttctaactttatttttctttctcaaaatgttttttggctattcagggtcttccgtggttctaagcaaattatagaattgcatcttctgtccaggcatggtggctaacacctgtaatctcaatactttgagaggctgagccaggaggattgcttgagcccaggacttcaaggttacaatgagctgtgatcctgccgatgctctccagcctgggcaatagggtgagaccccttctcttaaggaaaaaaaaaaagaaaaattaaataaaaagattcttttttcattagccgggcatggtggcaggtgcctgtaatcccagctacttgggaggctgaggcaggagaattgcttgaactcgggaggcggaggttgcagtgagctgagatcgcgccactgcaccatttctgtggaaaatgacattggtattttgataggaattgcatggaatctgtagattgctttaggcgatacagacattttaacaatattcttccaacccgtgaacataggatatctttccatttatttgtgtcttcagttttttcagcaatgtttacactttctggcatttgtatctttcacttcctctgttccatttattcttaagtattttattcttttggattcattctaaacgggactgttttcttggtttctttttctgatagacagtaactgctgtaaagaacgacagctgattaaaaaactgaaaatcttaaggcagagtccactgctttcttggtatcactaatacaggcaataggaggcacttagtaaattatggaatgaataaatgtaaaaatggagcttaatatgctttaaaagtaccttaataaaattatcaaaattaaattaaaaatataacccaaaatggccaataaggaaactgttactgttttgttttgttttttttttttttttgagacggagtctcgctctgtcaccaggctggagtgcagtggtgcaatcttggctcactgcaacctccgcctcccaggttcaagcgattctcccgcctcagcttcctgagtagctggaactataggcgcatgccaccacgcctggctaactttttgtattttcagtagagacggggttttactgtgttagccaggatggtctcgatctcctgatctcgtgatctgcccgcctcggcctcccaaagtgctgggattacaggcgtgagccaccatgcccagccgtgttacttatttttatataaaatatgaatactctgaaataaaggtaagcaactttaatagactaacatattctcactaaaagaaaaaaatgtgtctgtgtgtgcatatacatataacacatgcacacatctattcctgttttccaaaagtaatctccactaagagttcttcaattattttgtttgatcatcttcattaatagtgaaaataatcttaaatctcattatcattcctttctgccttccttctctgtaagaggcaggggactgagggtttgttcatcttccagcatcttgaataatgaagaactaaccagtatgaagaattattaccaagactgtattcgatggtgatatcacttacattcctacttgttcaaatcagttgttttataccgtgcgatatgtgcacagctctcccagtgatatctgactcctgtatttcaccacagctacaatatacatttgtggacataggatttacagaattctatctgaaagcaaatttgtcaggttgttatattgttgacaaatactcttgtttctcagatcattttttgctggctatatgcacgtgcaggaatctgtatgtgcttgtgttttaattacctaatgcactggctctgactgaataaattgcatgattacctcctacactggacacagaacagtgcaagtcatattaaaaagccattatatttgcaactctgagcaagagactataattaaaaggcagttggatgaaattagctttgagagtacaagagtttaagcaagatttggtaaatgaacattaatggttaacatgtggtttttattaggtcttttgcttcttctctccataaccccggagttgaatttcttagatgtcagtggaccagacatgtgagaacacctgtacaaagctatactttaccatgtggctaaaattatattcataaaacaagccaacataacttttgtgactttagtaaatcaaaggtattagactagaatgatcccctgggcattaataaactattcttaatgctcctaagattttagttatatgtcattaaaagcatactgtgtgctccatgcaacttaaaatgtttgtcataaaatacacatatacacgtcaaagaagtaataaaacttgagggcattttaattattctcaccgttaaatataaaaaagttaaagttgtatgcagtatgtgtaatagcatcccattcttatctgtttgcagactgttgaggactccgcatggtagtgatatttttgtagaggggaaagctttatggagtatgtgtatgtactcaataggtcttacacttaggcagattaaagatgcctgcaaattctggccgggggcggtggctcacgcctgtaatcccagcactttgggaggctgaggcagggggatcacaaggtcaggagatcgagaccatcctggttaacacagtgaaaccccgtctctactaaaaatacaaaaaattagccgggcgtggtggtgggcgcctgtagtcccagctactcgggagactgaggcaggagaatggcgggaacccgggaggcggagcttgcagggagccgagatcgcgccaccgcactccagcctgggcgacagagcgagactccgtctcaaaaaaaaaaaaaaaaaaaaaaatgcctgcaaattctttgctacttctcccagtgagagtaggggtctatttccttccccttgagtttgggctggtctgtgactgctttgatcagtacagtacagtataatgtaaatggtgctgcaatggttatgccaattccaggcttagtttgtaagaggccttgctgtcttggaaacctactgctagtttgctgctgccttggaaaccaactgccgtttaagaagcatgactaccccaagaccaccctcctgggcacaatccaagccagccacaggcagaggccctgtaggataagaaatcatgtggagagagaagctaaggagcaatgaggtgctgggcttgcaagtgaagaaggcgactggaaaagccatctagcctggatcaccccaggtgacgccacaggagttggtccctttccaagtttctaacccacaaaatgatgcacagtacaaaaagattgccttaagccgcttaatttcgggttagtttgttatgcagcaatgaattacatacaccccacttcaggcttgtttttgaattttatggtccctgctttacatgtgtgtgtatacgtgcatacatatatatacgtatagagagattgtcatatgactatatacatacgtacatatatacatatagaaatagataagattttgtcgtatatctagttagtgcccaagttcaaaaggaagtctttatatttctaggtttatatactagatttattttcagccatatgacaatgaaatagtgagttccctcttccttaaacattaaagactgattctatttggtggggtatctaaggaaactgcagctgcctttagtttactaaaactcagtctctaaagattggtggagggagaatctccacttgggaggaacagtttttcttcacggaaccagttctgaggctgggcctggtggctcatgcctgtaatcccagctctttgggaggccaagatgggaggattgcttgaggccaggagtttgagaccaacctggacaaaacagcaagaccccgtctctacaaaaaaaattaaaaattagccaggcatagtcccagctactcaggaggctaaggcgggaggactgtgcaaactcagaagttcgaggcggcactgagctatgatcacaccactgcaggccagcctggatgacagagccggaccctgtctcaagaaccggtcctgccacctgggtgggtcaccttcttggaggaatatcattaattgctgtcaccacaagcactgtccttaaagggccatgctgcacttcacactctgacccaagcctgagcacctagctctttctttatttcttagtaaaactgagatgaggttggaacatgtaaaggcctctattaacggcaagaaaataataccgcttggattctcaggccacaggcttaagagaggtgcacctgtttcaagatctagagttaagaggctccaatggttcatttctatctgagacctggtttaggtttctggctgggatctaccttactcagtattctaccttacccggtatgtctcactgacctcttcatgaaagtttatctccacgcattgtgtgacttcacatttcacttaacacgctaacaacgtaaacggctcaacagccccaaaacgtagataagaaatgaatacattctttatgaactttttctgtaaatctgctggcgggattaaagtattagatagagtatttaactagaagacccctctaaagttacccaagatgggaatagagaatgaacaagagagagaactttgcccctggcaaggggcagttttgcaggctttgtaacccatcgtaaagggttagaactttgccttgtagtcaataaaggaagcatagaagggattaataagcaagtaagtgacatgatcaaattcactctttagaaaattcatttagggtgcagagttaaagatggattgggagaaggaaaagatgaagctgttgccataatctagaggtgaggtgacatgtctttctggacttagtttccagcacaggcacagagcacagtaagtgattatagatgtttgaatatatgcttgactagacaaagctaaaaggatttccaagcagtagtaaacatagaaaagtgacagatgcactaaacttaaagtcagtgacacacaacaatcaaaaggtaaatacacccatttaaaatgggcatagggcttgagtagacatttcaccaaagaagacagaaaaacaaccaataagcacgtgaaaagatactcaacattattcatcactagggaaatgcaaatcaaaaccaccctcagataccatttcacactctcaaggctgcctataatcaaaacaagaagtattagccagatgtggagaaatttgagccttcattcgctgctggtgagaacgtaaaacagtttaatagttccttagaatattaagcatcgttacataaaccagcagtttcactcccaggtgtataccaaagagaaatgaaaaaaatctgtccacataaaaacttatatatgaatgatcataatagcataatacataatagccagaaagaagaaaaaatccaactgctcgccaactaatgaataaacaaaatgtagtgtgtccatacaatgaaaatttcagccataagaaggtagcactaatacgtgtgataacctggataagccttgaagacatgctaagtgagagaagccagacacaaaagtacccatattgtaaagtagcatttatgtgaaatgttcagaacagacagacccaaaggaactcaaacccaaagagttccccaaagaggttagcagttgccggggcgagggcgtggaggcggtagggagtggccgctcatggtactttttgtggcatgttaagaatgtgctgaaattaggtagtgtcagtgattgcagaactctgggaatgcagtaaaaaccgctgagttgtatactttgaaagggccaattttatgacatgggaattgtatctcaataaagctgttatttaaaaaaaccatttatgcaaacttttatagacttcttaactattttacagtcactttcatcagaagtaataacgcaaaaattcaaacacccaggaggttacacattctgtgttaagaacacagactttgaaatcaagcagactgagtggaaacccagttccatcccgtagaaactgtgtgacgttggacaaatgacgtaacttctctgaacctttaatcatctctaaaatgtaaataatacctatcagacatgttataaaggtgaaatgagacaacagagaaaaaagtcctaagctaaagtacggacatgaattattatccagggtattgttattctttactgtgccaagacaatgacccagccccctgaaggtattacagttttatagcacattctaggtggttgacataaattgccatgtttatgtttccttagtgagcacatatattaacgtttgaaaagtatgttgaggccaagcacagtggctcaaacctataatcccaacactttgggaggcggaggcaggagcatggcttgaagccaggagttcaagaccagcctgggcaatataacaacaccccggttctacaaaaataaaaaaagtagccgggtatgggggcacacgcttgtagtcccagctacttcggaggctggtagaaggatctctttagcccaggaatttgtggctatggtgagctttgattgtgccactgccatccctgcctgggcaacagagtgagccctatctcttaaaaaacaggtggggcgcggtgcctcatgcctgtaatcccagcacttttggaggccgaggtgggcggatcacgaggtcaagagttcgagaccagcctgaccaacatggtgaaaccccatctctaataaaaatacaaaaattagctgggcatggtggtgggcacctgtaatcccagctactcaggaggctgaggcaggagaatcgcttgaacccgggaggtggaggttacagtgagcagagatcatgccattgcactccagcctgggcgacagagcgagactgtctcaaaaaaaaaaaaaaaaaaaaagaaaaagaaaagaaaggaaaggaaggaaggaaggaagagtgcagatgctgggaggcgccttgcactaaggcggctttcatactgtgcgtaggagcttcggtttctcacatttagaacctaaagccattgaaggtagagctctaatattttgtattattttttaaattgctcataagaactgagctcattttcaagaaatacctcaacctataaagcataaataaaaggcataagcaccaaaaattcacgagctctaaggaaccattctggtgaatgcattcttcaaaaaagtagtgcgtttaatcagaggagcagtaagttcaggtttgcatgctgtatctgacacctttgtgtggcccgtggatataagcagatgtgaagcagaaaagagggaaagactggagaattgttggtttggaaataagaaatatggaaagcctggaaaaagcacagttgtcgggataaggaggagagaggaggaaggacatgtttgggttaagtgatcaagctggggccgtacgcggagtgagggagggaggaggaggagcagacaggcaggaggatcctgaggtattcagcttgctggagtgaatggattgagatgcggttgaaggagatgggaactgggaatgcaggaagagaagccagaaggggagactgcatgacagttcggctgaagataagaattattctgaaatggcagttgtgcatgttggaaaaataaatcaccatggaaatgagcctgatcaaatttgactagggaaactgagagttgtacagaactctcattccaaaatgttatcaagtccttaagataatttaactctgtgttgcaaaataggtagacataaacagagaggaaaacagtattttcatacagaacaatgaagaggaagtactagatttaattggacacacgcttctcacatttaaagatggggaggagataatggtgtccctttgtgtccttcccaaagaaatatggggaactgataatgcctcacataagtcttaaaggaagaaaatgtagagcatgcacttttgcagatcactctctcattaacaaacaagctcagaagaaatgtggtctcaatgaaatgcttcctttcttggagcttaaatacggtcaaatctaaatatctaagaaatcaggaagtttgacatctttaaccactaaagattaagacaaattttttacatgtaaagttttatctggatatagggacttcctgatcaaggaaatagttgaaaggaataaaaaaaaacaactgagtcacagaacattccatcaatgaattattgtccaggtttgttcagaagtggtgacactaatattattttgctcaaagtaaataaactgcattgctgactacataaagagagagaagttgtacctttttgcttacctctgttttcccgatgcctagtgtaagttgtctagcacgtagtaagcagacagaaactaactacatatgtggaatgaatgtacgtgggaaagatcaattctgaaacgtgtatagacgagaagtaacaaatattcttaaaatagtacaagaactcatcattcattcatcaaattcgttttaatataaattctttattgaaatattagagacagaaaataagtcataaatgctcttatattccccttacctgcttccaaactttaccttccctaccgcaaaagataatctttctactaacctctaacgccatatttgctgttgatggcatctgagaagtctccagttttcagctattactaacagtgctgtgatgaatattttgtttttttggttttattttgttttagaggaggggtctcactgtcactcagacttggatgcagtggcatgattatggctcacggaagcctggatctcctgggcttaagtgatcctcccactttagccgcccaagtagctggtactacaagcacacaccaccacacccagctaatttgaaaaaattttttagagatggggtctctctcgccatgttgcccaggcacatcctgaattcctgagctcaaatgatcatcctgcctcagcctcaaaacgtgctgggatcacaggtgtgagtcaccatgcccagcctcttctgtatataactagaattgcccgttctttggatgtatatatgatcagctttaaaggatatttttgaacagttttccaaagcaagagaggaaattcctctaaagcattttcttaagtgatgaataggagctttctaatgcattctttgccgttttcacagtgtggacattgacattcatggtgcaaaagcaatgatggataaaccagttggtgccttagaacgaatcaagccagtggcaccaaactgtcttagtagtcattacatactagtagtcactgccatgtatcaaagcaaacaagagccagttttattttttgaatgtcttgatgatgtcggtttaaaaataaataaatagaaattttaaaacttgaaatgttttaatgaagcactaaaaagagtcagttttactacatctcagcccttgagttcacattattatgaagtattttttaatattttctctggtgaaacggacatacgcataaagcgtatctgttgcatgcccaagtacccaagtacaacaaatgtatcaaagaatagaatctatgaaattggtggacttgagagctgacttagctgatttttttcatggaacataaattttactcgaaagaatgacgaagatgctgggtatggttattcagattggggtgtctctcaaaaatatacagacatactcttagaaacaagtgaaatgggcctgtgatctcaaagaaaaaactgtttttggtcagggatagaatttgagttttcacaagaaaactagaaattttaaaaattttaaaaacttgaatctatcactgtgaacttcgcagcttgcccgtactttaaaattttctgataagattatcatgttgttttatgaatataatttttcaacattatctactgaaatatgtcaacatttggaagatctgaataactcagtgaaccaatattttcaatgtatcatattacaaaattatacatgaggagagatccattaaaagtgcaagagataggccaggtgtggtggctcacacctgtaatcccagcactttaggaggccgaggtggttggatcatgaggtgaatagatcgagaccatcctggctaacacggtgaaaacccatctctactaaaaatataaaaaattagtcaggcgtggtggcgagcgcctgtagtcccagttactcaggaggctgaggcaggagaatcgcttgaacccaggaggtggaggttgtggtgagccgagttcatgccactgcactctagcctggcaacagagcgagactccatctcaaaaaaaaaaagacctacacctgtaaaggtttggtgtagattcaaagagtatccacaggtatctgaaacagctattaaaatactgtatgaggctggcttttcttcatatacttcactcagtcaacatatcaaaacggattgaatacagaagcagatatgagaatccggctgtcttctgtaaatcctaagtgacagttccattgtcataaaagaggacacatagaataatttttccagaaactccaaggtcaaaatctatattttaaatgtgcctaatgtacttctaaagtaagagttcttactttgattagttaaatcagaaaaaatttttattcatattcaaaatagtataaatatataaaaatgttaaaggcatagccaattattgatcacagaagtgacatgatacagtcgtttgttacaaatctgagtgattatttacaaatctttagagttgttgtctgataggactcagtacggcagttggagtgtagctgaaagtaggataaagcaggtggatatgtgcagatgatagaaatatggagatggtagaatcaataataaaaatatcacaaaacaagctccgtgatcctactttagctgttaaacttttgttgttgttgttgttactgagacggagtctcactctgtcgcccagctgttctcagctcactgcaaccttcacctctggggttcgagtgattctcctgcctcagcctcccaagtagctgggactacagggggggcaccaccacgtccagctaattttctgctaaactttttgaaatgagaggcccatggtaaagtagatatcaacataaggcttgttgagtgactgattaattctagattattattctcatttattggcacaaaaacaattacacattgctttctatttggctcctctggtgcccttaccaccactgcacagttcctacatatgccgtgattcttaacctttggagcttgagtaattacccctaaatccctctcttaaaaatcttgggggccaggcacagtggctcacacctataatcccagcactttgggaggccgaggaaggtggatcacctgaggtcgggagttcgagacaggcctgaccaacatggagaaacctcgtctctactgaaaatacaaaattagccaggcttggtggtgcatgcctataatcccagctactcaggaggctgaggcaagagaattgcttaaacccgggaggcggaggttgcgggttcaagcaacctcaagcctgggcaacaagagcgaaactctgtctcaaaaaaagagaaaagaaagttccttggccttttcttgtgtttcttgaccttgacattttttgaggagtccaggccagttattttgtagaatgtgtcagtttgggtttgtgcgatgtttccttgggattagattcaggttgtgcatttttggcagaaatacaactatagtgatgttgtcaccttcaccatgcatcgaatcaaagggacatgatggcgatggcttccaaggtgatgttctctttgagcacttggtaaggtggtgtctgcttaatttctcgacaggcaagttactgtttttcctttgttattgataagcaacttctgggggatacttggagactacgcatatatcctgttctttatcatgctttcacccaatagtacccactgatgaacatattgtgtatacatgaaataataataaactattatcactgatagaaggaacatattgtgtatacatgtaataataatgaactattatgacttcttaaagcaggttgttcattgtttcctgagtataaataaatcagaaatgaatggctttaattttctgtaaaatatgtttacttagaaaataatagaaaatgtcctttacaaaatgagttctagggttttattgaacaaaatgtgtttgcaaaacactgtggggtgaaaagagtatgaccccttacttccccatcataacgctcctggctgacactcccgtaataaaagacaggttaacaagagaaaagcataacatatttatttgatcaaagtttttttttacgtgacaaaggaaccttcagaaatgaagccccagaggtccccagaaaactgtctgtttttatgcttaggctgggtgattaggggacatctttgtagaaatgtgagtgaacaaaaggggaagctctaatgctaacagactgagtgcagacacccagcaaggcctgtctgttcagattcttctcagcctctccctgcagcatgcagcatcccttcctcctgggtatggggcagggcccttctggaatgcgggtttatgacctccgtgcaggcaaaatagaccagatagtttctttatggccaactcttacacagaaaggcaggggaagattggagtaatttttttttaggttttaaggctagctttcagggagaatggttctggtttctatggacttgccttggggaagagggattttagtttccttgtttgtttgtttgtgttttgagatggagtctcactctgttgcccaggctggagtgcagtggcacaatctcagctcactccaacttctgcctcccaggcttaagtggatcttctgcctcaacctcccgaataactgggattacaggcatgcgccaccacagccggctaatttttgtatttttagtagataccaggttttgccatgttggacaggctggtctcgaactcctgacctcagatgatccacccgcctcggcttcccacagtgttgggattacagacatgagccaccgcacccggccctagtttcctagtttctatggtcggccttgggggagaaagtttagcaggaggaggaaggcgaggagaaggtcagaaactttgcttctgaggccctccaaggccctcccaggccctttgctccaagtcctcagcaagccagaggacgtcttctgagcccaacaacagtttaaggcattccaaaattagaagagcaatcaggcacccaaccatactaaaagcgtgtttatattttcgcatattttccaatccattgaacaaacaagcaaacaaacaaaagaactggtgtgtagagtgaaaggagcgttagtgtgtataatatctgtggacagaatagtcgtctgaactgaatctacagcaaaactacaaagctgtgatattgtgactccgagaaagtgcagatttcatattccagtaagatttattgaatgcccgttgcctgctaagcatttcatacataagcatattcacacacagcaccttattttgttatcataactctatagggcaatggtattatgctattcttccactcaagagaacttttcagaggttcatttacttaacaaatcataactgccacatcccaggtgctttgttaagctctgggaatgcaacctggaagaagacagatctggttcctctcactttctaagcccagttataacatgctgggcccatgattttactcaacagtaaaatcgaggtttacgctgtgtgctaagagaggcatccaaaccaaacgtgtggactcaggggaggctttgctgatggaacttctaattaggctgggaaatgaaagacgacaggaagctgggtgaggaggggggatggtggtggagggaggacccaaatattccaggcagagggaacgttgtctcaaaaaaataaaaatagaaataaaaaaggcttctgttgggcacgatggttcaagcctgtaatcccggcactttgagagggtgacgtgggcggatcaggaagtcaggatatcgagaccatcctggccaacatggcaaaaccccccatctctactaaaactacgtggtggcacatgcctgcaatcccagttacttgggaggctgaggcaggagaatcgcttgaacccaggaggcagagtttgcagtgagccgagatcacgccactgcactccagcctggtgacagagcaagactccatctcaaaaaaaaaaaaagaaaaagaaaaagcgcctcaggctgtcccagcattttcattcaaaaaggagctttgagagacagccaggtggctagtgacgggctagcagaggcagagagggctgcaccttttctaccacagtttaacattgctcagagattgcgtgtctaacctcaggaaggttttgacatagtttacactgattttactttgttcacttcaggatggaaaggatggcagagtctctgctgcatccaggatagtatgaatcattaaaatgctgaaaccactttcagcagtgtattctagtcctggccggaagtcactaacctagctgaaacatcaaatattatggtaatttggtctgagaataaataatagattatgttaatacagacagggatgagataatgagaaacaggctacttaagaagcatattgagtggtttatttgtgaatcaaaaagaagcaaggaaattgcattaaaagaaaaactgaccctggagtcactcttttaggtgaccttaatattccataaattataagttaagataaatgaaacaaaagctctatattatgaagagtgaaattattttgtaattctgacagaaaactaagtattctaacattttactgaagaaaagcctgttgatcattctcatttcccgccacagaacacgtataccctttgccaacacttactgagcagttactatgtgcggttactaaggtctaatgttttgttttgtttttttttgagacagggtctcactctgttgcccagactagagtgcagtggcgtgacctccgctcactacagcctcaacctcccaggcttaaacaatcctcctgcctctgcctcccaagtagctgggaccgcaggcacgccatcacacctggctaatttttctacctgtttagcaacagggcctcactatgttacctaggctggtcttggactcctaggctcaagcgatccacctgcctcagcctccccaagtgcagggattacaggtgtgagccaccatgcccagcctaactctttacatccacgcatatactaccttaaacatctttgccatgcgagaatgtagataccacttgtatagattgggaaactgaggcacatgatggttgaataatttgccagaggaaacagagctggcaggctgaagggcttcagaccaaaacttctctgacctcatttggtagcaaaacatatgcaaagctttctacaatctttacataccccattaagtatgaatacttatacattctcctgcagaaatatgtataatcataatatactgccccaaatccctcttaggagaactgatagatggtgtgtggattgtctcctgtctctaaaaaacactctgaggccaggtgcgggggctcacgcctgtaatcccagcactttgggaggccaaggagggcggatcacgaggtcaagagatggagaccagcctggccaacatggtgaaaccctgtctccactaaaaatacaaaagttagctgggcgtggtgacacacacctgtagtcccacctactcaagtgaggcaggagaatcacttgaacctgggaggcagaggttgcagtgagctgagattgcaccactgcactccagcctgagcaatacagcaagactccgtctcaaacaaaacaaaacagaaaaacactgtgaattctaaatatctgacctcaggggttttggaaaaggcattttggtcctttgcaatttatacaccaacaaataatgaattaatatagtaacataataatttatttagtataccctttaaatttaatacttgcattttccagatatcaatataaagaaattggcaaacctcaaataaaattcaattggcgtgttttagagacagttatgctgctcttgtgggccgctgcctgaaatccaggtggctgcctgctggtagtctggagtgtagtgtctccagaatgtaaagcactgaacaaagcaaggacatcatgagacatcctgtttgaatattttgtctgcaatttagtgaactgtgtgatcctcagcaaattaccaggtgactctgtaacactgtgataacagtttatgtgtccaggttattgtgactattgaataagatgatgtgggtctttacacctggcctcttcatgggcatgtcgtaaattgtagcaattattaagctagataattatacatagggataatacttttctatcaaagcaaataataggcactagctaaatgtctccatgaaagctaagtatgataaaatacacaggaagcatctccaacatgaaaagtacccttagtgctttgtaagataacagttcccacagtcatagagcttaccttttggaaaggcggaagttgaaaaatgacttttttttttttttcagacgaagcttcgctcttgtcccccagactggagtgtgattttgcaatctcagctcactgcaacctccgcctcctgggttcgagcgattctcttgcctcagcctcccgagtagctgagattacaggcacctgccaccacgcctggctaatttttttgtatttttagtagagatggggtttcaccatgttagccaggctggtctcgaactcctgacctcgtggtctgcctgcctcggcctctcaaagtgctgggattacaggcgtgagccactgtgcccggccgagaaatgattttattatgtagctttgaaatgagttcaaacacgtaatttgctacatgagtgacttaacgttttcctgtgataaaaacatggagtgtaatcttccccacgagaatgctgggtcacactttatcaggccacatatgtgttgctggcttcaacctctagaccccaaacacagaaaatgtgagattttgacaggcacattgagagttcaggctgtggcaagaatactgtctgccaaccttcaggcaagtctctgaagccgtacccaccaacactggcaccactggctggcatcaggggccttgtgtcatggtggatctatgctgcattgctgaaattcactctccaaagaacctctcctagaaagggacacctcctagaaagagacacctcacacttgcattcaactgtacggctacagaggccttctgccatcctaactgaccaactagactttaataaaattagaactcacttactctgtggttaatggacctccctcctccatggagtggattccctgtgagagctgttctcattattctcccccttttgagcactgaaataaacaacaacaaaagctacaaaaaaaaacctctttacatggcaataaactgtgattcatgaaattatactttgttcatctcatttcaatcataaaaaacactttaaaaagcaagtttagccgggcgcagtggctcacacctgtaatcccagcactgcactttgggaggccgaagcaggtggatcacctgaggtcaagagttcgagaccagcctgagcaaggcggtgaaacactgtctctactaaaactacaaacttagctgggcatggtggcgggtgcctgtaatcccagctacacgggaagctgaggcagcagactcgcttgaacccgggaggcagaggttgcagtcagcagagattgtaccattgcactgcagcccgggtgacaagagtgaaactccatctcaaaacaaacaaacaaacaaacaaataaataaaaaataaaacgcaagtttaaatgaatatgagaagatggtaagtgctatgcagagaaaaagaaaaagcagaactggcttggaataggtgttgagggagcgggcagcatgagtgacaaaggtgacaggtggtaaatataggcctcaatacaaaagtgaagtcggatctgagactggaaggaagtgaggacctagtgagtatcagtagaaagtgttccaggcaaggactgtccagggcaaaggccctaaggcaagaattgccggctatgttgattcaccatcaaaagcatgcccagagccctgagccaggtgggggaattgggggagatagtagagtagatgggttcagagacctgggagtgtggagatccagagaaccacacaagacagtaccggcacttctgacagtttctttgttatgtacctgtgcttccatttgaaatcgtccggcccaggggtcagcaaactttttctataaagggccagatcatgagtatttttttttttttgagacggagttttgctcttgttgcccaggctggagtgcaatgacgggatctcggctcaccgcaacctccaactcccggattcaagccattctcctgcctcagcctctggaatagctgggattacaggcatgcgccaccatgcctggctaattttgtatttttagtagagacaggatttattcatgttggtctggctggtctcgaactcaggacctcaggtgatccacctgcctcggcctcccaaagtgctgggattacaggcatgagccactgcgctcggcgatcatgagtatttttaaacgttatggttcatatgatctctgttgcagctactgaactcagctactatagtgtgaaagccataggcagttatgtaagtgaatgagcatgattctgtttcaggaaaactttatttacaaaaacaggcacggggccatgctttatctgccagccatagtttaccgacccctgctttggcctaacttataaacacaaggaatttttctctctgttttcttctagacattttataatcgtatttattccttttttatatatgaagagatttattctgagccaaaacatgagtggccagttgcccatgtcacagccctcgggagatcctaaggacatgggcccctattttttcatttgggtctgtggttcattttgaggttatttgtgtgagtgttagctaatgcttgagtttatatagaaaatatgtcttatttatatttaacatatttctggcctatggatatctaattgttcagcactatttgttgaatgattatgttttccctttaccttgacacttcagtcaaaaatcaattgagtggggcacagtggctcacatctgtaatcccagcactttgagagaccaaggcagacggatcacttgaggtcaggagttcgagaccggcctggtcaacatggtgaaaccctgtctctactaaaaatacaaaaactagccaggcgtggtggcacgcacctgtagtcctagctgctcaggaggctgaggcaggagaatcgcttgaatctgggaagcagaggttccactgaggttgcaggttgcactccagcctgggcgacagagtctccaaaaaacaaaaaagtcaactaaacgtgtgcacctgtgtgtgtgcgcacctgtgtgtttgcgcacctgtgtgtgtgtgcctgtgtgtgtgtgtgcgcacctgtgtgtgtgcctgtgtgcgcgcctgtgtgtgtgcctgtgtgtgtgcctgtgtgtgcgcctgcatgtgtgtgcacctgtgtgtgtgcctgtgtgtgtgcacctgtgtgtgcatgcctgtgtgtacgtgtgcacctgtatgtgtgtgcctgtgtgtacccgcctgtgtgcgtgtgcacctatgtgtgtgcgcctgtgtgtgtgcgcacctgtgtatgtgtgcctgtgtgtgcacctgtgtatgtgcccgtgtgtgcctgtgtgtgtacacctttgtgtgtgcctctgtgtgtgtttacgtgtgtgcgcctgtgtgtgtgcatgtctgtgcctgtgtgtgcctgtgtgtgtgcctgtgtgtgtgtgcgcctttgtgtgtgcctctatgtgtgtttacgtgtgtgtgtgcctgtgtgtgcgcctgtgtgtgtgcgcctttgtgtgtgcctctgtgtgtgtttacgtgtgtgtgtgcgcctgtgtgtgtgtgcatgtgtgtgtatttgtctctctattttggactctctattttgctctattgatttctatgttgattcttacacaaatacaacactgtcttgattactgtatctttatggtaagtctttttttttttcggagtctcacactgtcgcctgggctggagtgcaatggcacgatctcggctcaccgcaacctccgtctcccaggttcaagcgattctcctgcctcagccacccaagtagctgggattacaggcgcccaccaccacgcccagctaattttttgtatttttactggagatgggatttcactatgttggccaggctggtctcaaactcctgaccgcgtgatccacctgcctcggcctcccaaagtactgggattaaaggcatgagccaccttgcccagcctatggtaaatcttgacattaggtaatctaagtcttttaactttgttcttatttaaaattgttttggctattctgtgtcccttcatttacatatatgttttaggggcagcttaccaatttctacaaaaaaacactgttgggatattgatgtggattatattgaatctatagatcaatttgagaagggtttagttcttaacaaggatctattagataggataacaaatgtacaaaccataaaagaaaaaaatgatgaattgcacttcaccataattaaaaaggcacaactccaaaatggcaaaccataatctggaagaaaatatatgcaaaacataaatctaataaaggacttgtatccaaaatacataaagcgcttttataactcaataataaaaaaaatcaacctaattaaaaactgggcaaaggatttgaatagacaattcacaaatgaatatatataaatggcaaacaagtacatataaaagcatactcaacatcattagttattgggaaaatgcaaattaaaattacagcgagataccactacgtagccactacaatggctgaattttaagcggctgacaatgccaagctttgtcaagagtatgagacaactggaactctcacaaattgctagagggaatgcaaaatgaaaagtatgcagtttcttaaaaagtttaccctctcctcctgtatggcccagcaaacctgctgctaggtactcaaccaactgaaatgaaaacatgttcacacaaagacatgccctgtgatgttcattgcagctttattccaaattgccaagaactggaaacaacccaaatgtccatcagctggcgaatggataaacacattaccctatgtacatacaatgcaatactcctgagccctcaaaaggaataattcactactacatataacaacctaaacaaatctcacatgcatttgctaagtgaatgaagccatacacaaaagggcacatactatgtgattccatttaaataaaaatggattgcagaaaagcaagcctacagttagagaaagcagatcagtggctgccagagaccatgaaagtggtggttgtgacaggaggattaactaggaagggcatgaggagagttggagggagatggaagatggacctgttctacactgtgacttattgttaaatgatgcttacatgtgtggaagccgttgaatcacaataagcaggcaagctttgatggaggcttgaaccagggtgatagggaaagggaactcacaatgagtcatagacacaaatgttaaaataaaactagtaaacatctagaaaaaaaaaacgaaagaaaaggctgggtgcggtggctcatgcctgtaataccaacattttgggaggccaaggtgggcagatcacttgaggtcaggagtgcgagaccagcctggccaacatggtgaaaccccatctctactaaaaatacaaaaattagccgagcctggttgcgcacacctgtaatcccagctactcaggaggctgaggcaggagaatctcttgaacctgagaggcaggggttgcagtgagccccactgcactccagcctgggtgacaagagcgacactctgtctcaaaaaaaaaagaaaaaagaaatcagaaagaaaaaaacctttctgtttataagttaggccaaagcaggggattggcaaactacatccagcaggtgaaacgtggcctccgccctgtttttcctaaataaagttttaccgaaacactggccttgcttactcacttgcataatgcctatggctttcttgctgcaggactgagctgagcaggtgaaaagggctcagattctctgttttgaaggtagagtcacaggatctgaaggctcgggtgtagaacatgagttttgaggatgatgtgccaccctcctcgcttcctgcggaaaggacggccgtggctgagcgcggtgggtgcgggccttgatcccggactgcggtgtgttgtcaggtttctccaccgtaagatcctttttccacaccgcgctcctgggaagaaagtcagaaagtgcagcccttccttaggcaagcgggagtttcgctccggctctatccaccctgtttttaaaactgaacatcgtacacattcgaaaacaactacaaattctctttcattagctaattttattttattggttcctcttgaagttagatgatgttatacattcatgatcccagcccagagctcctgattcagcctagccagggtgaaacccaccggattaacaaatgcctcgtgtgattcagatgcaaatagcccatcagcccacttcagaaagctcctctctaatcacttactaatgataattactctgaactaggacctctttacggaggctgaagctgtttttctcttggttaaggtattgtcattagtttcctgtcagagtcggggtcacctctctgcccttgtcggcctgcccaacagtcacacaagttgaacgaattcggcaaccacctcattactattcattgcccatgcggatattcaaacgcagcacacagctctatcgcggctccactccacgaaaagtcccaagtatatacaaataattgtataaagtactaaaaatgcactttaaatgagttccacatctccaagacacagacaaaccaaggctattgtcaagagtccttctagaaatgtgccttcaaaagacacaaaaggaaacaacgggagacattcaacgaggacagtggtttcctccgacgaggggaatggaaagcctggcgctgggagagctgcgctcttgaccctcctttccctctaactcgcccagccatctagggaaatgcacttcgtttttgcgcttcaacctcttatctgtaaaacattaataataggccgggcgcgggggctcacgcctgtaatcccagcagtttgggaggccgaggcgggtggattgcctgaggtcaggagttcgagaccagtctggtcaacatggtgaaaccccgtctctactacaaatacaaaaattagccgggcatggtggtgcgcgcctgtaatcccagctactggggaggctgaggcaggagaatcgcttgaacccaggaggcggaggttgcagtgagccgagatcgcggcaccgcactccagcctgagccacagagtgaaactcagtctcaaaaaaaaataataataatagcacctgcctggttttactttgcgtagatttaggataaaattagacactgcgtgcatctgagaaatacagttgtcacacagatgtgaagttttctgttttttgtttttttctaaagcagtcttgtttcaataaaaccttatttacaacaacggattttctttatttctttacaaatactcatgggatcaaataattcaatttttaatttttaatatcatcatgattctatgcccagatctaggttaaggaaacaaagttgaagaaacaaattgcctctgatgtcccagcagataatgaagtagatcaagatatacgacacacaaaattatacacaaaacctgtagattctaggagtattcctatcaagttctatttagttgcttaaaataattaccttagcattctaaaaatctgtaaacaatatggcatttctgaatatttaacattggccttttcaaaatgaagttcaattaccatttcccctgagaagctgtaagcctgagagggtctcgtctcctgacactacggttttcaatcctggctcggccgcttactggctggtgattgtgggtgagtttctatgctcttcagttttctcatcagtaaaataaagataagaacagcaccaactttgtgggttatctgtgagtagttagtgtccacatgtgcagaagtctttagaacagtgctatatgtgtttaatattgttatttttattactatcggttttaagggattaagcagctgttgaaaccaatgagactacttttttttctttttctttttcttttctttttcttttctttttctttctttcttttttttttttttttttttttttttttgtttgagacggagtttcgctcttgttgcccaggctggagtgcaatggcgcgatctcagctcaccgcaacctccgcctcccgggttcaagccattctcctgcctcagcctcccgagtagctgggattacaggcgtgcaccaccaagcccggctaattttgtatttttaggagagacggggtgtctccacgttgaagctggtctcgaactcctgacctcaggtgatccgcccacctcggcctcccaaagtgctgggattacaggtgtgagccaccgcgcccggcaagactactctttaatacacgcacacacacacaaacacaaaacctggaaaaatgtgctcaaatagtttgttagtactttatataacaactgaaaattctttggatttaatcaaaatggcatatttgaagtaaaaacacctatacctactctctcaagcctcttaggtagaaaatatttgatagaaaggaaattaattggattaccaaaggacagtaggtgaccccaattacttttgcttttaattataaaaaaagtctgagccataaaattggaaaactcttcctgtaatgaaaaatgtagagaagtagtttcacaattttacattttcttttttttttttttcttttgagatggaatctcacgctgtagcccagactggagtgcattggggcgatcttggctcactacaaactccaactcctggagttcaagcgattttcctgcctcagcctcccaaatagctgggactacaggcacctgccaccatgcccggctgattttttacttatttatttatttatttttatttttaatagaggtggggtttcaacatgttggccaggctggtctcaaactcctgacctcaggtaatctgcccgcctcagccttcctaagtgctgggactacaggagtgagccattgcgcccagcacaattttttttttttttagactgagtctcactctgtcgtccaggctggagtgcagtggcaagatcgtggctcattgcagcctgcatctcccgggttcaagcgattctcctgcctcagtctcccgagcagctgggattacaggcacgcaccaccatgcccggctttttgtgtttttagtagagatggggtttcaccatgttggccaggctggtctcaaactcctgacctcagatgatccacccgcctcggcctcccaaagtggttggattatcggtgtgagccaccgagtctggcacaattttacattttctctttaactgacacaaaaggtcttcctcttatgtgacagtatattacgatggtatgatataccatcctattgactaatatttaaaattgcaaatcacttatcgaaatccagatttttaaagattaggtttaaatctgaatgcttcacaaagatcacttggctgccccggaagagctgagttccccccgcgctcagaggccgaagaggtctttgcgattatgggagctttcttaccactgtgggcacagagtctcatggcacctacacaaagggcctgctcctgtatttttttgtggtttcccattccattcagcacagacaaagggacccgttgaaaggcacacaggtggattctcttaaaagacatttacggatattaaaattttaaagtttatctgagcaaaaagctattcataaattgggcagctccagacggcaagcagttgggctccaccaaggaggggagtcgaggggactacttttataagatgtttgtagaaagaggctggttaagcttaatttactattcacactgagcactgtttccgtttgctgacagaggaactcaagggattggggccagctcaacctaatggtctctcaattgattttttttttttttttttgagacggattctcgctctgtcgcccaggctggagtgcagtggcgcgatcttggctcactttccaggttttcttattgccctttttctttatttcggcaagagtgagggacatgcagccaacagtctccagtaattcttcactctggcttccttcagtagggacttgacattttgatgtaggtgtcttgatgctgttgtttttacatgtacattttccctcggaccaaaaaacaaacattaaatatttcctcaaaaaaaaaaagctttatttttccctgcttataaaaataaacagaggccaggtgcggtggctcatgcctgtaatcccaacactttgggaggccaaggctctgggaggatcacctggggtcaggagtttgcgaccagcctggccaacatggtgaaaccccatctctactaaaaatacaaaaattagccaggtgtggtggctcgcacctgtaatgccagctactggggaggctgaggtaggagggtcacttgaaccctggaggcggaggttgcagtgaaccgaaattgtgccactgttctctagcctgggtgacaagagcgaaactccatctgaaaaaaacaaaaacaaaaaaacccagaaatctctcaattaaaaatggatcctgaatttcatcttttaattttatatgtattctgaaatgctatcagaaacaactatgaataatggagatgagagatttcaaagaatttttacaaagaaggcaataatgatctagagcttgactctagctctgtgtaaaataaagcttgataagtagttgttatcggccgggcacggtggctcatgcctgtaatcccagcactttcggaggccacggctggcggatcatctgaggtcaagagttcaaggccggcctggccaacatggcgaaaacccatctctataaaaatacaaaaattagccgggtgtggtggcaggcacctgtaatcccaggtactcgggaggctgaggcaagagaatcgcttgaacccgggaggcagaggttgcagtgagccaagattgcgccattgcactccagcctgggcgacagagctagattctgtctcaaaaaaaaaaaaaagaattcattatctccaacatgtttactatagctggggagcaaagtgaacataaattgagtataaaaggtaattcataatgaagagctaaattgtgttgtgaagactgaggatgttacagttcaaagcactgagggctagagcagcaaagacggcttcgtttgtagtgaagtgccttcaaccactcctcaccccagttgcctgcttcgtaggcatacctcttcaggaaaatcactaatttatactctccaagaatacatgagtgtgctacaaagaaaaaaaattaatggtaaaaatatttatagaaaaaatcgtttgaagtgaattattatacattttttagatgtgatgatggcattgtgatcatgtttccgaattttccttatctattagataaataaaatagttcttcatgatatgaaatgtcgaaaattttcttcaaaatactccaaaaataagtttcctggcacaacttttaactttgccaagcgcaatgactcatgcctgtaatctcagcactttgggaggccgaggcgggccaattacttgagcccagaagtttgagatgagcctgggcaacatagtgagagactgtttttacaaaagtaaaaaatatatttaaaaaaataaaatactaggtggatgtggtggcgcatgcctgtagtctcagctactcaggaggcgaaggtgggaagattgcttgagcccagaaggtcgaggctgcaataagccctccagcctgggtgacacagcaagaccctgtctcaaaaaaaaaaaaaaaaaaaaaaaagaaaaaaaaaaaaagaaaaaaagtaaaaagaaaagataagcttaacaaaaaagaaaagaaacttttaacctttaggttgattaaatttctacgagattttctgatttttctcatgggctaatagtcatgagaggttagaggtttatgataagaattttttttttttttgagactgagtctcactctgtagccaggctggagtgcagtggcgtgatctcagctcactgcaacctccgcctcccaggttcaagcgattctcctacctcagcctcctgagtagctgggactacaggcacccaccaccacgcccggctaaatttttgtatttttagtagagatgggtttttgccatgttggccaggctggtctcaaactcctgacctcaggtgatctgctcgcgttggcctcccaaagtgctgggattaatactatcaaattgcctttttgttttgctaatatttaatactcatgataaaaagattttagactgtagcaggtttttctttttaaccctggttatattatttggcatgattcagatgttgaagtagcctcaattttaaaattctgccaggcgtgaaaaggcatccgccctctagcttactttacctggccactgcttgtatagcttacgaggtttaatcttgtcatttctggttgagagaagcagattttcacccacatgtagggttttagctatgtttgttttttctaaacagagccaactgttaattaatttctaagagtaggtaatacatgcatgcacccattacaaaagtagaaaaacaaaatgatttacaatgcaaagcaaatctccctctcataccaagcccccagctacccaggctccagcctgctcacttaactttggtcaattgagatcagtttacactccttcattgtttcataacctcttggaaagttctcgtaacaggaaaatgtggctgcattttcaattctgacctgtttctctaaatagatcacattctctaatctttctatgacttttctttctttcttttttttttttgagacagagtctcgctctgttgccaggctggagagcagtgacacgatctcagttcactgcaacctccgcctcctgggttcaagcgactctcctgcctcagcctcatgagtcactgggattacaggcacgtgccaccatgcccggctaattttttgtatttttagtagagacagggtttcaccatgttggccaggatggtcttgatcgctggacctcctgatttgcccacctcagcctcccaaagtgctgggattacaggcgtgagccaccgcatccagccaacttttcttaatttaagatggacttctatctcactgtgtaagtaaagctcaaggcatcatttattcttttaatattcacttcctctcacttctacaggatgtaaactgtctcaactctttttcttcgtttgtaagctgtgatcgtttcttaatttgttttattatttttattgccttctctgttttcctaaaatagtttctaaattttaaatgaacttttaattttagaaaagttttagatttacagcaaagatgaaaagataacacaccctcactcccaatttcctgcattgttaacgttgtacattatgatggtatatttgttacaactcaagaccaacactgacgtattattattgactaaaccccacactttatttcattttactagtcttcccttctatcctttttctgttccaggaggccatcaggatcccacattacatttagatatgtgtctccttacattcctctagtttatgacaatttctcagacttcccattttgataaccctggcagtttcaggagtactggccaggcccctatacaaagttcttccatcttggtttgatgtttttatgaatagactgaggttatgggtgattggggagaatatcacaacactgaagtagcattctttttttttttttttgagacggagtctcgctctgtcgccaggctggagtgcaatggcgccacctcagctcactgtaacctccacctcctgggttcaagtgattctcctgcctcagcctctggagtagctgtggaccaccacgcccagctagtttttgtatttttagtagagatggggtatcactatgttggccaggctggtctcgaactcctgaccttgtgatccgcctgcctcggcctcccaaagtgctgggattacaggcatgagccaccgcgcccggcctgaatatgatatgattcttaccatatcatatccgggtgcatgccatcaacctgactcttccctgatgcaattaacaccttgactgcctggctgaggactgcttgtcaggcttccccctgaaaaattaccactcctccacctcttttccatagtcttgaaacaagctgctggcatcacctacacttagggtagagaggaattcagctccacctcatcgaggggggaaatatttacatacattatttggaattccctatgggagatttgtctcttcttcactattcatatgctagattttctgtgtattacagggttctttttatacagcaattaccaaaaaaaaaaaaaaaaaaaaaaacctgcctactgcctacatataaacatttttatctgagatatttccattatacctctaaatgaagaaagtaaatgctaacagttgttaactgataatttgttcaacaaatatgcattaggtttggcgagatggtttatgtctgtaaccccagcactttgggaggcttaggtgggaggactgcttgagctcaggagtctgagaccagtctgggcaacatagaaagatccctgtctctacagagaaatttgtaggctgggcgccgtggtttacgcctgtaatcccagcactttgggaggtcgaggcaggcggatcacttgaggtcaggaatttgagaccagcctggccaacatggcgaaaccccgtctctatttaaaaaaaaaaaaaaagtagaaaaattagctgggcgtggtggcgggctcctgtaatcccagctactcgagaggctgagacaggagaatcacttgaactcgggaggcagaggtttcagtgagccaagatcgtgccactgcactccagcctgggtgacaagagcgagactccttctcaaaacaaaacaaacaaacaaacaaacaaacaaaaaagaaggaaatttgtaaaaaaaaaaaaaaattagccaggcgtggtgtcatgcacctgtagtcctagctaccaagggggctgaggcagggggatcacttaagcccaggaattcaaatctacagtgagtcactatcctgctactgcactccagcctgggtgacagaacaagaccccacctctatacatgctaccctggcaggcacttgataaacacagtgctgctgatgaggctcacgggctaatagacaatcacaatgcggtatgattggtgacctctggaatatatgtatacatgcaaaggagcctacaggacttccacacagagggcttagggtcagcaaacatctcagaaggacgggcattcggctgggcgcggtggctcacccttgtaatcccagcacttcgggaggccgaggcgggtggaacactaggtcaggagttagagaccagcctggccgacacaatgaaactccgtctctaccaaaaatacaaaaaattagcctggggtggtggcgggcgcctgtaatcccagctactggggaggctgaggcaggacaatcgcttgaacccgggaggcagaggttgtggtgagctgagattgcgccactgcactccagcctgggcgacaagagccaaactccatctcataaaaaaaagggacaggcatggggcatgccaggcaggcaattttagactgtacttgtgtagatctttacttgacgttgcagaaatgtcaactgtttatatatgtatttttaatggtagtgtatgtgatacagaagtgctgggtagagaagagcatggtccctttaaataattcggaagtggggaagggatgtgccgggtaaaggagggcgtggtccttagctagggctccgcccccacggacctaggtgaggacaggcatctctgcccaaatgttgcatttcccgcccaaatgttgcatttcccaaaaccaccctggcctgccatggccgcatcctgggcctataaaaacccaagatgctagcaaggcagtgacagaggccgccagacgttgagaggacaagtcagcagaagacgccacagccgctggcggtggagaggaggtcgagaggctcacgcgcgcagaagaaaataccggcacacggacaggccattgaccggcaggaccaggcggagtttggcccgggcagtgggaggagagccaggggaagatcatcttccttctggctccccatcgtgggagagttaacacttgacactcgttctccaagcccaggtgtgctgcgattcttcaggtacaccaaggcaagaacccgggatacagaaatccctctctccttgcgataaggaagggggcctattgagctggttaacatgagccgcctatagacaccttgtaacagacgccccctgggtcttcaggagccgtaaacatccaccgcagacaccgccgtggggtcggagccgcacaaagctcccctggaggtttgagcagcgggaagcgagccagagccacaccccaactgcacaccctgcgggggcctttcagatgggaagagagtaagtctcctcctggtactgtaactttgaggtttggtgattttttttttttttaaacagtctttgaagactgatataaatggtttggccagtgccactaccaggtgctgtctggttttagatgaataactttaattccctgagcttaacttttcatattttcttagtgttttgtgaatattcaagctaagtcagcagtagcgacttagtgcatgactttttgccacccctaatgcatgtccctttgcaatgtgatggttatcttctcccatcaataggtgaagtccattttctcctcctttgagtctgggcttgactgactaacacggcttttgctaatgggaaattaacaaacatgataaagaggcttaagaagaactgacgttggggttttgcttcctgctgctcctgggaccctgctgtcatgtgaacacatcggattatcttgtcggagaatgagaccaggggaagagaaccaacctaccctggccgatagaaagccactcccagggccggacacggtggctcacgcctgtaatcccagcactttgagaggccaaggttggtggatcacttgaggccaggagttcgagaccagcctggccaacatgatgaaagcccgtgtctactaaaaacacaaaaattagctgggcgtggcgggcgcctgtgatctcagctactccggaggctgaggcaggagaagtgcatgaacccgggaggtggagtttgcagtcagccaagattatgtgctccccagcctgggcaacagaatgagactgcgtctcaaaaaaaaaaaaaaaaaagcaaagaaaaaaaagaaagccactcccagagggtaagtggggccatctggatatactagccctcaccagtccactgactgatcaccagaatttgcaaatgaagacaaatgcatgagtgagcctcaccaaaaatagcaagcaaagtgtcctgcctcgctccagtgatgatctatagaatcatgagttgacaattgttgtgttaggacactaaggtttggaatggttcatgacacagcagtagattaccaataccagtcaaatggtgatgagaacagagtaactgttgcaagtttcagaagtaatgctgtgtttttgtttttctttgagaggtttgagtgctgtgctcacctaagtttaaaatgaaaatggggctgggcatggtggctcacgcctttaatcccagcactttgggaggccaaggcacgcggatcactagaagctaggagttcaagacctgcctggccaacatagtgaaacctcgttctctactaaaaatacaaaagttggcggggagtggtgactcatgcctgtaatcccagcacttggggaggccgaggcgggcagatcacgaggttaggagttggagaccagcctggccaacacagtgaaaccccgtctccactaaaaatacaaaaattagctgagcttggtggtatgcgcctgcaaccccagctactcggaaggctgaggcaggaggatcgcttgaactcgggaggcggaggttgcagtgagccgagattgtgccacagcgctccagcctgggcaaaagagctagactccgtctcaagaaaaaaaaaaaaaaaagttagccaggcatggtggcacacacccataatcccagctactccagaggctgaggcacgggaatcacttgaatctgggggcggagcttgcaatgagccaagagcgtgccactgcactacagcctgggcaacagagtgagattctgtctaaaaactaactaactaaataaataaataaatgagaatggtatttgcatatagccactagctggtccccaaaagcctcttccctggccaactggtctcctgcagaaccctgactagtgacaattcctccatggaacctctttttctattattaaacaattatataagtgcatattctgggtaggaagtgctttcacactctaaaaaccctcttctgtgatgaaatctggttgttttcctttaaagatgaaatatatttctactgaccccaatgtggagatcaagtgattctcaccttgaaagtatcatggttggtcactgtgattagaacaagaaaatgctgtgatttttctctgcaacagtagggccgacttgtcctgaaagccgaaagtctttgcagcgaaaggaaagggtgcagtggatgactcctagccctgagaataacatggatctggaaggtccatatatcattcagtgaatcagtaaacaccactgggttccctttggggatatagcaccaacaataaagggccctgttctgaattctctggaattaaactgagtgttcaggatgcaaaactcattaaaaattggcagttgcggcatggcatggcataataataaatccaggagcagaagggatgcgaacccatatatcaaatgaggtcccaaacgctccccagtgtgtgactcctgctagttctagtgtggctgccattgcatgggacgtgttggagtccttcatgggcgctccatgaaagacatctttctgtgctacaggcagccctggtgggatgtgctcccaccacaatgaaaaagtcagccctagaaagatcagtggcagaggaaagaagtgggtattttgctttgtttttttcccaaaacagaaagacgtaattgctattcccactctggtaagcttggcatataaataccagggactctggtcttcctggcaacccctctctccattggtactcagtcactccaagcatgttccatggcatgttaataagtgctgcttcaacaagccttaaagaacatagttccactcttcatgctaattgcctatgcacattctctcccacctttcaccatcacaaattcagaaacagccagcaactcctcacaagtgaatggtattaagctgttaggtcgtaagtaagaccaattgaatcaacaggttcataggactttaaacgtcacactgcttcagatgtctagatcatcagttactcccatcctgctgtgcctccatctccaggtttcttcacatgagcttactagcttaaatgagatttatttgaactaaaaaggtgaaggatgacagggcatggtggctcacgcctgtaatcccagcactttgggggccgaagtgggcggatcacctgaggtcaggagttcgggacctgcctgaccaaagtggagaaatcccgtctaccaaaaatacaaaaaaatgagccgggcgtggtggcgcatgcctataattccagctactcgggaggctgaggcaggagtatcgcttgaacccaggaggcagaggttgtggtgagccaagatcacaccactgcactgcagcctgggcaacaagagtgaaactctgtctcagaaaaaataaaaaaaagcagaaggatctccccacgctctcacaatggttagttactggttaaaattcattatgtgcctttagaaattaaagtgataagttggagacctaactagctctgaaagctaataagctacggcagagagggtgggaatctgagaggcagagagtaagagtaagtaaaggagagtaagagtaagaaaacacgtgtggggtccactctaccctgtgacggtgtcaataaactgtatgcaaaaggctagtactttttttctgaacttgtctaaatctacttttatttaaatagaaatccaaaacacttcctaggttatgattttcaagatcagtctaaaatttaaaagtaagcccctaaaaataatgtttgaattattagctatagaaaatatttcatggctgggcatatgtgtctcacgcctgtagtcccagcactttgggcggccaaagcgggcagatcacctgaggtgaggaagtcaagaccagcctggccaacatggtgaaaccctatcttactgaaaatacaaaaattatccgggcgtggtggcgtgcacctgtagtcccagctactcgggaggctgaggcaggagaatggcgtgaacccgggaggtggaggttgcagtgagccaagatggtgccactgcaatccagcctgggagacagagtaagactccatctccagaaaaaaaaagaaaatatttcatgcctatcaatcagaaaaaatacaataattattcaagcacacatgaaatcttaaaatcatgttcacgtgctagcatacgaggaaaaccttaatccattctgaagatcaatattataaagattgtggtctgctgataatacagtaaatttgaaaccattagtagatgattgatttaaaatgttatgcccgggacatttacaacatgcaattaaaaacttctgagcaagcttttgccagtgcctgctgccttttgtgattgtgcatcctagctgaggcatgcagaaccaaatgaaagcaaggattcattaactctttgaacttgttaaatgctaacagttaaccattagaaatggttcaacgatgtgagccacactacttcaactttttctttgttgtagttttagaatggtcaatttttagctacttgacagattaaaagcaaaataatcacgccatatttagtcctggagttcaagtctacatgtttatgtgaaaaatctttgtaataaacttttaacatgagaaggcaaccttaagctctattttagccaaatgaaacaaaacctgaaattgtattagaacatttccctgtcttcaaactggtgtaacagaatcctgatatgcagcttgatggatttcaccagttaaggcacattcttctccctccgtccctgcaatactgtgtatactgaacaatgtgcatttgtctgaggagttattttgtttgccaccacttaacgaatctcaaaattttgagtaactgtacctcagtctaatcggactttttatgagctttataactacattgaaacccttaattcccatttctgggtgtttgtgagcctgattgctgtcatttgcgactctaggtactcaccagctaaataaacatagtttttgtgtggccagcacgtactgctcctcaattcctttctccagcttccgcggcgtcctggcatccttaaaatatctacaaaatatggccttcattcataaatgaaatcagtttctatgtgagtgtgtggatgtttattgatcgcacatgtataagtggaaatacagcatatgtctgggtattcttttttcttttgagacagtcttgccctgttgcccaggctggagttcagtggtgcaatcttggctcactgcagcctccaccttccaggttctagtgattctcctgcctcagcctcctgagtggctgggattacaggcgtgtgtcaccatgtacagctaatttttgtattttcggtagagacaggttttcaccatgttggccaggccgggctcaaactcctgacctcaagtgatccgcccgcctttgcctcccaaagtgctgggattacaggcttgagccaccgtgcctggcctgtgtgggtatttgtatagtcttctttttaacatatttttttttcattaattacatatcaacattaatttcgtatcttgaaacaagttgattttgtataattaaaggtgccgagcatctataaaataaataaataaataaaaattaaaatcttctgagcaaaatgaggttcattttgaagaatgtagaataaatgacagcagcaccccatgttgatattggtagaacactgccaaagcagtatctagagggaagtaaagaactttaaatatatgaatgaagaaataagaaagattggcaacaaattaggtcaggatttgacccagaattcaccctttagctgttctgagatatagttcatacaagaaaagtaggataaatcctttacttttttatttaccagactttagaataattcattgataaaatactaacaattctctgatccctaggtagagtattatgcatgagttttcacttcatttatacttttatttctgaaattttttttaccaaacatattctaactttataatcagaaaaatacttttgaaaaaggagtcagggaataaagatatatttgcaacttagtaaagttcctctgatctcttgaagtattaaaacttttgaatacatgtgaaaaaaatttctaagacaactcatgaaatctgaaactgggatggtttctggaggttttcaaagaaagcgtctcatactaaagttaagacctctgttttatgtcattttaaaagagagcgcagctctcgtgctggggcattgcttcaacccgcacttggaggaatgagcatcacttcctgaatcaccagccttttctacagagcctcgattttctctagggtcttcccatccacacaccggcaatgctgacaatactcagagcttatgaaacctgacagatcacagtttgaggtgaaaaaactttaggaatgaaaactatcaagaggaattggaaatgaaaggtgaatgccattatatttattcaatttatagctaaattataatggaaaaaatctcgaaatagaaacattttttaaatctgaagactgtaattataacaatgagcattgtcataatgttgacctgtgtcacattacaaatattctttatcaataagacattaaatgtaataagttaatgaagaagttatgacttttgccaaaatgatagggcagtttttttattttgaattttaaaaaaattgtgcttcagtttgcaggatgtttgtgtgtgtgtgtgtgtgtgtgtgtgtgtgtgtggtgtaggggggtgttggtatgagatagaaattgactaacacagtccagcttctgttgattctttttctttcaaaaaaaagtcttcccataatatcttacactgctcgtctcagtagtttagtcaatgtttaacacatgccaaaatatttctgactctcagaataatttgattttagagaagtagatgggaccagccaggttcttaattttttccccacaactttttattttgagaatgttcaaacccactgaaaagctgcagatagtccagtgaataccctttgtgatgggctaaattgtgtccctacaaaattcgtatgttgcagtcctaaactgcgtatctcagaatgcggctgtgtttggagagaggatcttaaaagacgtgatgaagttaaggccattagggtgggccttaatccaatctgactgctgtctttgtaagaagaggaaattgggacacaccctgggacacccctgtgaagcagctgcaagagccaaggagaggggcctcagaggagaggaaggaccccgccgacagcctcagcttgggcttccagccttcaggactccgagaaaatggatctatgctggttaagccagccagtaagtggtattttattatgcgagcctgagcgaactaatataccttatacctttcttatacgttcactaattgttaacattgtgtcacatttttgtgatccctctctctgtctccacaaacacacatgcataggcatgcacacacactaacatgtgaagtatacacatacaacctatcacacacatcatacatatgcatacatatgtgtgtacatatgtatacgcatgtctaccacacttttggcaggggtgaaggaacaggtgaaccattacatgcctgttagttgcaggcaacatgacttttttttcctaaatacttttgtggaaacctcccaagagccagtacatttgcttataaaaccacactataagtttcatattcaggaactaaaaacagtactacattatacggtaatatgcggtcatatttaaatgttcccatttgtcctaatatagttaggtttgtttgtttgtttttctccaactcgaagtttaatcaaggcacacacactgcatttagctgccaagtgtgtttgcttttttttttttttagatggagtctcgctctgtcacccaggctggagtgcagtggtgcaatctcagctcaccgcagccttggcctcctgagatcaagtgatcttcccacctcagtctcctgagtagctatgagtataggcacgtgtcactgtgcccagctaattttttttttttttttgtagagacagggtctcactatgctgcccaggctggtcttgaattcctggcctcaagccatccttccacctcggcctccccaaaatgctgagattacaggcatgaaccaccttgcccagcctttattaagattttctattggtgcaaaagtaattgcagtttttgcaatttttttttttttttttttgagacggagtctcgctctgtccccaggctggagtgcagtggtgcgatctcagctcaccgcaaccttcctctccctggttcaagccattctgctgcctcagtctcccgagtagccgggattacaggcatgcaccaccacactcagctaattttttattttctgtagagatggggtttcaccacattggccaatatggtctcaatctcctgacctcgtgatctgcccacctgggcctcccaaagtgctgacattacaggcgtgagccacctcacccagccgcaattatttttaatgacaaaaaccgcaattccttttgcatcaacctaataatacattcttgtcattattcggatggtcaaatattcccagatttacaagcaggtgtgcttttaagctggtttgcctagcctgtgacatgtccctatgggttttcagcacatccttgcttaagccgataaacaatgaatagcaagtttttcattttgttctatctcttattttgaatctaaaagagcagcccctttttgtttcaaaatcttattgacatattgaagagattggtccggtttctataatgttctaccttctagatttgtccaagtgtttcctcatgatgtcatttagctttgcttatcacgtgtattttgtataatgtgaaagtgagagctaaaggtttcattagctgccaggtaagtagttttggccagatgttttataagttgtgctatactttatgattgcatcacattagcatgtaatatttagttgtcctactcttaaatttaatacttaccctaccattattgaacaaaatacacaaagcaacattaaaaaaagaaaaacaaaaatttaatacttaccctactattaaattgagctgtaatttcatcaccagtgtgtataataaaatgtcaccacattcacaaaactcatgtttttaattcaaatgagatattattgcctaatgactgtaagtgagactttagtgatttcagcaaatatatataatcgttttttgagaacacatccttaaatttcagaaaattgcagtaaaaatgaagtaccaacccattcttggtattacattctaaaactttggcatttttcctttgatcaccaattccacatctggagatactctccggacacttgtcaagttcatgattttactacaggagtctattcgagcaatatttgtaggcacaaaaatgcagaaacagtttcttcaagaaggggcttaataaacctaatgtggaacattggttatgtaactatcatgcagtcactaaagacgaggatctctgtataaggagacagactactatgcagaaattatttagtgaagaaggcaggttgcagaaccctgtatctagtgcaattccatgtatgtttgaaaagagcacagctgaacggaggaatgaatgaagaacatgtggaaacatacacaaaaattagaaaatgttagagaataactttgataaagttagataagattttcgttgtaaaaagcacctattttgaataaagattcattcaggttaaggcctcctttggaccccttacattcacgtggattacttttcaagatatattgcatgatgtctgtatgtctgacattcttcaatatttcaagaaaaagggttttgcaaaaaggccaatctatctaaccacaaatatgacttctaaattaaagacttaccaaaggctgggcgaggtggctcacgtctgtaatgccagcactttgagaggccaaggcaggtggatcacttggggtcaggaatttgagaccagtctggccaacatggtgaaaccccgtctctacggaaaaatacaaaaattagccgaatgtggtagcgggtgcctgtaatcccagctacttgggaggctgaggcaggaggatcacttgaacccaggagacgaaggttgcagtaagccaagattgtgccattgcactccagcctgagcaacagagcaaaactcagtcaaaacaaacaaacaacaaaaaaaaagaaaaaaaagaaaagaaagacaatcaccaaagatacctaattttggcctggcatggtggctcatgcctgtaatcccagcactttgggaggccaaggtgggcggatcacctgaagtcagaagttcaagactagcctggccaacatggtgaaaacccatctctaccaaaaatacaaagattagctggacgtggtgtcacgcgcctgtagtcccagctacttgggaggctgaggcaggagaattgcttgaacccaggaggtggaggttgcagtgagccaagattgcaccactgcactccaaccagggcaatagagtgagactgagtctcattaaaaaaaaataaaaaagatacccaatcttgttacagaaataccaaagtgcagaaatcagaaaactgcatagatcacaaaacttggataccacagaaacagtaatcacaacaataacaacaaaacaaatggaaggaagccaaaccttacaacaaaatgaaccgcacttccttagaggaatgatttgtgttaaataaccaccatcattcacaaaaataacaatcataaattagtagcacatcactgtctgaaggttctcatttttcaaaaagcacctggagcgagcatctctcgcatatactttttgcaggttaattctattttggagacttcttagcttaagatgagccctaagtggacagctgtttagtttcagaacagtctcccccatgtgtatgtgctggtgagtgacacgctccacctgcctgcaggagctgctgcctccttacatctcccagccatgcatcgcgcctttccctttgggaagcacttaatgagccataggctcctgaaagtggaaagagaacacgaaagggcctctggtcctgctgacaaagtcatttccgctgcgcctggtgctttttggttttcacattggattcacttcacttttaattaaagaaacgagatttgtgtgtttctttttgattttggtcatcttccccaaattaaggctctgtctctcaaacaggaagttaacatttattcaagtcaggaacataggggctagcttttccttttccacagatgtacctgagatatttggccaaacttgtccctacattcaaagatctctggtgggattacatagcctaaacgaactcaactactaagttatctttggctatcttcagatatgacccactgatatggtttggctctgtgtccccacccaaacctcagcttgaattttactccccataatccccacatggtgagggtgggacctggtgggaggtatttgaatcatgggcagtttcccccatgctgttctcatgatagtgagtgagttctcatgagatctgatggttttataagcgtctgtcatttcctctgcttgcattcattctctctcctgccgccctgtaaagaggtgccttctgccatgattgtaagtttcctgaggcttccccagccatgtggaactgtgagtcaattaaaactctttttttatagttacccagtctcaggtatttcttcattgcagcatgagaatggacaaatacacccacatagctatcttctttattcatggatataattcttacagttagcaatagacaaaattggacccttttttagtgttacactagctcaattgcatagacatccagtgacctacagctttcctaagactctaatgtttaaagcactgtcatgccccgggccctctctcggcactgccccaaggaagtttgactttgcctctctgtggctcagatttccgtagacagttggaaaggcacccaacaaacaccccatccatccatattcatgcaacttctttatggtttaatttaatagagtttgcctccccactgaatccaattttaacacaaaaacaaataaatttctacttcaacgaaaaggaggagaagatgcctatactttgcttatctctgtgggctattccattgtatcttaacctaaggaaagtggtcttttggggaatacatagaaattataatggagcaattaggcagctcaatgaaacaaaaagacatttaattcaatcaattgaataaggagaacaatcacattcaatatggtactagtgtatcatgtgtggaatatttgtgcatttccaaatctcttgatacaccacaaaacacactcaagtttcatggccttagttaactgatctgcaaaaaaataaacatccctcagtcattcctacatgacctcataataacccatatttctacttttctttcctgctgccttttcttgtagctcactacttaaacttctaggccgggtgcggtggctcacgcctgtaatcctagcactttgggaggatgaggcggaaagattgcctgagctcagaagttcaagactagcctgggcaacacagtgaaaccctatctctactaaaatacagaaaaaaattagccaggtgtggcggcatgtgcctgtagtcccagctacttggaaggctgaggcaggagaattgctgaacccgggaagtggaggttgcagtgagccgagattgcgccactacactccagcctaggcgaaagcgagactctctcaaaaacaaaaacaaaaacaaaaacaaaaaaaacttctaacaaaatgccttccagcctcagaacacttccaaagtgctgtcccaactagctcctgattttccttttatctagcaccttcacctgcacaacttgaaccctttacctacattattcttcttacaaaactcattatgggctgggcgcagtggctcacgcctgtgatcccagcactttgggaggccaaggtgggcagatacccaaggtcgggagtttgagaccagcctgaccaacgtcgagaaaccccgtctctagtaaaaatacaaaattagctgggcgtggtgatgcatgcctgtaatcctagctactcaggaggctgaggcaagagaattgcctgaacccaggaggcagaggttgcagtgagccaagatcgtaccattgcactccagcctgggcaacaagagcaaaactctgtctcaaaaacaaaacaaaacaaaacaaaacaaaaactcatctcttcagaaaggccataggtttccttgcctctggattccttgtgtcccccatagtacattcattgtcccttcgatctccatggctcctcttctaggctttgccacaaatggtaagccttctttctgtgggtcttttctgcatgatcacactcacctcgtgtgtgagtaaaacacgaaaaattaaatttcaaacccagacctgtctgcttcgctctagtccttgagtcacattctcatctctctctttttttatttttatttttgttgagatggagtctctgtcgcccaggctggagtgcaatggtgcgatcatggctcactgcaacggccgactccctggttcaagcgattctcctgcctcagcctcccgagtagctgggattacaggcacgcaccaccaagcccagctaatttttgtatttttattagagatgaggtttcacagtattggccaggatggccttgatctcctgacctcgtgatccacccacctcggcctcccaaagtgctgggattacaggtgtgagccaccgcgcccggcctcattctcatctctttctaatggtgaggcctgacatcatctggaactgaagagattctacaatgagctccaggtttcattctctcttccatgcgggcacagtctacctctcccttccatgcgggcacagtctacctctcccttccatgtgggcacagtctacctctccctttcatgagggcacagtctacctcagtcaaccagtctcaaatcttcagggtcgtgtaaacttccaggcccttaaaacctccgaacccaagttgggatcactgcactggggctgtctttgttcctcctgctttccctgcactgccattttgttcattcagcttcataaaacccgctgaaagaaccagtgtaatcatctttaaattagtcaaccaaagttgacactttcatttttaaacttttaaatctattatcctaactttagtaccctttatctgatccctaactttttaactttgagatttgacttcctaatttttaaaagtttacaataaaaaataattttgaatacatagttttacttgtacttaaaactgatgtgaaaaaagtaattaatttttaatgcttgtattttatcttaaagactggctgggcgcggtggctcatgcctataatcccagaactttgggaggccgaggtgggtcaatcacttgaggtcaggagttcgaggccagcctggtcaacatggtgaaaccccatctgaactaaaaatactaaaattagctgggcatggtgtggtgtgcgcctgtaattccagctacttgggaggctgaggcacgagaatcccttgaacctgggaggcagacgttgcagtgtgccaagatcacaccactgcacttcagcctgggtgacagagcaagactctgtctcaaaaaaaaaaaaagacgaatacaattttagatttaaaaaagaaaaagtgttaaaataattacttttaatttatgtagtgagaagaattaaaaagtaaataatatttgttttagctacagtacatagatcatatttgtcttatgaactttaatttttaaataacatgcacatgtacaatataaacttcaggagagtgggaactttatctccaatgcctgcaaaagtacctgatacttagtaggtgcttacaaatatttgctgacttaatgactatacaattcattggctacaaaatggtaaaaagtgaaaagtaacttttccttttatccctatagatacctggtttctacccccagaggcagtcgcaactttatttgttttgtctttctctagagatattataagcccacctaagcatgtgtatatctatataaagacagttagacatatatgcgtgtatgtacacaccatagatatccttttttctaccttcaaatgggaacatcttgtacatatttcctgtattctaccttttgcctcaactgtattttgggtgtaattttatatcaattttgggaaaactctctcttctttataaaagtgacatagcattccttgtataactgtgtcctcaatttatttgaccaatcttttattggtggtatttcaatttctagaattttgtgatttttttttttttctttagacagaagtttgttcttgctgcccaggctggagtgcagtggcacgatctcggctcaccgcaacctccgcctcccaggttcaagtgattctcctgaatcagccttccgagtagctgggattacaggcatgcgccaccatgcccggctaattttgtgtttttagtagagatggggtttctccatgttggtcaggctggtcttgaactcctgacctcaggtgatccacccgcctcggcctcccaaagtgctgggattacaggcgtgagccactgtgcccggccgaattttgtgatttttaaacaatgctgtactacgtgttcttgtatggatagcattgctcatacatatgagtgtttggaaaataatttttccttgtgcggctataacaaaacacttgagaccagataatttattaagaacagaaatttattttctcacaattttggaagctgggaagtccaaggtcaaggtgccagttgtctggtgagggctgccttctgcttccgagatggcaccttgatgctgtaccctctggaggggtagacgtgctgtgtcctcacatggcagaaggcagaaggacaaggaagccaaaacctgggtaaagcctatatatatatatatatatatatatatatattatatatatatggctttaaaggtgtatacacacacacacaaaggccttatatatacaatttacatacacatatatatacacatgccttaattccattcacaagggaaggagctttcctggccctcccttaacacctgaattttggaggtgacacattaaaaccatagcaatatcctagaagtaaaactgccatatcaaagagtaaatgcatttaaaattttaatgaatattggcaaattttcttccatggattatgtcagtttatacttccatcagcaatgtataaaagcaccattttccttcacactggccaacacattgctatcacattttgagatcattataatttatagttgaaaagcgatatcacactattactttaatgttcttttctttaatgtgaaatttattaattatcctcacattctaaaggcattaatgattacatttttgtaattgccagggactgtttacattttaccaactgatttttgccattattttcttccttcattttcctttcttttttccttccttccttccttccttccctcctttcttcctttcttttctttctttcctttctttcttccttttttattttttcttagacaggatctcacttgttgcccaggccgcagtgcagtggtgcaatctcggctcactgcagcctccatctcctgggctcaagtgatcctcccacctcagcctcctgaagagctgggaccacaggcacaaaccaccacacccagctaatttattttttaaaatgtatgggtctggggtctccctatgttgcccaggctggtctgaaactcctgggctcaagccgtcctcctgtcttggcctcccaaagttctgggattacgggcatgagccacagtaccctgcttcactgtttcctgctctattggtcataatttcactcattatttcctcactttttccctcacgtttctccacttcttcacctcgacggctttgcatgtgtaattctctgttttggaattgcctctctccagcctctccctccatcttcaattggaatcttaattccatatgcacagaatagctccaagtggtagtggaggggagaaacttgtaacaaggggtcctgggtggaagaactggcacacggggtcagagatttcagggaaacttacttttcactgcaacaccttttgtacctttgcatcttgtaggaagcttacatgtaacctctatacaagcaaacacaggcaaaaacacacacattgtcaattcacatccttatttgtcaaggtatagcttgaatgtaatttttagctaaaaagttgtttatctttactcttaacattcatggaaagtaactacatacgtataacatacctataagttgtataacatatacatttttatagaaaaataaacatatttcttttataacttgctaacttcttgattgagaatctctgattattctttgagtcctgccaacatgtctagcatatttcttaatcaatgtaggcattcaaaaactgtttaattcatttagcaaatatttattgagcctctgttctgggaaagtatcttagtaatcaccggcagtagaatttacagtcacagtccttgcccttagacatcccagttaatgatgaagataaacacagagataaataattctaataggtacaatttagagacatgcaaagaaggggaatgataaacatcaagtgattatttatctccgcatttcccaaggactgagtcaagtagcatcttctcatgataattttggtgatcaccaggaaagctttttattagataacgatttattgcagaaaatacataaaaaactaatacttttgcagagattaattttgtgtgaggttaaagtagacatttaatttaaagaagttagtcactgaaagtaaaatattcagtaaataagagtttcgacagaacatagccactgcaacagtagtggagcagaggtgagcacaaccgaggctgcggcaggagaatggcgtgaacccgggaggcggagcttgcagtgagccgagatcgcgcccctgcactccagcctgggcaacagagccagactccatctcaaaacaaaaacaaaaacaaaaagaaaaccaacaactgaagcttggcacatgttaatctgtcccaaccaggcacacattgccttggtaatgataattataattaaatattagtatagcttccctgtgttgagggtttactctgtgtcaagcattatgttatggactttatatctcatttaacagtcacaatctcccaaggacgcttatattttcttgagacaacagaggctgagagaacgtaatgaaatggcacagataactaaaagtttattctttaattgccatgcaactacacccagtaggagccaaatattggaggaaaggatcgctaaagattttgaccttgtaaattttgactttgagtgagaaaagcaagtgccagatgaataaataaccctttttgagaggtgctatgaataagtattatgagcatgcagggcaggagaggattggggatggaagccaggtcagggaagggttccttgaggagatgatgctgaagtgggctcggacgaatgcatcagcattaactaggcgttaacaaaggaagctctaagtggaagtgcctgggagaacacacacagaggcccctgtggtggagccagagagcttcacggtgccacggaccgtggtggagccagagagcttcacggtgccacggaccgcggtggagccagagagcttcacggtcccacagactgtggtcccagcgggcctctgtttctgcagccttgcccaaagtaggttgtcaacattttgaattactgacaaattcaagggtaagaaacgttatctccggtagatttagtttgcattttccttattaagaacatcttttataagcttaagaacaatttacattcttctgtaaactacttcttacattctttgcctattttcctgtttgtttcctcattcatttgaaaaagcatctcatagattaagttagtttcttgtctatgatataagacatatatttgctttctaatttaacatttatttcatctttattattttaaatttttagttatgtgaaaaattttaattattattattattataattttttttttgagacagagttttgctcttgttgcccaggctggagtgaatggaacgatctcagctcacctcaacctccgcctcccaggttcaagcgattctcctgcctcagcctcccgagtagctgggactacaggcatgcaccaccacgcccagctaattttgtatttttagtagagacagggtttctccatgttggtcaggctggtgtctaactcctgacctcaggtgatctgcctgtctcggcttcccaaagtgctgggattacaggcgtgagccactgcgcccggccttattttaaaagtcaaatcaatctgtgatttttgttgtttttgagtttaatatactgaggaggctaatatattccaattttataaaagtattcaactgtgttttcttttagcacttttatggtatcagttttgaagtgtaagtatgtgaacattgggatttattttggtttaaagtgtgaggtagagatacaattaatttttttcttcaaatagctcctcttgttgcaacactatttgtagaataatccatctttctcaattgatttgaaatatcacctttatcaatactagatttccatatgtatttgagtcttttactggacttcattctgtttcattgatgagtctatatcttcatattctagtaatactgtgttttcaatgttattattattattttattcatttatttatttacttatttgtttatttattttgagacggagtctcgctctatctcccaggctggagtgcagtggcccagtctctgctcactgcaacctctgcctcccaggtttaagtgattctcctgcctcagcctcccaagtagctgggattacaggtaactgccaccacgcccagctaatttttgtatttttagtagagatggggtttcaccatattagccaggcttgtctcgaactcctgaccctgtgattcatctgccttgacctcccaaagtgctgggattacaagcgtgagccactgcacccagcctaattattattgttttattatcttgtagggctaattacttgcataaagtatttctcagatttatacttttgcctgttattcttattcacttatttttccataccttcttcagaatcagatttctagtttaaaaaattcctgttaaaattgttattgagcattagatggaagcagcatgggtaggagccgtggggctgtttccgggagggtattccaggcctaatggccagcatgtgtcagggcctcgactggcagtgcgtgttgtgtgtttgaagaacaggggagttggagttactgcagcagagagttcagtctgaggaggggagatgggagataatgccctagtgggggtggaggtgggacatgagggtccagatcacccttggggcccttgtaggccattataagactctgacttttagtctgaatgagatgaaaagtccctggcagatttacagcatagaaatatcatacaaaaatttggggcagggtgcagtggctcacacccataatcccagcactttgggaggctgaggcaggcagatcatttgagcccaggagttccagaccagctttgacaacatggcgaaaccccttctctgcaaaaaaatgcaaaaattagctgagcgtggtggtcctcgcctgtaatcccagctactcaggaggctgaggtgggagtcactttaacccaggaggcggaggttgtagagagttgagatcgcgccactgcactccagcttgggcaagacagcgagacccttatcaagaaataaaaataaaaaataaattttattttattttatttttctatctgttaaatatccaaccaattcatttctgggcatctatctgaaatattcaacatacgccaccctactcccgcccccaccccaacaagagaaagaaaaagcattgtagaaagattattacagcacagcttgttacagtgaaaaactgacagctaaaatgcatattaatagagaaatgattttaaaaatctgtgctgtgcccgtactatacaatactaacatgcagttaaatgcacagaataagtttgaaagcgcagaaaaataaatagcgctcttatgagaccgggcgcggtggctcacgcctgtcatcccagcactttgggaggctgaggcgggcggatgacctgaggtcaggggttcgagaccagcctggccaacatggagaaaccccatctctactaaaaatacaaaattagccgggcatggtggtgcatgcctgtaatcccagctactccggaggctgaggtaggagaatcgcttgagcgaggcagaggttgcggtaagccgagatcacgccactgcactccagtctgggcaacaagagcgaaaataaaaaaacaaacacaaacaaacaaacaaaaagaaatatagctatcacgttgacaacaaagtggtacataagggaggctgtggcttggctttggagctgctcaccggaatgtccgtggtgcagtgacggcgtccacgattcgggtcagagctctccaggacaggtggggtagagctggaacaagacgggcaggtgctggcgctcactgaggctactctggcaacacatgaggacgcattttatttttctccccacttttaatacgtttgaaaattccataaaagtaaaacaaaacaaaaataataaaaattcattaaagactgaaccataaaagtcagaaaatttttccacaacagccttggccattgctgtattgtgcattgaaggcggctcttagtgaagagacacatttgtaataaatgttttgatgtactagacaatcagggctctgaggattgaatgagatgatccgtgtaaactacttagcctggaattctcaggacatataaatctaaaagtttttatggaagttgattttattactcaaaatatattacagtaattttgtaaatctattttatctctctatctctatataatttgtcttctgtttaatagctacagaatgtttcttaatttatttagccattcccctattgaccttttctccttttataacaattttgtaataaatgtctcataatatgtatttgtgcacctgcccaattctttccatgaggtaagtcccagaactggatatggtaaacaccaatgcattttcatatatcttttttccaatttgccctgcaaagagattgtactcatatacacaccctccagttaatggtggcagtgtctgattcttcacacccttgtcaacaaggaactagacacatgcattattagtgaaggcaagtgcatatggactgtgtatttttgtctcttccaaggtgaaatacatttttatgtcctcaacttgttttgtattggattctttgtcttttctttattgatgtgttagaactctttatagtaagactattaatattttgtcacatatgttacagaacattttctctagtttgccatttgtctttaatttcatgtagttttaaatatttcagccttcattttaggctatctgggatttattgcatgcttagaaaagccttttatatttcagaattaaaaagctttttttggtaaactctttcacactgttggattttgtttgaacttctgtttttaagccatctggcatttatttttattttattttactttattttatttttttatgattttttaatttttttattgtactttaagttctagggtacatgtgcacaacgtgcaggtttgttacgtatgtatacatgtgccatgttggtgtgctgcacccattaactcgacatttacattaggtatatctcctaatgctatccctcccccctcccgccaccccatgacaggccccaatgtgtgatgttccccaccctgtgtccaagtgttctcattgttcaattccccacctatgagtgagaacatgtggtgtttggttttttatccttgcgatagtttgctgagaatgatggtttccagcttcatccatgtccctacaaaggacatgaactcacccttttttatggctgcatagtattccatagtgtatatgtgccacattttcttaatccagtctatcattgatggacatttgggttggttccaagtctttgctgttgtgaatagtgccacaataaacatatgtgtgcatgtgtctttatagcagcaagatttacaatcctttgggtatatacccagtaatgggatggctgggtcaaatggtatttccagttctagatccttaaggaatcgccacagtcttccacagtggttgaactagtttacagtcccacccacagttttactttattttatttagagacagggtcttgctctgttgccaagcctggagtgcagtagcacaatcatagctcacttcagccttgaccccctgggctcaagcaatcctcctgcctcagcctcccaagtacctgaggctacaggcacatgccactattcctggctaatttttaaatttttttgtagagacagggtcttgtccaggctggtctcaaactcctggtctcaagcaatccttctgcctcagcctcccaaagtgctggaattataggcatgagacactgggccaagcctggaatttgttactgcagttaggatatatgttttattcctaaatgtagcctactgtcccaacctgttaattgaagagtttattatctatatctggttgggattctccatatcattatttttcttttaggcacttttattggctattttcatacttactatttcgtgtactttagaaacagtttttgcattccaagacaattctggagagactatttttggactcacattggaaattaggtgagaattggcatttgtctttatacaagtgttccacttaggaaaattgtgcgtcctcccacttttaaagtcttttaagtaagtcttattttttatatatatgtatatattatacatatatataaaatatatatattatacatattttacatatgtatttttacacacacatatatatatatatacacaaatatatatatatatatatacacaaatatatatatatatatatatatatatatatatatatatatatatatatatatatttgagacagagtctcactgcgtcccccagggctggagtgcagtggcgcgatcttggctcactgcagtctctgcctcccaggttcaagcagattctcctgcctcggtctcccaagtagctgggattacaggtgcccaccaccacgcctggctaatttttgtatttttagtaaagacagggtttcactatgttggccagggtggtcttgaactcctgacctcgtgatccacccgttttggactcccaaagtgctaggattacaggcatgagccaccatgcctggctgaagtaagtcttatgattaacttccccataaatctttcacatttcttattaattcctaggtattttataatattgaaggttttaaaaaatttcagagatcatttttgccattctattttttaacttagttaccactaagacaacatctacaaaatgctgtagatctctgcgcacacacaaacacacacacatcatgcaacaaataagaaaatgccaatacatgaattatacgtgagatgttggatatattattttattggcacatgtcttagaactcattacacttctaggtacatatccatgagacaccaatgcatgcgaccatcaaaaacatgaacaataatatttacagaagtttcattaacaataactaaaatttagaagcaatctaaatgtccaccaataggagaacagatgagcaaatgggatacgatacagacagaagcaacaataataaaatccctactgatgtggatacacatgaaaaatctcatgaccctcatcttgagcaaaagaaacttcacatcaagaaatgcatactcttttattccatttatataaagttcaagaacaggcaaaactaatcttgtaataaaaatcagggccaggcatggtatctcacacctgtcatcccagcaatttgggagaccgaggcaggcagatctcaggagtttgagactagcctgggcaacatggcggaaccctgtctctaccaaaaatacaaaaaaaaaaaataagaaattagctgagcatggtggcacgcatgtgtagtcccagctacttgggaggctgaggtgggaggatcgcttcagcctgtgtgacaaagtgaaaaaagtcagaataatggctatctgttgagagattaggtactatctgggaagggtatcagatgaccttggagcctgttggacattttttgaatcttgatctaggtggtaacgtcactggtagataagcactgtatataaaagctcattgaatttacacttaagatttgttcacctgattcaatataaaatttacctaattttcggccagccgccccgtctgggaggtgaggggcgcctctgcccggccgcccctactgggaagtgaggagcccctctgcccggccaccaccccgtctgggaggtgtacccaacagctcattgagaatgggccaggatgacaatggcggctttgtggaatagaaaggcgggaaaggtgggggaaagattgagaaatcggatggttgccgtgtctgtgtagaaagaagtagacatgggagacttttcattttgttctgtactaagaaaaattcttctgccttgggatcctgttgatctgtcaccttacccccaaccctgtgctctctgaaacatgtgctgtgtccactcagggttaaatggattaagggcggtgccagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttatctgctgaccttccctccactactgtcccatgaccctgccaaatccccctctgtgagaaacacccaagaattatcaataaaaaaataaattaaaaaaaaaaaatttacctaattttataaaaagtaagcttcctaataggcttctgtatatctagtcatgaaataaaagttaaaataaggctgagcgtggtgactcatgcctgtaatcccagaactttgagaggccgaggtgggcggatcacctgaggtcaagagttcgagaccagtctggccaacatgatgaaatcccatctctactaaaaatacaaaaaattggccaagcatggtggtgggtgcctgtaatcccagctactcaggaggctaaggcaggagaaccgcttgaacccggaaggcggaggttgcagcgagctgagatcgcgccactgcactccagcctgggcaacaagagtgaacctccgtctcaaaaaaaaaaaaaaagttaaaataaaacaaaagcaaaagactctcaaaacaaatcaaagagcagccaaataagcaactaataaaaagaaagtcattgtctggcttgtgcccaaaatgtactcatcagtctaagactcagatcattctaagcaccaatactttgacctgctttctatggagacccctgactattcaacttagcacatccccagaggacctttcctctacacttggctcatcctctgtgctccgtatttctcttcctgacatttctatctgcccgtctcccaagccacaaattacagcatcccattttacactctataataactgaatatcgtctcatatcaatctcttagcccttttactaacactgtcttcaaatggggtacaaaaatagctttctaatagaatcctcccaacccaatttctggctccagcatattttgcaaaaggctgtcagtttgatttcctcgcacagtgcttctggaaaggatggcagtgttgtagacctgctgcatctgatatggtcactgctagccacaggtggctactgggtacttaaatgtgctcagctggctgaagaactgacgttttcatttcattttgttttaatcagtttgaatttagttaagcacatgtggctagtggctagtgtgttggtcggtacagttctagaaggaaagctctgagctgtgcccctctctccaggtggaattagattttatatattcactgactcaggcctgagcaggactggtatcagcctaacggcccctcttcatccaatacaaacataattttgcatatcagacttcaagctgcatttgttcttttaattctcctcaagtaattgtataggaacctttttttttttttttttttttttgagacagagtcttgctgtatcgcccaggctggagtacagtggtgtgacctcggctcactgcaacctctgcctcccggttcaagcaattctcctgcctcagcctcctgagtagctgggactataggcgcaggccactacgtccagctagttttttgtattttttagtaaagatggggtttcaccatattggccaggttggtctcaaactcctgacctcatgatccactcgcctcggcctcccaaagtgctgggattacaggtgaaagccaccacacccagccaggaactactttttaatgcaagcgtctttctcactgctgaccatggatcctggattatttttaagtggctgggcccggttctacagatatatcaaaaggctcccaatctctatgcattatgtccatttgaaaggcactatacttggccaggtgtggtggctcacgcctgtaatcccagcactttgggaagctgaggtgggcagatcaactgtggtcaggagtttgagaccagcctggccaacatggtgaaaccctgtctctattaaaaatacaaaaattagctgggtgtggtggtgcacgcctgtaatcccagctacttgggaggctgaggcaggagaatcgcttgaacctgggaggcagaggtggcagtgagccaagactgagccactgcattccagcctgggcgacagagcaaggctctgtctcgaaaaaaaaaaaaaagaaatgcactttctggccaggcgcggtagttcacacctgtaatcccagcactttgggaggccaaggcgggtggatcacgaggtcagaggttcgagaccagagtggccaacatggtgaaaccctgtctctattaaaaatacaaaaattagccaggtttggtggtgcacgcctgtaatcccagctactcgggaggcaggagaatcacttgaacctgggaggtggaggttgcagtgagccgagatcacaccattgcactccagcctgggcaacaggtgagattccgtctcacaaaaaacaaaaaacaaaaaacaaaaacaaaagaaatgcactttcctggaaacttcagcccaaaatagcaaaattaagtgtgattgaaaccaggttgtattgtctatcatatgtacagataagcaaaaattataaacaacataactggattcaataaaaacttgggtaattcatttatgggaaaccaatagcctgtagccatgtagctattagaatgattagatttgtactgacacagaaagatgtatcaaattataatatgaaatcagcaggatctaaaattctaaatatcccaattctactttatttttaatataaaaatatgtatacaatcatacagaaataaatagaaagaaaacacattaaaatgttagcagcactggtttatctccaggtggtagaatttgatgtagccaatccaaattttctctataactggtattaacactctttaaaaatgaaaacagatttcaatattaaaatattcagtatacttctaaagccagattttttttttttttgaggcggagtttcactcctgatgcctaggctggagtgcaatggcaccgtctcagctcactgaaacctccacctcgtggattcaagtgattttcttgcttcatcctcccaagtaactgggattacaggtgcccaccaccatacccagctaagtttttgtattttcagtagagatggagtttcatcatgttggccaggctggtctcgaactcctgagctcaggtgattcacccacctcagcctcccaaagtggtgggattacaggcatgagtcaccgtgcctggccagatattctttacattttgaattagtggccaggcatagtagcatttccctgtagtcccagctacttaggagtgaggtgaaggtgggaggatcacttgagcccaggagttctaggctgcagggagccgtgatttgtgccactgcactctagcctaggtgacagagcaaaaccctgtctctaaaataaattaaaataaaaattctgaattagtgactgttttctgtaaaattcggagctacaacaccaggcgaaccagaagccccacgtataaggttttaattatttaacaatggccattttcttttcttttctttttttttttttttttgagacagagtctcactctgtcgcccaggctggagtgcagtggtgggatctcggctcactgcaagctccgcctcctgggttcaagtgattctcctgcctcagcctcctgagtagctgtgattacaggcgtgtgccatcatgcccagctaatttttgtatttttagtaaagacggggtttcaccatattggttaggctgatcttgaactcctgaccttgtgatctgcccatcttgtcctcccaaagtgctgggattataggcatgagccatcacgcccagccaacactggccattttctaatagagattctgaaaaaggaaatatgtaagactctgtatatagactctgtacacagactctgtatataagtatcagtctctgttgggagtgccattctaaggaatgattaccaattctgaaattcagaaaaggatctatgtaaacataacaaccgaggccaggcacggtgcctcatgcctgtaatcccgcactttgggaggccaagcagggtggatcacttgaggtcaggagtttgagaccagcctggccaacatggtgaaaccccatctgtactaaaaatacaaaaattagccaggtgtggtggtagatgcctataattccagttacttaggaggctgaggcaggagaattgcttgagcctgggaggcagaggttgcaacgagctgagatcgtgccactgcactccagccttgtgacagggtaagaatctgcctcaaaaaaaaaaaaaaaaaaagaaaaagaaaagaaagaaagaaagaaaaaccaattgaaaagagaaaaaaactattcattaaaggaggttttttttttttttttttttaacaatctcacagtgtcacagtggggaggatttgtccaaacataacgcaaacttcaaaaactacagaagatttgactacttggcaaagaccacaagaaaaaccatcaaaacaagcagctgagagaaatctgcaactgacatcatagacaaaggattaacttccttaatctgtaaatactgtctgtaaaccaagaaaactagacaatgcaagtatacacaagttatcaatacaagctgggtgcagtggctcatgccttgtagtccctgcactttgagaggcagagatgggaggatcacttgagccaatgagtttgagaccagcttggggtgcatagtgagataccatctctacaaaaaaaaaaaaaaaaggaaaaaaaagacatataggctgggcacggtggctcactcctgtaattccagcacattgggaggccgaagtggacagatcacctgaggtccagggttcaagaccagcctggctaacatggcaaaccctcatctctactaaaaatacaaaaattggccaggtgtgttggcgggtgcctgtagtcccagctacccgggaggctgaggcagaagaatcacttgaactcaggaggtggaagttgcagtgagccgagatggtgccactgcactccagccttggagacagagtgagactccgtctcaaaaaaaaaaaaaagatatataaatacagaatagtagttatttcagggaggaagggagacaaaagcaatcagggagaagtccacagaaagtttctaaggtactagttaatatcctattctttgttgtataaactaggtgacgggtacagaggtgttttattattcttaagtctctttgtgtgaacatgtgtatgcgtgtatatacacatacatttacacacactaatatacatgcatatattctgtatttagagtaaaaaaaaaatcacatgcattaaagttttgattacaccacgggctggagtaaaggggaagagagacttgcaagtaaaaatgtatgtgagcatttctctggagaactatgacatctataaaaattccaatgcacataatttttgatccagtatttctacctccaggaaattcactccacatatataactgcacatgtattatatgaaattacattatacaaatctatttattgtaacatcatgtgttttagtgaaaatttgaaaacaaattattgacagggagcctaatatataaaacacactactgtgcttttgaatacacatgcagctgtagccacacacacacaaacacacacacacacacacacacacacacacacacacacaaagtctttagatagaatttcatgagatcggccggaggcggtggctcacgcctgtaatccccccgctttgggaggctgaggcaggcagatctcctgaggctgggatttcaagaccagcctggctaacaaggcgaaaccctgactctactaaaaatacaaaattagccgggcgtggtggcgcatgcctgtaattccagctacccaggaggctgaggcaggaaaattgcttgaacccaccagacggaggttgtgtgagccgagatcgcgccactgcactccaacctgggtgaaaatgagactttttctcaaaaaaaaaaataatttcataatatattatttggggaaaaatatatagaaaagtatgacataattggtttattaaaaagaaatatatacattcagactctctgtagagggatatctgatagagaaatagatatggaaagtgtattatctattcaagaaataagttttaaaaacaagtttccacatagacttgtaatttaatgatcataccaaattaactgcatcttgtgattatacgtagaatgatttcagtcacacaaattaaaaccttaacagaggaaagggaattgcaaaaaatattctctatcaaattaattatacttgtattggggtaatgaaactcagaggggcagttcatatttctccatttttataatgaaagttcacagatttgtaatacacttagtgtgtttcataagctataatagagagttgtcctgacaatatttgaagaaaaatgacattagttccttcctcctgtgtaggaaaaacattcagttgctcttccaggtcattcaacaaagaccttttctttcttttttctttttttttgagaccgaattttgctcttgttgcccaggctggagtgcaatggcgcgatctctgctcactgcaacctccgcctccctagtgcaagcgattctcctgcctcagcctcctcagtagctgggattacaggcatgtgacaccatgcccggctaattttgtatttttagtagagtcggggttttgctatgttagccaggctagtcttgaactcaacctcaggtgatctgcccacctcggtctcccaaagtgctgagattataggtgtgagctaccatgcctggccatgaccttttctttttttaacctcagctttttattttgaaaaaagccaaatctcagtaaagttgaaaaagaattctaatgaccatctctacatatgtccatgttttgcaaaattgggcttatcactttctcgctgttctcagacacacatacacattcaggctcttgttttgatttgacaaaaatcagataactctgtgtagtcctcagtcctcacagtattctcagatggcagcgttacagagcagccagggttcagttgtgaaccaaaagaactgttctaactcctcccccaccctcaggaggaaagcaattcactggagacctgtatatccattctagtctaccagagagggcctgggacagaattgtatggttacagtaagctgaggaggtatcttttcgttgattcaccaatatgttctgaattgggactctggtatctaggaacacatattccaatggtagaagatcattcttttatatgatgtgaccgagtacaggagatgtatcttatggctaggaattttctgtgtaaacccatgcatcagagaaaaagatgaaatcagatatatacctttcactgagggattatcaatccatctctaggcctcgaattccttactattatttagaacatcgtcaacctgctgttgaaaatgaaataaacatcttctgcaaagtttatttattttttattttattattattttttttttgagacagagtctcgctctgtcaccaggctggagtgcaatggcgcgatctcggctcactgcagcctccgcctcccgggttcaagcaactctcctgcctcagcctcccgagtagctgggattacctgctcaatgctgttgtagcagagggggaacatccccagggagctgcagactggtgggaagagcaggcaggcacactcgacacagaagcccagacaaacccttggtatcatgagtggctcaaggtcagagataaccaggcccgtacatgctgtctttccacgtcagacttgtattgatgctatttaaatcataaaagccaccagctccatggagttcccagggaggcagttctccttagtacttcctggtcactcggtggtcagagctgcgggcacacaggctcaagccactccacatgtcagtcgatattgcaaaccatacatcatagtatacctaattaatatatcaatgttggccgggcgcagtgtctcacgcctgtaatcccagcactttgggaggccgaaacgggcggatcacgaggtcaggagatcgaggccatcctggctaacaccgtgaaaccccgtctctactaaaaatacaaaaaattagcagggcgtggtggtgggcacctgtagtctcggctactcgggagactgaggcaagagaatggcgtgaacccgggaggcgaagcttgcagtgagccaagatcgtgccactgcactccagcctgggtgacagagtgagactccgtctcaaaaaaacaaaacaaaacaaaattccacaacaaacaaagtagcatttaacaccaagagaaaggggataggaaagagcgttaatgaaccagtcccaaagaatctcctggtctggcccaggtggcccatcagtcttgcaaggaagagtctttgatgtgggcagagcctttggtggtagattctgggtaccaattaccagtgacagcaagatggggtctgttaagatggctgtttcgagctggtgaagtcctgctgtttgatagccccagagtcctctggtgaggactgattgtggaggagtgtgcctggtgatgcccttatctggctggatgcactctttgttgatcaggtgaaacatttggtccctgttggcaaagtgctttgtgaaatagaagatggagtcttttgttaagatggaattacttatgtcaatggtgttgtatacacttgacaaggccagatgacattcccaatttgtttttataaatagtagagaaacttcgctggaggaggagggtcacacatagcaagagcagagggcttggtgcatcttccattccagatgctactgagaatgtgcaaatcagtgtcacgacggatcccaaaggtttcatttcaaactgagccatggacattttatagtgcctaacttactattcaaaaatactcacacacacagttttgtttgtaacatttccactcatagaaattccacaggctttggtataggaagtgtcagcggaacacacctttaccctggggtaaaaagcatagtcttccctcacagttaatgctctcaatcttctgattctgggtgtctggtagatcttgtgtccccagaggataaatcaatgtattttaaaagtattaataatcagtttacagccatgcattgttttataatggggacatatgctgagaaatgcatcattaggcaattgtgcattgtgtgaacatcatagagtgtacttacacaaacagatggtgtagcctcctaacacacctagattatttggtacagcctattgctcctaggtacaaacctgtccagcatatgactgtactgaaaatgtaggctgaaaattttattttacatatgtaggcagctgtaacacaatgtaaatatttgtgtttctaaacctggaagaagcacagtaaaaatacagtattataatctcatgagaccaccgtcgtatatgtccgcagttgactggagccgtcattaggcagcatatgactgtagtccattaattttaagtattcaaaacaatttccatccattcacaattcaaacaattgctcacaattttgtacagctattaatccaggaaaccattagcctaggaagccaaatgtttagttagacacaagtttagggaaacatttgagtattgctggaggacaaaagcactcactaaataaccagtggctgattaccggcctctggaccatggccagttggaatagctccatgtcattctttctttctttctcttttttttaagttttgttattacaagaataattttctatattagactgttttcactttattaactttatcataagtatgccaacttctgcaaacttggagcaattgcaataatctattgatttattttcaccaaattttcactttatttgcccagaattcaagcttgtctgttaatttcccaggtcttcaatgacttgtctcttattggctagcatctccttattttccttgttcaattagtaaggttttccttattatattacttttttggggggcctttctctgttagtatatagattttctcctgagagctaaaaatcttcataacaccttagtcaatatacctttgaaaaaaccccttatattggctggttgcggtggctcacacctataatctcagcactttgggcggccgagatgggcagttcacctgaggtcaggagtttgagaccagcctggccaacaaggtgaaaccccgtctctactaaaaatacaaaaattagctggatgtggtggcaggcacctgtaatcccagctactcgggaggctgaggcaggagaactgcttgaacctgggaggcagaggttgcagtgagccaagatcacaccactgcactccagcctgggtgacaagagcgagcaaaactctgtctcaaaaaaaaaaaaaatcccttatattataattgtcattgaaataatctgacattcctagtaacctctgacactaaaattttcttcgcttttaatagaaacacaattcatcatttatccattatccattgttttgaatttaatttaattcaccaaaataatacatatattttagtaccaaagatcaaaaagtgctcgaaggtttataattaaaaaaaaaaaatcctctcttctcccccattccggctatctagatacagtcatgtccaactctcagttctttcttatagaatatgcatgatattccctcatctttcatttaagttaaggaatatcatgtatattctataagaaacagaatgaggcattctatttctatttccttagaaatagaaattggaaatagaaatctaaattggaaagattggccagttgcagtgactcacacctgtaatcccagcactttgggaagccaaggtggaggactgcttgagtccagaagtttgagaccagcctgggcaacagagcaagacaccatctctacaaaaaggtaaacaattagctgggcgtggcggtgcaagcctgtagtccacgctacttgggaagctgtggtagaagaatcccttgagtccaggaattcaaggctgcagaatgggcagaatgactgtgccactgcactccagcctgggtaacagggtgagaccctgtcgaaagaaaagaaaaaaaaaaagaaagaaaagagaaagaaagaaggattatcttttaccttttacttgctacagataacttccctgccacctcattccaatatagtcaaagcaacattttattaagccatcaacacctttgttttttatggagttaacagttctctctatatatatttagtttttttttcctagtgtaccaaacacagattcatcccttatactgtcctatggagctataaagcttttcttgacatagccaaacggctaggaaataatcaattctatttattttttccttcaaggtacccttctgtgaatcttccaccttttgttctaattagggccaactgatgctgtcgtcctgggaattttcccattcaccatcactttgctaattccttcacctctttgctttcctgtactcaggagacatccttggcaaaacttaatggttgctgggtcatgatgaaatattataggcatactagagaagctgcttgattaagtagccatcagttcgacaaaacaaaaaacaaaaacaaacaaaagctaatttgtagagttttttagataaaattgtcctgtgaaacttcaaaatcaagcttcctcatctgttcattaatgctgagatctttgttttgttccttcaggtaaggcaaatacccgacatacagggattgtttaataaacactttctgggtttcttgttcattcatttaacgcctttgccatcatggggtttccattccagacaggaagttaaatacataatgttaaatcaggtcatgattaatgctacaaagaaaataatgtagggtaagaggtaagagaatgagtggggattggagagaatgttcagggagggcgctctttgtggaggacagatcaagaaaggcctgtgtggtggcagccagctggagcctagcactgcggtccagatgaaagatcacagcctcaactagtgtggtcaaagggaggatggcgagtgtttgctgagggacatatatggatggtagagctgacagtctttgctgatagattgaacacagaatggcagcaaaataaaggatggctccaaagtctgtgctgtcagaatgagcccctgaagcttttagaatgcacggggtgcctgcgagggtggcacatttgggaatctagttggctctgactgaagctatggagaaacgtggcaaagaagtgaggaagaaaggatgctgaggcgggcttaggaggccctttattaaagcctggctgtgtttataatcgcaggcaagaagggaagctaatgtagtaattcagaaggatgaagagaactaaattgaggaaataggttttcatttttatcaagcaattcatcattgactacgactccacattaattcagctctacccataaagccaattaaattaccccaagaaatcaataaaaacacaggcagggtggggaagacattcttgatgaacattcacacgtcttttttataagtatttgggaagagatttcgggctaaaggggtgaagcatgttccctacatcactgtagacctaggaaacgaattctatttctccttttccctccatacaagcaatctaactccacaatgaagatagggacagcacattctcaggggaaattgacatggacagttcctggactatagctcactcctatctgaagctctgaatgttaacatccaatgtaggaacagcttttagcttcagaaattccacaggccaaagaacaatgataaccattaagaagattgcaacaggagcttttacctccaccctctttttcaaatacaaagttctcttgtatctctgagtatctggaatgaccacatagttctcctatctgaaataagacagacacacaaaacagggtaatctagctgaccagagagtgctgggataaacacaaagctcactaaaacggttagggaggggaaaagcttattcacatagttttaacttttttttttttttttgagacagtctcgttctgtcgcccagggtggagtgcagtggcgtgatcttggctcactgcaacctccacctcttgggttcaagcgattctcctgcctcagcctccagagtagctgggactacaggcgcccgccaccacgcccggataattttttgtatttttagtagagacggggtttcaccatgttagccaggatggtctcaatctcctgacctcgtgatctgcctgtctcggcctcccaaagtgttgggattacagacgtgagccactgcgcccggccaatgtttgtatttttagtagagacggggtttcaccatattggtcaggctggtcttgaactccggacctcgtgatccacctgcctcggcctcccaaaatgctgggattacaggcatgagccactgcacccagcctggttttaacctgttttttaattaaaaattttattttacataaatacactttttgaaaataattttaagtttccatcaacggcttcctttgagtaatgtgaacctcacttccacatctttgccaggcctcgacttccccaactctcccctccagtgagcctgttatctgtctgcaaatacttttaacgagatacaatttgtgtggttggaaagaataaacagcccaggtttcaagagtctgaatatcactctctggagattttgaatgtattggctctatttctgactcagttaaaaaaaaaaagtactgccacttagggtagatgaggtcatagaaagcattctgaaccttccctggcaggtagcaaatgtacgacaaactgaaattgctattttgaaaggagaagcaatatttacatttacatcctttctatttatcattctaccacatccatctatcattacagagaattccttcttctcatgtgaggttaaatttccaatctcatacttgattttttccaggtcaaaagtctcattctcttatatatgttccaatttgtcgaggcataactgaaatgcaaatttacccatgttttgccgttacccacctacgtgttttttaacttccatgtaccattgataatatttatcacattccagtcagaaaatccgaaaaatcaaagcttcaaattccttccttattccctgtgaattcttatctcctctctatcctgtaattccttttcctgctttgtgcaagatcaaaaaattaactgcagtgaggtcacttacctctctccttctttcagccctacacagactatttcaagctgactgccctgcctttccattgaagacagaaggagctggtctagattcctatgagctgtgagatttcctgagcctctcccgctaatccttaacccagaaatgtattcgtcatttggctataaaaaaactcacagcttgacatccctgcacatgtaagagcactttttccaagttataactacagaacaaaactagatattctactttattgatacatttgttgtccaaggtacatttaccatatacaaatacagagacatcttttcagtgtagtgaggtaatcccaggcgttccatagcactggaggccccactggccaaaggcttcctaggtctacttagctcaaatatccaactcttacactttcttttttttttttttttgagacagggttttgctctgtcacctaggctggagtgcagtgacttgctcttggctcactgcagcgtcgatctcccaggttcaagtgatcctcccaccgcagcctcctgagtatctgggactacaggtgtgtgccaccatgccaggctaatttctgtattttttgtagagacaagatctcgccttgttgcccaggctggtctggaactcctggactcaggtgatcctcctgccttggcctcccaaaatgctgagattacagatgtgagtcaccatgcctggccacttaccgcttttatttatttattttttttttgagatggagtcttgctctgtagcccaggctggagtacaatagcgtgatcttagctcactgcaacctctgccttccgggttcaagcgattctcctgcctcagcctcccgagtagctgggactacaggcgtgaaccatgatgcccagttaatttttgtattttttaaatagagacggggtttcaccatattggtcaggctggtcttaaattcctgaccttgtgatctgcctgccttgacctcccaaagtgctgggattacaggcatgagccactgcgcccagcccacttatcacttcttaaagctacttccaattatactttgcccaattaacaatcttcctaatacagctgtttcattataactaatccctagcaccatcaacacatttttacatttaaacagtaaaccgtacactacaccagagccactgaacaaaccgcctgttgttttctatttcttgcttctgccaactttgctgtttgtcttggttggatattgtaatcaactaaggagctttgaaaaaaaatgatgcctagttttcaaccccaaagattctgatataattcttgtggagatatggtttagatattaggatttataaaaacttctcaggtcagccgggtgcggtggctcacacctgtaatcccagcactttgggaggccgaggcgggcggatcacgaggtcaggagttcgagaccaacctggccaagatggtgaaaccctgtctctactaaaaatagaggaaattagccaggcttggtggcaggcgcctgtagtcccaactactcgggaggctgaggcaggagaatggcgtaaacccgggaggcggagcttgcagtgagccgagatcgtgccactgcacgccagcctggggacagagcgagactccatctcaaaaaaaaaaaagaaaagaaaaaaaagaaacacgtgggccgggcgtggtggctgacgcctgcaatccaagcattatgggaggctgaggtgggcggatcacgaggtcaggagtttgagaccagcctggccactatggtgaaaccgcgtctctactaaaaaatacaaaaaactagccaggcgtggtggcgggcgccagtagtcccagcaactcgggaggctgaggcaggagaatcgcttaaacccaggaggcggaggttgcagtgagccgagattgcgccattgcactccagcctggcgacagaacaagactctgtctcaaaaaaaaacttaggggtagagcaatgtctctcaacattttcgttacattagatacaaaactggttaaaaccccacaaggctataaaatgaaaacctttgagatgatctttttctaccagaccgtctacagattttttggacttttttccttaatcacttcctccctcatgaaattttactaccacatacatactgcatatgtttatggactgggctcttttggagggccctagccacagtaatatataagacttttttcacctctcatgaaccgatttttaccaattgaactcatgggttagaagtacaatcatgtgtgtgtctccccagttcctgagaaatgcatccttaggcgatttgtccttgtgcaaatgtcagtgtacttacacacacctgaatggcactgcctgctgcacccctaggccatatggtatagtgtagcctgttgtccccctgggctatatggtgtagcctgttgcccccctaggctatatggtgtagcctgttgcccccctaggctatatggtgtagcctgttgcccgcctaggctatatggtgtagcctgttgcccgcctaggctatatggtgtagcctgttgcccccctaggctatatggtgtagcctgttgccccctaggctatatggtgtagcctgttgcccccctaggctgtgtggtgtagcctgttgcccccctaggctatgtggtgtagcctgttgcccgcctaggctatatggtgtagcctgttgccccctaggctatatggtgtagcctgttgccccctaggctatatggtgtagcctgttgccctctctaggctacaaacctgtacagcaggttactggactgcatactgtaacacaatggttttgtgtatctaaacatagaaaaggtacagtaaaaatatagtattgtaatcttgtgggaccaccatcatatatatgatctatcattgaccaaaacactattatgcaacacttaactgtatacatttaggggtcactgctgaggagttgatagttttggctgtggatatgaggttcacttagaagtgaatgagaagtgagatcctaggaaggaacatgaagtatttactacatatttaaaaggaaagatgcatttggcacaatggtaggaaaatgaggacagtgcacatcctataggtcaaggaagaatatattaaggataaagagattaatagcattgactacttctgagagcttgagtaatatgaaatggaagtggccgggtgtggtggcttacacctataatcccagcacttctggaggctgaggcagatggatcacctgaggtcgggagtttgagactagcctgaccaacatggagaaaccccatctctactaaaaatacaaaattagctgagcatggtggcacatgcctgtaatcccagcttcctgggaggctgaggcaggagaatcacttgcatccgagaggcagagattgtggtgagccgagattgcaccattgcactccagcctgggaaacaagaacgaaactccacctcaaaaaaaaataaatacataaaataaaatcagttggatttagcaatatggaagcgattaagacctgtaggcagaaagagacagaaagcaaattggactgaacacaggaatggatagcataaaccaacacacacaccagagtgcatttgggaggccgaggcgggcggatcacgaggtcaggagttcgagaccagcctggcctatatggtgaaaccccatctgtactaaaaatacaaaaactagccgggcgtggaggcacatggctgtaaacctagctactcaggaggctgaggcagaattgcttgaacccaggagaaggaggttgcagtgagccgagatcacgccactgcaccccagcctgggtgacagagcgagactccgtctcaaaaaaaaaaaaaaaaaaaaaaaaaagggagatatagtcttttttttttttttttggagacaacatctcgctctgtcgcccaggctggagtgcaatggtgcaatcatagctcactgtagcctcgaacttctgggatcaagtgatcctcccacctcactcttccctgtagctgggaccacaggtgcaagccaccatgcccagctaatttatcttttgtagagacaatgtctccctgtgttgcccaggctggtcgcaaagccttggcctcaaggtgtcatactgcctgggcctgctgaagtgttcatattacagaaggaaccaccacgtctggcctacattagctttttaaaagttaattttagaaggtcctgattgaggaatagtttcaatattgaaaagagaaaacgaatcacctatagcaggggtaggcaaactgtggcccctgtttttataaagttttattggaagagtagagccacatgcattaatgtaagcactgtcctggctgtgtatgcactagagcagcagagttagtttcaagagggacagtacgaccaataaagtctaagatattaattacctagttttttacagaaaaagtttgccaagccctgatctccaggtgaggatttcctaaaagccctcaggaatttggaggaaatacaaggtaggaaaaaattggtttattgcaagacagaagaaaggagaaagaataggtgaaggtgaatttgcaatttgttgctcaaaagatgagaaatgttgactgctgggctccttgaaagattgatcatccgaaaatcctgttgatcgaacaaagctttagagctttgacagagtcaggctctctgtcataagcacacaacctgacagtcttatcagtgtgtcagatggagaaagaggggaaagacacagggtctgggttggaaggttcaaagggggtcttgcaggatgtagaactagttggaattggagtttttggacattatgaatgcattttttaaaaatatggatgaaaggctgggcgaagtggctcatgcctgtaatcccagcactttgggaggccaaggtgggtggatcatgaggtcaggagatggagactatcctggctaacatggtgaaaccccatctctattgaaaatacaaaaaattagctgggcacggtggcacatgcctgtaatcccagctactcaggaggcggaggcaggagaatcgcttgaacccaggaggcggaggttgcagtgagctgagatcgcgccactgcactccagcctgggcgacagagtgagactccatctgaaaagaaaaaaaacagatgaaaatgtatagaattatgaccaaaatatttaactaataacttagttattattatgatattcacaaggtaatttcaatatattaattttctctgtcttaaattcaatattcgaagataattagctgttaacaaataacctgcagcctgacgaatatggtgaaatctcatctctataagaatacaaaaattagccagctgtgttggtgggcacctgtaatcccagctacttgggaggctgaggcaggagaatcctttgaactctggagttggaggttgcagtgagccaagatcatgccattgcactccagtctgggcaacagaaaaataaataagtaagtaaataaataaatagatagataaaacttggaaagccctcactacatgggtacattaggaattcctgcactttggagaaagaatgctgataatggtttaacaacgttctctgatttttcagtttgctaccctcgttttttgctattattgttggtctaggtcagggtttgtcagcctcagcactactatgttttgagctgaatgattctttgtgcgtcaggctgcgctgtccatcgcaggatatactgcagcatcactggcctctattcaccagattccggtggcacggctcttctggtgacaactaaaaaattgctccagacatggtctagcttattataaacaattttatttttatgttgtgggttgtatagcaatgtttgatccaaagtatttatcttagcttgaaatttgcagtagctagacatggagatgtctattactgggttttgaacattaattatacatttattgctaaatcatctcacatttccctttatgagtcatcatcatattttcttaaaaaattaggtaagggtttgagagccattgctctgaattcttttttttatttttatttttttgagacagaatcttgctctgttgccaggctggggtgcagtgcagtggtgcaatctcagctcactgcaacctctacctctactgaatcgcttgggttcaagcgattcccctgcctcagcctctcaagtagctgggactacaggggtgcaccacaacctctggctaacattttgtatcttagtagagacagggtttcaccatgttggccacgatggtctcgatctccggacctcgtgatctgccggcctcagcctcccatagtgctgggattacaggcgtgaggcatcgcgctcggtctgctctgaattcttcatcccagtgtttcaaataattgtctcacttccagctcacttatctgacctgaccctgacttttccaatagagccatttcccccaattctccatgtgattcagcaacaagatgtattgtgacttttccaagtgtatatctttaccagaatatacttattcacatcttttttttttttttttttgagacagagtctcactctgttgcctaggctggagtgcagtggtgtgatctcagctcactgcaagctccgcctcttgggttcacgccattctcctgccttagcctcccaagtagctgggactacaggcgcccgccaccatgcccggctaagtttttgtatttttattagagacggggtttcaccatgttagccaggatggtctcaacctcctgacctcatgatccgcatgcctcggcctcccaaaatgcagggattacaggattgagccaccgcgcccggccttattcacatcttttaaaagcacattttgagaattcgaaatggtcaaaaatgtctccccaaaagataggtaagcaagatcctacatcttccttgactcccatgagtcaacagaggcaattttctgacatttgcctttcgttccttcctcctctgcccatcctaaagaacttggcctccatgagccagagcccacctacagagggctgtgtacatgatatgctgcttctattttctgtgggaactgacttgcattttgagaacatttgagtaaaactggaccaccgttccacctagtcatgctcattacaactgatccctgtgcgacaggagtcaaggcggagcttgctttttgatctgatgaccgtctcaatttaattccttctccttgtcactagatatgtaacagcaatgtcactttagaaaaaacaaatcagctctctgagcatcagtttccacatgagtaaaaagattaatgcacactcataggttgttaaaaacattaaaggagataaagcatgatagaacttaaacataaaagtccctatgtagatacttattttctcagcattatacaaccatccctgagcaaggatgtaagagaaggcatttgcctgtagaccaccaaacagagaaagaagagggtgaacaccaggcatcatcggtattacttacctgattcaaaccattacctgtcgggcttcttctaataaatcaaattgttcctatcagaaagagaggtaggccgggtgtggtggctcacacctgtaattccagcactttgggaggctgaggctggtggatctcttgaggtcaggagctcgagaccatcctggccaacatggtgaaaccccgcctctactaaaaatacaaaaattagctgggcgtggtggtgggcacctgtaatcctagctactcgggaggctgaggcaggagaactgcttgaacccggggaggttgtgatgagccaagatcgagccactgtactccagcctgggcgacaagagcgaaatttcgtctcaaaaaaaagaaaaagaaaagaaaatttaaaaatattcacattttccacaactccttcttatccacataaaatatctatataaattattattctctatttggaataaaacactttaggaagtcctgatactcactgtcagtaatggacacctgttccgcatggtggcatgctcatatctaaagtcccgctttcattcctgattatacctgattctgcaaatgttttcagaaatacatcaagttcctaacctagttctaaggaccccagactgtatttcttctctaattccccaagcttacgatgcatatgcattttttctcattagcataggatctccccgttattatcattcatgattcaggttaagtgcaacctcttccactacacacaggtgttgacagttacacaaatgcaaaggctctggatattaaatcaggctcctactcctggaacgctttttattgggttagtttacacaaattctttcaaagtcttgttctccaactttctggtgtctcgtggtcttggattttacacacagaagattaagggctaacagtagcatcacaagaaggaccatgttgtaagatggtgagggagtctggacttgtgtctccatttgggatacagagggaaaacacaggcctgagagctccttggaaggcgcaatgggagaaattgtaaatgagggacatctcggtcacattgtagaatgatatctgcccgtgttcgcagtcaaggaaaacgccaactgtgtccaacttcttttccaggaagagccttttcagaggggggaagacccagagagtccactcggtccccatcaccgaccccgtgagcaagactttctctccggaagctctggccgtgctgcccttcgcgtctgcagagccgtggtatatgcccacttgccacctggttgccttttccacgtccacctcccagtagtgcctccctgaggtgaagctctccgcagccagcaccatggcactgaaatccaatctttctgggttgccagccccatcctgctgcccatgtctcaatctcatagttctcaggtcctcagatagtgccaggcagggatgagctgtttcaggatccaatgttaaatgtcctatcaggagagaaaaccctcgttaacctaggagttcaccaatgccaatgccagagacatgatttctaacacacctgggcttcccactgagtgggcacaagtcccaggcccagatacgggagaggcaatttgggagggtccaggaaaaggaactgctgaacttcaatatggacctcatggaggaaaaagtccataagatatggaaagggacacagtctacctgagcgggaagaataaaacaaagatgaatgagctaaggaaggtttagaaacaccttcatccaacgtggcgcggtggctcacgaggtcaggagttcaagaccagcctggtcaagatggtgaaaccccatctctactaaaaaaatacaaaaagtagccgagtgtggtggcaggcgcctgtaatcccagctactcatgaggctgaggcagaaaattgcttgaacccaggaggcggagattgcagtgagccgagatcacaccactgcactccagcctgggcgacagagcaagactccatctcaaaacaaacaaacaaacaaacaaacaaacaaaaaacagcttcaccccagagacggtcaaactgtcctggtgccaagttccatccagatatcacttggggcccaaccctggtcttctagatctccaagcctggagcggccacaggagtcggccagcagcaactcattcgtggccctcccgatgccgtactctacacatcttaaatatccccacagggtgacatagaggcctggaaattgctgacaacaggccctggacatcaggcattacatcagataatttatcagcggaggatggaacacctgtgtggaccctccagaaactcacgctgagaacacgcaggctcaatgaattcctcacacctgcatgaatacgtcttcttcctatctctgactgttcctctcatctctttctgcccagcctctaactattgtgatctttcagggcttggtcctgggacttcttctttcaagtagtatattctccttcactgcccccaggtaactgtgcatagcttcagttttaaacatcttctctgtgtttgtgactcgctccataaacagctaaataccagttggaaaaaacacaggaatttcaaacataacacacccaaaatggaacttcaacgccagccctctgcagtctctacttctcagttcacagctccctcattgcttcagttgtctaagccataaacctggaaggcctttatttcctactttctgtaatgtggaatccagcttaatttctattatttgactgaagtaaatttaatgaacttaaatctctgaatttgaagcccaattcacattattagggtggtctcaacagctacacgtcttgaatttttaaaaaattgtctgagactctcagtatttccaggagactggcagaaacaaatgcaaattatctctggaaaaacgcacagctgtggctgggcacggtggctcacgcttgtaatcccagcattttaggaggccgaggaggacggatcacttgaggccaggactttgagaccagcctggcgaaaccccatctctactaaaattacaaaaatcagccaggcctggtggcggcctgtaatcccagctactcaggagggtgaggcaggagcatcgcttgcatctgggaggcagaggttgcagtgagccgagatcatgccactgccctccagcctgagcaacagagcgaggctcatctcaaaaacaaaaacaaaaaaggttgaagaaacaacaggagtatctcaagagaaaaagaacttgataaattcaacattgattcataaaaattcttagtaaaccagaaataaagggggacatcctcaatttgatgaaaggcagccattaaaaaaaactatagctagggccaggtgcggtggctcacgcctttaatcccagcactttgggaacctgaggcaggcagatcacgaggttgggagttcgagaccagcctgaccaacagagtgaaaccccgtatctactaaaaatacaaaaattagctgagtgtggtggcactcagctactcgggaggttgaggcaggagaatcgtttgaatctgggaggaggaggttgcggtgagctgaggcttcgccattgcactccagcctgggtgacagagccagacagcatctcaaaaaacaaaaacaaaaacaaaaacaaaaacaaaaacaaaaaacacaaaacaacaacaaaaagcgctatagctgtatcagaatttagagtgaaaagacttaatgttttctttcttcctaagatcgagaataagcaagtgtccactctcaccacttctgttcaacacactgcaggtctgagccagtataataaggcaagaaaaattcagaaaaggcttacagactggaaaggcagaaataaagctatctatactcatatactgcatgactttgtagaaaatcctgaaggatctatttatagaaatccactgtctaatgagtgagttttgcatagttatagggtacaaatgtcaatatatataaaacaattccatttctatatacttgcaatgaactagaaatgaatgaaatgtcaattagaaattgatattttaaaataccgtttacagtggctgtaaaaaacataaaatacttagggatacatctccaaatacatataacattttatgctgaaagtgacaaaacactgatgagagaaatcgaagacctaaataaatggagatattttgtattcctggactgaaagcaccaaatattgtcaagatgtcaattctccccaaactgatcaacggattcaatgtaatatgaataaaaatcccagcggtccattttgaagaagccaacaagctgatttcaaaatttatgtggaaaagcaaacaacctacagtagccaaaactattctgaaaaagaataaatttggagaatgcacagtacctgctttcaagacttcctacagagttatcaatcaagccagtgtgctattggcaaagggaaagagtcaaccatcaatagacctattagagtcacaaatagacgtgatcgcatataccagttgattttcaacaaaggggccaagtaaattgaatggacaaaggtagtgtttttaacaaatgaaactggaacaaatggatacatgtgagtcaaaaaataaaaatagaaggtggggggaggagagggtttgcaccattctgtgaactgtatacagatattaactctcagtggttcataggccacaatgtaaaaccgaaaaccataaaacttttggaaggaaatctttgttggctttggcaaaatttcttaaataagacacaaaaagcagaagtcataaaagaaaaaacttgataaattgaacttcatcaaaatgcaaaacctctacacttcaaaagacagtattaggaaaatgagaatacaaaccatgctgggaggaaatatttgcaaaatttatctgataaatgaatgctaaacagaacatataaagaaattataaaactcaagagacatacaacccaatttagaaaaggggtttgtacatgtatttcaccaaagttgagatagagggaaaacaaacacatgaaaatatgctcagcatcattagtcattctggaaatgcaaattaaaatgacataccactacccatctatcgggtcggatgtagtaaaacaaactgacaataccaaaccctggtgagaatacagagtaactgaatctttcgcacgttattggtgggaaggcaaaatggcacaggcaatttggaaaacaagtttggcaatcccacccttagacagtcaatcaagaactatgaagctgtgcccacacaaaaatctgctgctaatatttacagcacagagctggaaacaacccatgtccgtagaattgcaaaaggataagtaaattatggtatatttatacaatggaatattatcaacaataaaaaggaacaaactactgatacacgaagcagcctggacgttctatatgtcaactgcagtatgctgtcagcctcgaaaggccacacactgtaggattccatcgataggacattctgggaaaggcaaagctataaggacaggagatataaaccctttgttatacatgctgaatttcttccccagaagttttaaatttttaagcagtggaatctgcctgcaatcatgtttcatggctggggaactggtaaagaatctgcagccaggcgtggtggctcacgcctgtaatcccagcactttgggagcctgaggcgcgtggatcacctgagatcaggagttcaagaccagcctgaccaacatggtaagacctcgtctctaccataaatacaaaaaattagccaggcgtggtggctcacgcctataatcccagcactttgggagcccaaggcgcgtggatcacctgagatcaggagttcaagaccatcctgaccaacatggtaagacctcatctctactatacaaaaaattagccaggtgtggtggtgcatgcctgtaatcccagctacttgggaggccgaggcaggagaatcacttgaacccaggagggggaggttgcagtgagccaagatcgcaccactgcactccagcctgggcaaagtgaaactctgtctcaaaaaaaaaaaaaaaaaaaaaaaaaaaaaagattttgcatgggaagagctttcatatgagatcatacagttatttttttgatccttatctaatatgtataacatattaagctctccagtctcctaaaatttttatttatttattttaagacagagtctcattctgttgcccaggctggggtgcagtggtgtgatctcagctcactgcaatctccacctcctgggttcaagcaattctcccacctcagccactcaagtagcagggactacaggcacacgccaccacaactggctaattttcgtattttttgtagagatgggatttcaccatgttggttaggctggtctcgaactcctggcctcaagcaaaccgcccgccttggcctcccaaagtgctgggattacaggagtgacccactgtgctggcctaaaattgttaaactactggaatttgttttcatttatggcaggatggtcacctgattctcaaatgcagaacagtgccctgtgagtattcacatgtgtcaacttactctggagtactctgaacatgctgctgagtcctcttatgtggcataaactcaggtctgtgatatgagcgggctccagatgctcaagcagcagtgacttgctcctgaagagaaaggacagcctcagtcatctgcacagaccacaggccccttagtctactggatggatcccattacatcctaccagcaaatgcaatctccctatctcaatcaacatcttactggactctgattctcacccaattgtatccaaaatgaaaactcacctttctaaagagtattttgcattctaagggaaagaaaagagaccaggttactactgggtttttgagctgtttttgcaatctgtgcccaggaaaatatcctcttacaatgaactcaatttccatgtcatttcttcaacctcataatgctagttatcagatgaacaaattctaacatggaaacagaaaaagtcagaaaaatgcatgaaatcattttgtcgtagtcccaagggaaaggttttctatccctcaccccaggcatcttactcagagccatcatttctcagtcttcagacgggagcatctatctgctttccatgcagggggtggccagagttcagcaggtgaaggggccactggctgggagggcagtgggagccaggcagagccacacctgcctgcatgctcaagaactgagctgcttcctaaggatttacctacagacgctttccagatgagcgcattcattgcaattataagcccaggagagggatatggacagtcttaaaaagatagtaaggccaggcgcggtggctcatgcctgtaatcccagcactttgggaggccaaggtgggcgtataacctgaggtcgggagtttaagaccagactgaccaacatggtgaaaccccgtttctactaaaaatacaaaaattagctggacatggtggtgggcgcctgtaatcccaactactcaggaggctgaggcaggagaatcgcttgaactggggaggcggaggttacagtgagccgaaattgcgccactgctccagcctgggagatagagcgagactccgtctcggggaaaaaaaaaaaaaaaaaggtaacccactttctgaaaggcaacgtatgttactatacaaaattcaaaatatgcaatacttaccatagactgagtagcttctgcacagcagaaattcatttctcgcagttctggaggccgaatttcaagatcaaggcactggcagattcagtgtccggtgagggctccatccctcctaggtagcctccatctccagcctcacaagctgaaggggtgaggtcttcctcggcctcttttataagagccctaatcccattcacaggggctctgcccccaggccccactcactacccaaaggccccacctcccaataccatcgccttgggggagaggatttcaacatatatattttggagggacacaaacattcagatcatagcagataatctcacccttgtttcaagattatcacagatgactatacatttattaattttttgccagaaagtctgtgaatgttagcaaccacacatgtatatgtgtgtgtatatatacttattatccaaagatcaaacaaaaagcagtctgcatctttctttttcacttaatgagtgcttgaaatactgttagtgcctatagagctgttttattctttatgatcacagaatatttcattgcatggaggtattaaccacattgtgtcacatctcaaccctaacttactgctgataattttaaggtgagaattcatctcatgaagcagctccacactatcccacaaagctatgaccattcctaaagcttttggcagctgaaagaaagtcatgtagccttcttttgtggttgaagatcattggatattgtgttctgacagcaacccctaatgagtactgtccacttctcatttctcaaatactggaatgaattttattttctttttcccagcatcttaccttgagcaatgccaaggtgccttccccacactttttctcaagctccacgatgagctttaggaggctgcggacctgttcagaagccctggcttcactctccttcagtttctccatgttctctctccccacacggcccagtctctgcagaagcatttcttcgttactattcaacaacctcaagttcaggaacaagagttcggtaacttctcctatagattaattcaaccatgtttttaaaaacctgcttttcggttgggcgcagtggctcacgcctgtaatcccagcactttgggtggccaaggccggcggatcatgaggtcagggtttgagaccagcctggccaacatggtgaaacccagtctccactagaagtacaaaaattagccaggcgtggtggcgggtgcctgtaatcccagctactcaggaggctgaggcaggagaatcgcttgaacctgggaggcagacgttgcagtgagccaagatcgtgccactgcactccagcctgaatgacagagcaagactccaaatcaaaaaaaaaaaccaaaaccaaaaccaaaaaaaaaaaaaccctgcttttctgcctgctaccccaggaacagacataattaggcaaggccatgatattcttctgctgaagcaggattcctctcaagagacagttgattctttgccccctgttatgtatgtttaagccaatacagatgtgtgtgcacgcagcccttactcacattaatatgcacctaaaacatttcatgttttttctgtggctgtttgttcagaaggttccctattttttcattaacttgaaatcaattaaaattaaggtatatagattaactaataagaaataaataattacgttactgatatcaattttctttttatccttccaagtatactttacatatactgcgtagtcacatacgcaacttgagtatgttatttagggggaaaaaacataaacataagtgatagtttattatatttgattactaatctgacaacttactttattcttggagaacattccttattcatatacacagagccatgacatcatcttaacatgctgaagagtattcttccatgtatgtatggagcacattttgtgagtcttctattgacaaatacagggtgtttctaacctcttgctatgaatgttataattgtaacatctgctactcatcaactgcttaacatgaacaagacacgatttaataagctttagcagattatctcactcaaatctcacaataattttataaattaggggtcactgttatatccagtttacagctaaaggaaccaagtcaaaggttaagcagcaggtcgtaggccacccaggagccagtaaacagctggctcagataggaactccattcatccggcttcaaaggtgaattctaggccgggcgcggtggctcacgcctgtaatcccagcactttgggaggctgaggcgggtggatcatgaggtcaggagatcgagaccatcctggctaacacggtgaaaccccgtctctactaaatatacaaaaaattagccgggcgtagtggcgggcacctgtaatcccagctacttgggaggctgaggcaggagaatggcgtgaacccgggaggcgaagcttgcagtgagctgagattgcgccactgcactccagcctggagacagagccagactctgtctcaaaaaaaagaaaggtgaattctaaaccatggctctaaactgaaactcagtttcagtgttgccttacccaggtgtctttttctatgtgtgtaagtatgtttgaagcataatacagtaatatgtgtacaaatatatttataggtatattgtgctttatttatgtctttttatatgcatgtcaagataaattcatagaaatggagttgccaggtaggtatataattcatttaatacatgtgtggttgtcactggctatgttattttggaattgacataatgtttagctcttctttttctcatttctcaaatatgaggatgttgttttcaatatctcacctgtagcatttcctggaacatctcctctagctcggtggcaagcttgatcgcttgattcagaagggtttctctcaggttcaagtcagatatgcattcctgctgtctctggagattctgctcacactcttcattcaacaaccggagtctcatactatactcagactcaatcatctttttaaaattttgttcctcttccttcctcatatagacatgatagacttcaggttaaacatgatagattaacaacacacacacacgtcataatagatagatatctatatctatatatagatatatatatcttacactgaccacaatgtattctttccatctctaaccccaatataaagacaaggaaggctgggcgcagtggctcacgcctgcaatcccagcactttgggaggccaaagtgggtggatcacgaggtcaggagatcgagaccatactggccagcatggtgaaaccccatctctactaaaaatacaaaaattagctgggcgtggtggggagcacccataatcccagctactcggaaggctaaggcaggagaatcgcttgaacctgggaggtggaggttgcagtgagcagagattacgccactgcactccagcctggcaacagagctagactctgtctcaaaaaaacaaacaaacaaaaaaagacgaggaaatgtaaagtacagaagaaaaggaataaacccaaaggagaaatagaatttgagtcaacatcagccaagacatcaacacaattttagaacataaaatgcagacgaagaaatgttcatcaatgaattggctgggcgcggtggttcacgcctgtaatcccagcactttgggaggccgaggcaggcggatcacgaggtcaggagatcgagaccatcctggctaacacggtgaaaccccgtctctactaaaaatacaaaaaattagccgggcttggtggcgggcgcctgtagtcccagctactcgggaggctgaggcaggagaatggcgtgaacccgggaggtggagcttgcagtgagccgagatggcgccaccgcactccagcctgggcgacagagggagactccatcttaaaaaaaaaaaaaaaaaaaagaaatgttcatcaataaggaaaaactaaggaagctatagcctctgtcaaacagaggaggagaccaggacattggaaaagggccaatgggatttgctgatgcttgggtaagagttgtggggaaaaaaggagtcatggacgaaagacaccaaaaattttagactaagcaactggaagaatggaattaccaaaatatatagagagaatctatggaaaggctggattccagaagtgaggagtgtgcgttagctcgggatgtgatgaatttgattagtcaattagacatccaagtaaagatagtaagtaggaaattggacatgaagcctactaccatttggaaatctgagctagggatatatatttgaaagtagtcatcttagagatgcttaaatagcatctctattaagctatttaagattcagtgaaattgtccgggctcacgtctgtaatcccagcactttgggaggccaaggcaggtggatcatggggtcagcagttcgagaccagcctgaccaacatggtgaaaccccgtctctactaaaaataaaaaaattagccaggcatgatgacgggcccctgtaatgtcagctacctgggagactaaggcaggagaattgcttgaacccgggaggcggaggttgcagtgagccgagatcgcgtcactgaactctagcctgggtaacaagaacgaaacttcatctcaaaaaaaaaaaaaaaaagattcaatgaaatcaagatttatcaagaacctgactacttctcaccactgctctacctgtcccccagctcaccatcatctctccctaattattgcaagtccctttgcacgtctctccacctctgcttttactctcttggtttttttttttttttttttttttttgagacggagtctcgctctgtcgcccaggctggagtgcagtggcgccatctcggctcactgcaagctccgcctccaaagttcatgccattctcctgcctcagtcacctgagtagctgggactacaggcacctgccaccacacccgattttttagtagagacggggtttcaccgtgttagccaggatggtctcgatctcctgacctcgtgatccgcccgcctcggcctcccaaagtgctgggattacaggcatgagccaccacgaccagcctgcttttactatcttaatgtctattttcatttggcagctagcgtgtttctatgaaaatggaagttaaatcatgtcagccttctgttcgaaaccttccagtggttttgaagcttgtatttcattgaaggctgccaccctaaatgactgaccgccttcttctgatctcatcacctacagcccccgtttccttacacagctccagccacatacacggcagcctccaggcctttcctctgcctagaatattcctccccaagaaaactgcatggcccaatcccccacctccttcagtgccaccttctgaataacaaggttctgatcactttatttacaagctcactccattgcttcctttctcacttaaaaaaaatttttttaaacacttcccaggtaacatactatatattaaacttattttgtttatatccactagaatgcaagttccacgaaagcagagctggttttttttgttttccattggtgagcccctagcaccttgcatagtccctggcaaacagtgggatctcagtatttgctgaacacatggtacttggaactgaaaaagaagggggatcggttgaaaaatccttacctagccaggcaattctcctccactatcttccctaagtaggcatttatttcctttaaaaattgagggagagaaaagacccagaatcggggataccttgcacagaataggattaagtatgaagatacaggctgaaattagaagtgaaatatgcctaacaggtggtgaaccctcaaatctgaatagctattctcaaattgctctttaaagggttttagaatttatgtggcaaccagaagtacaagagatgctcattctcctatgtcattgttataaacggtgtcgttaatctttttgatcattgcaaatagcattgcaaatgccattttactcaccatataatttgtatttctcttaccacgaacaaagttcaaattctttcaatgtatttaaaatatatttactttcttttctgcaaactcttatttgatcgttttttaaaattaaatttctagtcttttccttactgactttttttatttttattttttttgagatggagtcttgctctgtggcctaggctggagtccagtagtgtgatctcggctcactgcaacctctgcctcccagttcaagcgattctcctgcctcagcctcccgagtagctgggattacaggctcgtgcaaccacacccagctaatttttgtatttttagtagagatggggtttcaccatgttggccaggctggtctcaaactcctgacctcaagtgatccgccctcctcagcttcccaaagtgctgggattacaggcgtgagccaccacacccagcttcttactgactttaaagagctttttatacattaagatattagcacttttccttcctatagatttcacatttttcctgctttgtgatttgtcttttgactttgtttatgatacactattttctaacaacattactggtaatttccccccaagaatcaagataagcactcactgacctgaatcatcgccattctttcttgctcatcagtcaatatgcttttagctgcttcaagtttctccctcgatgtgttcaatatttcctggaataacttctatagagaaagcacagaattccaggtgagatcattgatttagaacagttggattcctgaccttaaacagccaacaactctgagtatatattttcttagcctttaggttgaaggttcaacgaacttatctaatattctgtaataaacatcaactaaggtaatggttttggaggaccagaatgtctgtccatttcatccatataggagttggccagagtgttttgggatttgcgtgagtgactcttaccctgtaattctcagcagcctcttgtatcccacacaccatgtgatgtttgtgctcctgggactggaagcatttgctgcagagtgtgatttggtcaacatcacagaacagccgtgttggttccaggtgtgtttcacaataggcatcttctgtgatgttgtgctgtaactgagggctgagccttttggacatcctggtaggggtccctagttgaagactggactgtatgcttctactgaggtatctccctgcactgtgaatgagaaaaaatggtggcttcctttgttttctggagcaggcacacacacttggcaacttcagagtccacgaagatccaaggaaataagtccacgcagacagagcgggtcggcgctctggactcctcaaatccaacaaatttctggcagctgcctgcttggggaaaagacagagttaggccagtgttctaagaccagcgggtttccctcaggtcttctgacaatcttgagcaataggctgaaaattaattacaaggaacagcactcacttacgagtcattcaggggaaaacagtgctctaaaggcatcgcgctaattactgaaggaacttcaggactagagtgaggtaacagagtgcgaaagaggttcgttgatagaattacagaaaaaaaccacaagtatctgaaaaagttattaaaatactttccctttgagagacagggtcttgctctgttgcccagtctagagtacagtggcgtgaccacggctcactgcagcctctggaactcccaggctccagcgatcctcccacctcagcttccggagtagctgggactacagctgggacaaaacacatgcaacagaaggaatggggaagcaaataagggaaaacagctcctctttttttttttttgagacggagtctcgctctgtcacccaggctggagtgcggtggcgcgatctcggctccctgcaagctccgcctcccgggttcccgccattctcctgcctcagcctcccgagtagctgggacttcaggcgcccgccacctcgcccggctaattttttgtatttttgtagtagagacggggtttcaccgtgttagccaggatggtctcgatctcctgacctcgtgatccacccgcctcggcctcccaaagtgctgggattccaggcgtgagccaccgcgcccggccgaaaacggctcttctaagaagccatcaattaaagagatttgcaaaacagtgaagccaaagccactcttctcaataattgtttccgaaataaaatttcaggagtgacgtgacgcgctgcccgcggtctggccgtgagcgccctcgctccttcctctttgactccatcttcgcgggggcggcagccggaaccgcggttcagtcaccaacatgcagttcttggtccgcgccccggagctacacgccctccaggtgaccggccaggagacggtctcccaggtcgcggctcaggcagcgccactggagggcttcgccccggaagatctatcgtgctcctggcaggcgcgtccctgcagggcgaggccaccctggaccagggcgaagtgggaggccccgactgcccgggaggccaagtccgtggttccccggcccgcgctgggaaagtgacaggtcagactcttgctaaggtggccaagcgagaagacaggccgggctgagccgcgggtgcggtaccaccggcgctttgtcgacgttgtgcccatctttggcaagaagaagggccccaatgtccttcttaagtcctttgtaattctggctttctctattaaaaaagccacttagctcgaaaacttttttctcagaaaaatgtttttgtttttattattttattaacttatttatttatttttgagaccgaatctctgtcgcccaggctggagcacagtggcacgatctcagctcactgcaacctccgcctcccgggttcaaccgactctcctgcctcagcctcccgagtagctgggactacaggcgcgtgaaaccacacccagctaattttttgtatttttagtagagacggggtttcaccgtgttggccacactgatctggaactcctgacctcaggttatctgcccgcctcagcctcagtgctgggattacaggtgtgacccaccgtgcctggcttgtttttattattttaaatgaataactataaaatgcagttttaaatttctaatacagtaaacatagatattaacgctcataaacaaaagcttattgggatcttcgtcaataatgagtgcaaaggagtactgattccaaaaagttgagaatcttggcctgaaaaggcatattccccacaaataggactgtgaatgaatgcatccataattttgatatgttttgtcagtttcccaagcacaaaagttgtacaattttgcactccaagcaacaaattaaaaagatgttaaacttttggatcattgcccactggctgggtgagaaatagtgtattcatatattttcaacttccatctgttatattattaatatgtctaagccttttattttcatatgctaaaaaaccattttcacttcttttgctgtgaagtctatgttcaagcctctctctcagtttattccatcaggtttggcctttttggagggaggggtcaattttaagagagagctatagatccaagttcctgtaaattgtgtgagttgcaaatactttctccctccttccttgtttttgatgctctcatcctttcttctgcttaggtctttgaaatccctgctggtttcccgtgtcttaggtccctgaacatgtccgagatgactccactgagtcaccaaaacaaagaaattcaccaactcaaatttttccttgagctctcagcagcagttaacatagctgaccacacccttcttcctagaatgttttcttctctcatctgtctgcagctgacattcctctaacttgtctggtcttgttctccgtggccttttctggtcccacatcctctgaacctctcaatcttggggtgcttcaaggttgagttctggtctcccagtcctggtctctccctaggtaatcttactcgtttctgaagatttaagttccattctccgatttcaatctcctgcccaattcccaacatttttgcaatagaatgtctaaggagcactcaaaattaacatatctaaagccgctcaggatctcaacccagtggctctcttcccccaaactcattcctttagagccacagtttaagccttcctttcaccaattcaactattgttttccaaatttatattctgtcctgccctcctcgtccatctccagctcctctctgctcaaccaccagaatactattttaaaaccaaaaccaagtgagcaggtttgtggtcactttctatggcattagagtaagatcgaagtgggtaataaccccgtcctatacaatctggcctcctgccttcttctgatctctctatagctttcccccatcactgtcaatctagctgcctctaattcatcacagcccttcccccttccgtggccaacagagctcttctctcatatttttgcaattccagctgcctcttctttcttctcttcagttctcagctcaaatgtcttcccaagagagacctttccatcactactcaatttgaaataccttcccactactcatctccttattttattttcttagtagcgaaaagattttatctttctatgaacaagtttacttgtgggtcactctccatccataagaaactaagtccttgagatgccctgtgtctacatctgacatactcgatgcacaataaatattgtaaacgatattttatgttaaaccagtaaaaattgaaggtgtaatgagagagggacagagactaaatatttttacagaaacagcaaaggaaaattgacgaattaagtccccagcatgttgtctacccttattttgtttttcctaatatttttcttcaggctttttcctgataacacacagatacacacacacacacatagattctaagatcaagtttagaaatctaaagaaacaattattaagaaaatgatctatagagaaaatctcacttactttctttgtagcaatcctgggtatttccttttttttttttttttttttttttgagacagggtcttgctctgtcacccaggctggaatgcagtggcgcaatctcggctcactacagcctcgagctcccaggctcaagtgattctcccaccttgacctcctgagtagctgggattacaggcgctgcacgaccacacccggctaatttttgtattttttgtagagacggggtttcagtatttttcccaggctggtcttgaactcctgggctcaagcaatctgcctgcttcagcctcccaaagtactgggattacaggaatgagtcaccacaccgaaccaaggtatttcctttagggaaaaagctggaacagtggagactgaagagattttatctgttcaattcctccctcagccccgccctcacaccatcaggaaggcgtctgtgaagtttcttatcatattcacacaattaatctcattagaaccacctgagtttattaaaacgcaagcctcttcacagggtctctgattccagaaatctacggtggggtccgtaatttacatttttaatggactcccagaaaatgcttaatagccctgaccttggttggataaatatcttgttttatctccagtgccatgtacagtgcctaacacctctagctccttaaggtttggggttttctttcttaatgaatctagtgtatattgacaatttcacaggaaagaagccttcgagctaacactcaagactgtgtttgttccttagtagaaaataatgcctgacttgttagtttctagaacgtttgctggagaagtgttcattccagtatctgtggaaagaaaaaccaagagtagggataactgcctatggaatctgtcacagatgggaggtcagggaacaatcccagataattcatacttgatatttggcttcagtgaggaggaactcttcacagctttctaagttttatagttttgtccccgagggtttttattgcatcagtcagtcaatcccctgctaatcaaaccagggagtttttttctttatgctgctgacaggataatgagaattcttctgctttgcttatctgatctttcagaacctggttctaccttatggaatctcaatacaccgtttctctttttcttttttctttctttttttttttttttagatgagagtctcactctgttgcctaggctggagtgcggtggagcgatctcggctcactgcagcctccgcctcccaggttcaagcaattttcccacttcagcctcccgagtagctgggattataggcgcccaccacacccagctaatttttgtatttttagtggagatggggtttcaccatgttggccaggctggtctcaaactcctgacctcaggtgacccaccctccttggcctccaaaagttctggccaccgcgcctggccatacaccctttctcttatctcagatgattacctacacccactctcttttccaaaacccaattccccagctttcttcaaatagaccacatttattcctgtgccccctcccctcctcagccagtccatcctcctttacttctcttatttttctaatccaatcttcctttctcttctaagcctgggtacggccaacgtctgtgaagatactcacacatacttgttgtcagatactctgtcatttactctcaccatcccttgagctttcataactcttgagcttactcatcttgacaagaaaactttgtaatctttgaatcaaatggaaaataaacatcaagcatattgtcaggttttgaagtctcttaaagcctgttttagagtattaaatgcttaaataaatacttattaaagcctgttttactattaaataaatatttattaataattaaattattaattctagaagagtcaatattttaagataattctaaaaacattacaaaaaagtgtgctaaacccttatttactgttacatgccccacctgttgcatgctccaaccccgtgaggtacatctgcagctgatgaagtagatgacgtagagattaagtcacgggattaagtaattgaccaagagcactgggtgcagaaaattgaagatatggaatttgaatcgggtgccaaatttcatgatatttccttattataattatttgtccttattaaatattaatcaaatggcttgacaatttacaaaaaagatgcctcaaatttgtatgacaatttatcacgagatgctttcatagggctagagtaatcacattacaaggaacacagatcattttaaggtagttagatttttcataggaaaacttttcattaaaatgaaaatcctgaagaaatgtagttttttttcactgtcaaagaacaaatacaattatgaatgagtgagtcattgttctcctgagtcatttcatgaacttataacagtcgtatcccagccgggcactctggctcatgcctgtatccccagcactttgggtgaccgaggcgggtggatcacttgaggtcaggagttcgagaccagcctggccaacatgggaaacctcatctctactaaaaatacaaaaattagccggaaattgcttgaacccaggaggcggaagctgtagtgagccaagatcgtgccactgcactccagcctgggcaacagagcaagactcggtctcaaaaaaccaggacaaaacaaaaacagtcctgtcccctttgttagccacatcaccttcaccactcgccccaggctggcatactctcggcttctgggtgggatgagtatggctggtgccaaacaaggctgtatttgttactttggaccaaatctgcggcaggagactaccacctcctcccattccagaaaagaacagctggaggcgggggtgtgctggttgtggtcccagtgttatcactcatctggaaggtgtggcttctctctggctccttttctccaaggctgctccattagaagcaggggcttggctctcactggtttacttcccacagctctaagaggtccagaagtcatgttcaactgcttcttccttgcttaagaaagcattaaaacttaagaatcaggccaggcgcagtggctcacgcctgtaatcccagcactttgagaagccgaggcaggcggatcacctgagttccggagttcgagaccagcctgatcaacatggagaaaccccgtctctactaaaaatacaaaattagccgggcgtgggcgcatgcccagctactcaggaggctgaggcaggagaatcacttgaacccaggaggtggaggttgcagtgagccgagatcgcgccactgcactccagcctgggcaacaagagcaaagctctgtctcaaaaaaaaaaaaaaaaaattaagagtcaaacattatgggggccgggcactgtggctcatgcctgtaatcccagcactttgggaggccgaggcagttggatcacaaggtcaagagatcaagaccatcctggccaacatggtgaaaccttgtctctactaaaaatataaaaattagctgggcatggtggcgggcacctgtaatcccagctacttgggaggctgaggcaggagaatcgtttgaacccggtaggcagaggttgcagtgagccgagatcacagccactgcactccagcctgggcgacagagcaagactctgtttcaaaaaaaaaaaaaaaaaagaatcaaacattatggtcgacctcatgatagcacagttacccatttgttgttgtaagtcagtgcatgcttatctgaacccaacatgttcagtttgcttgcactcttttgtaaggaagataatcctcctaacaattccagcagaattaagaggtcaccttcacctcacctattacaacaccgggacaagccctatcggttttcaccagacagaataccctcagcaaaaggaacgggctggtttaactgaaatcagtgaatcctgagcaaataaacttcggatttttgccaaagttcacaggctgaggaaagcatcatgtctcatggatgaagttagactgacgtgggctctgattccagcttggccacacacttgtcatgacctgcagcaagccactgaacgctgagcatcacttgcaccatgagtcaccgtcaccatcttccacaagtctctgagcattaggagaggttcgatgaaatacacgtaggagcgaggagggtggtaatgagaacagaaattgctctctgaatgagtatgcttcctctcctcacccagagtcattcttttcagcaaagtcaagagcacggccctctacataagggagagtgcagccgggaaggtgatggaggtggtagagatgaattattggcatatgggaaataaagagatctttgatgcccttttcagtttcttttgtttaataatatatatattagtaatgtagtaattgcgtaattgatatcaaggcatatattcagcttttattaatgtaatgtttatctgaaaacttttaggccactggtataatttttttttttttgatactgagtcttgctctgtcactcaggttggagtgcagtggcacgatctcagctcactgcaacctccgcctcctgggttcaagtgattctcccacctcagcctcccgagtagctgagactacaggtgtgtgccaccatgcccagctaatttttgtatttttaatagagacagggtttcaccatattggctaggattgtctcgatctcctgacctcgtgatcgacccaccttgtcctcccaaggtgctgggattacaggtgtgagccaccgtgcccggccactggtataaatttttaggaagaatttttttctgttccattatagtcagtttcaacaataaagcctcattgtcaagatattaaaatcgctgggcatggtggcgcccacctgtagttccagctacttgggaggctaaggtgggaggatctcaagccagagaggtcgaggctgcagtgagctatgattgtgcccctgcactccagcctgggtgacagagtgataccctgtccctaaaataaataagtaataaaaatgtaacaagatactaaaatctacatgctgctcactatcattggaggatatgcatctttacaccctcctgaaagaaggagtcaaaaagcctcctccacactttaaagttatgtgataatctggatacccttcaggacctggacctgtttaaaaagactggcatcaaatgttgtaagggattggatctcagagaaaaaagcagctttataaataaacttgaccagaagttattatgccggcaatattcgttcaaacagaaaatctggccaggcatggtggctcatacctgtaattccagcactttgggaggccaaggtgggcagatcgcctgaggtcaggagatcaagaccagcctggccaacatggtgaaagcctgtctctactaaaaatacaaaaaattagccgggtgtggtggcaggcacctgtagtcccagctactcaggaggctgaggcaggagaatggtgagaacctgggaggcagaggttgcagtgacccaagatcgagccactgcactccagcctaggggatagaacaagattctgcctccaaaaaagagaaaagcaaagaaaagaaaattttatgtcgtcaaaatatttttacaaaaccaggtgttagtcttgcagaacttaatgcagttgagttaatttattcaacctactcaatttagtacacagtagggttgtactactgtgaacatagtttcatagtctgattggaatgaatgaagaaagatggctgagagacaaaataaatcaataaatcagtactatccatcttctctcaaaatataatgcaggaaatccttctccaaatccaccttcaatagtagccctagtagtgatgtaaacaagagtatttcctcagcatactcagtccctttactaaactttacactacgtttcctggctgcgacggcttagcatggatccgttgatcagtattgtcggtgcaatcctggagagacactgcttttttgcttctcttgttaaagtggttaaagtgaatgttaagtagaaaaagggcgtggtttgctagggtgaaagcagcacagagatagaaaacatcagggccaccctgagtaatgcacatttaaatttaaccaggtaggatataaactatggattgcttcttagtcataaagtaccttatataaagaaaatggaggccaggcgcggtggctcatgcctgtaatcccagcactttgggaggccgaggtgggcagattgcctgagctcaggagtttgagaccagcctggccaacatagtgaaaccctgtctctactaaaaatacaaaaaattagctgggcgtggtggcgggtgcctgtaatcccagctactcgggagactgaggcaggagaatcacttgaacccgggaggcagaggttgcagtgagctgagatcgctccactccactccagcctgggcgacagagtgagactccatctcaaaaataaataaattaataaattaaaaaaaaaaaaagaaagaaaatggaaacagccaggcacggtggctcacgcctgaaatcccagcattttgggaggctgaggagggcggatcacctgaggcagggagttcaagaccagcctgaccaatatggagaaatcctggctctactaaaagcacaaaatttgctgggcttggtggtgcatgcctgtaatcccagctactcgggaggctgagacaggagaatcgcttcaacctgggaggtggaggttgcagtgagctgagatcgtgtcattgcactccagcctgggcaataagacaaaactctgtctcaaaaaaaaaaaaaaaaaaaaaaaagagaagaaaagaaaaaaagaaaatggatacaaacatgaagttatagaaaagtagtggagatcatgtagtaaagtaaaaagatcttatggatataactctttgggaaaagttataaacacaaatattttagtaaacattgtaagactaaactagctaatgcaaaagactgttttctaagattcggaagtttacacgggatacatctacctaggcctagtgtgctttctcaggttttgtttctttaaaaacttaataattctcttggtattatattctcaaaaaaattgtctgcaaatgattttagctgagcatccctcttgcaggtagaagaaggataaatctgacagaaacatccatgggctgtatgtagtaatcacagttcgtgtgtgtgcatgtgaataaaatatgtttctttcacattattaaatcgttttttcttttgaaatgaagtcttgctcttgtcccccaggctggagtgcaatggcgtgccctcggctcactgcaacctctgcctcccaggttcaagcgattctcctgcctcagcctcctgagtagctgggactacaggcgcccgccaccacgcccgctaattttttgtatttttagtagagacggggtttcaccatgttggccaggctggtctcgatctcctgacctcatgatccgcccacctcggcctcctaaggtgctgggattataggcgtgagccaccgcgcccggcccacattattaaatcttaatatttatatcatttccactagtgtagatgctaacttaaatgcttggtcttgatctctgatcattaccaagtcaatatatctaatacttaaaattaatgtttttccctctgttgctgaggctggagagcagtggcaccaacacggctgactgcggctttgacatcctgggttcaagcaatcctctcaccggagcctcctaagtagagacacacgccattgcacctggctattttttcacaaagttttttgtagagacagagtctggctttgtttctcaggctggtcgcaaactcctggcctcaagtaatcctccccgccaaagtactgggatcacaggcgtgagccacggcgctggccctgttagaacatagagctagctttgtcaatgctttttcatcagtagtaggtagaatgtagggactggttaaatgttacggtgattacaatcttgaaagaaagtaagtggtatcattactgccaaataacttcttctttagcctgtaactatttcagtgcgcattatgattgtaactagaaacaatggaggcaggagccaggcctacattttatctattattctatctgcttagtgcaaaagtccctgactcctaatccaggatttttttttctcagagggttaaaaatagttttctttttaaagatttgtggactgggcagacaattaatggtacagaatccccacgcatattgtgggaatgaaaaaaaagaagacaggatgcagagttctaatggcacaattggcaaacagagtaggaggcagtctctaatagcatcataaacgaaaacagcccccaaatacctaggaagagctcttccttgtctgtaacaagctttgtttgaggaactaatagtaaagaatgtggttacagaaaatacagtggtgtctgccaagcacctcggcaaatacaaatccacactggagaaagagacgactttgtcttccgagatacctgcctgactcctactgctcagccacgcttctctcccacacgcacccccagtaatgactccagaggtcaagttctgagttctcacgatggcaggagaatcagcctgtcaagacggtcacctcgattaaccacacactgcaaatctgaggactccgtgagggaagggctctgttcctatccagggtttaggcactgggattagagttctccagaaagacacaatcagtaggataggtagagagatgcatgagaggaggtgtattaggggaactggcttatgctattaggaggctgataagtcccaggatgcgacacaccctggtgtgtcagctggagggtgtgtctccagccggagaccagccacgtgtgaaggccttagagccagggaggccgatggtggggctcgtggccagggctgaagccctgcaaaccccggctgctgctggtgtaagtcctggggcccaaaggcctgggaaccccgagttctggtgaacaaggacaggagaggaagagggcctgcatcccaccacagaagatggacacacagattcagtgcccacccgattgagggtagatcttccccatcccctccagtgtgactctcaccctcatcttttccagaaacactttcacagacacaccccaaataatgctttcccaggtttctaggcattccttaattcagccaagttgacacctaaaatcagtcgtcacaatgcgggggaaaaaagcatagcccccaccacagcaatgtatagacatgtcattatgttctcgccaacaggttctaccacaaagtttttgtgccactttgtagagtcctttttttcttttttcttttttttaagacagcgtccaggctggagtgcagtggcatgatcttggctgactgcaacctccacctcccaggttcaagcggttctcctgcctcagcctcccaagtagttgggctaaaggcgcctgccaccatgcccggctaattttttgtatttttagtagagacagggtttcaccatgttgggcaggctggtctcaaactcctgacctcagggatccacttgccttagcctcccagagtgctgggtttactacaggcgtgagccaccacgcctggtcactctgtagagtctcaaagagagagggtgtacccttctcctcttgagcctggcttcaatgtaaacataatgatagaaactgggtcatcagatatcctgtaggacggaggctgtatgtgtcgaagaaacgagagtcgaggtccctgaattcattctgcctactgggtattaaatgaggaaaataaacttccacccgttttaagccactgttactttgctttttactgtcacacatagctgaagctagtacattggatacattgactgtcctaaagttaagatctggaagatctaacatggacagctgagcatgggatttatttgagtttgggataactcatgggatcattctgagttttttggcagtgatggcgaggggaggtggcttaggaacaggagataaagctatggaaaaagcagtgttaatcgtggaggaggactcagactgtctctgccttctagactatgtggctttaataatgaagagctgcaacataaaacctgcgaaccaaaagcattttcttgaaactgatagttcctgaaaagagagaggatagaaggaaaccgctatttctatctaagtcctgtgtcccatggacagtttcatttgattttaatcctgtatgggtaagccttggtcttttcccttgactgctccaagcttggaggtgcagtacagtgatagaacagccgtgaatccaggccagctcgcctgcgccactgctgacttcgcctgaaaattctctcatccattcttaccatcttgctgcatgctcaggccttctcaaaaccaccttggggacgttcttcatcttggaatggtgcctgtgaacaaagatggagttattctgtttaggtaatgctaagaaaaaaatttgttttccttactcccttccctcactggatacctgcagtaagtaggccatcccttagacacaggcagatagagaagaggcactgtggtgggcagaaatatgagaatgcccccaggattctcacccactagtacacatacactttctcccagtttttcaaacacatactaatctgggtgctggccaggagcggtggctcatgtctgtaatcccagcactttgggaggccgaggcgggcggatcacaaggtcaagagatcaagaccaccctggccaacatggtgaaaccccgtctctactaacctccaaaaattagccaggcatagtggcgtgcacctataatcccaggtactcaggaggctgaggcaggagaatcgcttgaacctggaaggaggtggaggttgcagtgagccgaaatcacaccactgcactccagcctgggcaacagagtgacagagtgagactatctctcaaaaaaaaaaaaaaaaaaaaaaaatctggttgttgatgtgagggattttgcagatgtaattaaggccaaatcaattgaccttaaggtagggagactgccctggataggcctgacctactcctgtgagcccccaacaaagactgggtttttgtggtgaggaagacacaatgtgagggattggtggcttgggagaaggattctggagagacacacggcggggatctgacagtggcggacagtggcctctgacagcaactctcattgacagtcagcaagaaaatggggtcttcatccactcctgtaactttaaggaactgagttctgtcaacgatgtaaatgaacttggaagaagaccccaaacttaaaagaatacatgctgtccaacctctgagaccctgagcagagatcccagtcatgggatgctggatttctggcctgcagaactgtgagctcgtacatgggtgttgttttcagatgctaagtttgtggtcacccgttacaatgcaatagacaactgacgcagacactccactgaactgctcagtgactaaggagataaagaaagaggattagaagtggattcttcaagcaacgcctacatcttatgttgggttcaggaaacaaatcaagccgggcgtggtggctcacacttgtaatcccagcactttgggaggctgaggtgggtggatcacctgaggtcaggagttcgagaccagcctggtcaacatggtgaaaccctgtctctactaaaaatacaaaaattagctgggcatggtggcacatgcctgtaatctcagctattcgggagactgaggcaggagaattgcttgaacctgggaggtggaggttgcggtgagccaagatagcaccactgcactccatcctgggcgacagagtgagactgtatctaaaaaaaaaagaaaacaaatcaagaattctgttctaactcaaaattattttattagaccaaaatgatagcctcaacacaaacctagaatagctttgacacagaacttaacctagaaagaaaatatactcggtgaggattttttcatgagaaagtagtaaattttacccttcccctacaagggtgaaaccctctccctgaaccaaagttctttagaagatacaaagtatttgttttccaaaaattcaccctacttgtcactatacctgttcacacaagacaatgaactaaatgtcttcacatgttcagtgaaatgagcacaaattgctaccagtttcagtagttttacattttattttaagaattttcttattttaagaaaacgtggaatgcttcacgaatttgggtgtcatcctcgcacaggggccttgctaatctctgtatagttccaattttagtttatgtgctgctgaagcgatcatggtttccgtttttttctgaccagattctgcataagagaagcctcctgcaggtattgacagattcttgcattttctttgtttttctccacttcctactcattcacgagaggtttcacgtttgactactggtagttaactgtgtaatccacgtggttgaagttcgttccacgaagttagtggcgtacccgctctcagtcttacagaggctaacaacaggtagtcacagattgttacctgtggctttccactttaaggagataaatccttcttcaaaggaaatccgacacacagcacacacacacgtagttgaaattctcatccagccctttgtttatccagcatctgtttgttgctactctccatatatatgcacagaactgttagaatgcaatttgtggagaaaaataaaatacccacacacacacacacacacacagtcccctcctcttgggccagttattctagactgcaggttgctatgtcagttgaattaaccatgaccagtactaaaaaaaaatacgatatttgggccgggagtggtggcttacacctgtaatctcagcactttgggatgctgaggcgggcaggtcatttgaggtcaggagttcgaaaccagcctggccaacatggtgaaaccctgtctctactaaaaaatattaaaaaattagtcgggcatggtggcacgccccgtaatcccagctactcgggaggctgaagcaggagaatccttggagtgggaggtggaggttgcagtgagccgagattgcaccactgcactcagccaaggcaacagagtgagactccatctcaaaaaaaaagattcagggcactttttctgcagcaaagataaaagtgtttcatcagttgcatgtcccatgtcgtgtaaaactgtgtttcttccagtgggtcgtggtcaatagtatgaaaagcactgacataagggagttacagtctaaggcaagagacaaatggcaacactaaggcattgaaggagagataggaagaactatgagctcttgtatcagagggggaacttaattaaccaaggagacttggaaatgcttcccggaggaagctcaagctgagaagcaataagtggggtagatgccctttaccctgaggtatcttccattaatcctcgcagctcacttctaaaagtagtcatcgttgggcaaatagatgaacgaaagcttgctttcttcttcaaaatgattggtggtttaaaaggaaaactattaccgagtacaaaacaaataaattttttgtttcttctttttttttctttttcctttcttttaatttttttctttgtttcttcttatcatctagaagtgcctttggtctggtcctttcaaaatcttgagggttttgcaaaggttagcattttacatggaggttcccatggctctgtagcagatcttatatcataagtgaatttatataaaggttaggggagccacaagggcagtatttttatacgtagactatctggaaggtttgtatttataaagccaaaccccaaaataggttttcttaaacttttaagtttgtttagagttgttatataattctagtaaattttaccactcaaagacccttatgcttggtctcgtttacaaagctagaccattttatatagtgaggatatagttatcaatgaacgtagtcaatatttttaaatagtttaattgtctgacttgaaaaatatccttcctcagcaagaaattcttttttttttttttaatttgagatggagttttgctcttgttgcccaggctggagtgcagtgacgtgatctcagctcactgcaacctctgcctcctgggttcaagcgattctcctgcctcagcctcctgaggagctgggattacaggcacacgccaccatgccgagctaatttatgtatttttagtagacacagggtttcaccatgttggccaggctggtctcaaactcctgacctcaggtgacccacccgcctcagcctcccaaagtgctgggattacagacatgagccaccgcacccggcccaaaattcttatatgataaatcaaacttataaaaatagtgaacctgatattctgaaacatcacaatgctttgtatatatttaaacctcaacttagaatcacaaatctaaatcaatgactcaattatatgttttacattggagttacttggttatttccatagctgagttctcctaaatatcacaagcaaaactaaatagatttttacatatccaaaagtacgaagactctggttatggtacttctttcagttaaaaggcactagccttctagggaatcactgtcattgggttggacatttcagctgggcgtgaactctaaggcagcagatacccagggtgcttctcctcagcacccaccacggaactgacctcccaccacatgatgctgatgcttcccttcctatgtgattttttggtatttcttttgcagcctgcttgaagtgacataatgaccagatacgtttgtgaggatgctgactgggatttggtcagaggccccggtaggcccactgaattcttaccgtacatcagtgacctcataacctttcaagctttctattcatgaagctcaaaacacccctctcagtaacatacacacatcacttgatagattttgcattttcttggctcttaatatactcaaatgcctttttcatttaaatctagagtttgatctggatgaaataatgcatttttccatatataggcatttctgctacgtgcaatgtattttcctaacaaacaaacaaaaagacaccccactctgccagataatgtattaaaataatagtgcttccgtaagagttagagtggaacactcaatccctatacaactcaaaccagatgcttacaaaatgttaacagcccttaaaaaaaggccacatatagagtcgaggacacataaacttctaacaacgacaaaaacaaaaatacagggtaactattgaatctgctttttttggaagtgaaagttatttgataagaaatttgggaaagggttgaggctgccgagttagggtggccaggacaagaggcacataggaacagcaaaatcagcatctctatgacagagtatctggtcaaactgagccaagaagagtgtggtgtggatggctgtcgtgatctcatcatagcagagagatcaccccactgagggcttgctgccttggctgcgttagtgttctctgccttcgactgctcttacttacaaccaaacttcagtgtgccagggaaaggacatgtttgaatcaacatgattttcttgtcatactaaaacaagtcctttactttgcattatagaaacatgttatttttagccctacagttgatttctaatcctcgtaggacaattcccaaggatgtttaagatctatttgaactttgagtttcacctgccttctataatcatgacagtggagactccccattctacatattctttctggacagttacctgtgatctagtcttcagctaccttctgtatgccagaacttcatctctagtttaggtccctctgttcgtcttcaggctcataaggatgtacatattgatcactggagctctctatccagatattgtgcaggacacctcaaagtcaaggtgtccaagatgaaacatgtacatatatatacaccattctctccccgtgtcaaaggcaaccacatccactcagtttttcaggaatgccagtattgtctaggaaagactatctgcgtcatatttctatagttaattactaagttttagctatctaagactttttttttttttgagatagagtctcactctgtcgcccacgctggagtgcaatggcatgatctcggctcactgcaacctctgcttcctgggttcaagcgattctcctgcctcagcctcctgagtagctgggactacaggtgtgtgccaccacgcctggctcatttttgtatttttagtagagacagggtttcaacatattgcccaggatggtcttgatctcctgaccttgtgattcgcctgcctcagcctcccaaagtgctgggattacaggtgtcagccaccgtgccctgcatgtctaagactttatacaacattaaagtccacttatctctatcccactgccactaccccagcccagcttctagctgagaactgcaaccaaatatcaagttttgtgacagtgtaaactattttgatcccaacctgaagccagtcaaaataaataaataaataaataaaaaataatctttctctgccaatctcttgtttaccactttggtggatatatatttactttggaattaagtacacattttttagatgtgcaaggccctgcctattttctcccaaataacttttgctgatgaggagcttgacttactcctccttccagtcctttctacgtaataatggtgccctctgagccttcttgttccttcaaaccctattaggatggaagaagtgacgcttgagtagaatccttaactatttctttgaaactgtttctggctttggtgctttgtgtactcactacagccattttaccatagtttctagatcatgactgtccagtgacttttctgactcttccatgaggatagtttccttgaggcaagaactcgctatattttctggcctttatatagtttgggtgctcacatttggccaaattggtgtttacactgtggtgaggagaagctgcagcctgtgaccctggactcactgaagactcctcgttaatcaagcggccatccttattcggaagagccccaagcatactcacctgttcatttttctctgccgaggcagttgtccgcttgtgagaccattgccttgtgtagagaattccggatttcttgggcctcattctgaaaaggataacgattatcctctcttggaggttgctatgctagagctataaagtcaaaagtaagcataaatttaggcgtgaattagaatgtggaaattagcattactgtcagtcaaaacggggcttttggggctcctgagtctccgttgttgacaggtcagggatagaaaatgaatgagctagtaggaattgttttgaagaccccacgtcttcaaagacggaaagaatgatcaagaatgaacccctgaaattttctttttttcttttttctttttttttgagacagagtttcattcttgttgcccaggctggagtgcagtggcacaatctcagctcactacaacctctgcctaccggattcaagcgattctcctgcctcagcctcccgagtagctgggattacaggcatgtgccaccacgccaggctaattttgtatttttagtagagacggggtttctccatgttggtcaggctggtctcgaactcccaacttcaggtgatctgcccacctcggcctcccaaagtgctgggactatgggcgtaagccactgctcccagcctgaaattttcagagtagacaatcttaccttgaagatgacttttgccttcccagtgatgaattttgagagagacttgtgttgctgagacagaacacgagtctcacacaggagcatcaactctgtcaacacaagccttcaggctttttgggtgcatctcacatatgctattcttgaaatccattacatgacatctcagatgctttgccatctcagccatcatcccctactgcacagcaaaccttggagccataaccagatgttcctttccatctccctagaggcactcacagcaaggcctgcgtgcacctgcaattacaagtggtttgatcaaatgatgcgaatggatagaacaagtcagctctttcttgaaatctggtagatccaagctagccttcatactttgcagggaggaagagaaggattaaggagagaaaaatcaataaaaacctctcatcttgacctgatttttttgcagcaacaggaatttgtctttaatgtcagctcacgatcacatgccttcatcttctgagtcacactctgactgagtcacacttgccattcttagcctgtatagaagttgtctgggactttcctccctccaccctacacctccctcagaatgttactgtctacccacactcatctgggaactctcatttggaatgaggggagggaggcacagttttgctaagaggcagaataaaagcatgccccgggtgccagcctccagctgcctgggaacccagtctttgtgaggtggttttatttgtgaaagtcgtgattcttaacttcttaacttcattgcatgttagaatcacctgaaaagtgacaacaattctgattctttttttgttttttttagacggagtctcgctccgctgcccaggctggagtgcagtggcgtgatctcagctcactgcaacttctgcctcccaggttcaagtgattctcctgcctcagcctcccgagtagctgggattacaggcatgtgccaccacacccagctaccttttgtattttttagtgaagactgggtttatccatgttgatcaggctggtctcgaacacctgacctcaggtggtctgcctgcctcgacctcccaaaatgcccagattacaggcgtgagccacggtgcctggccttgctggctccttttgaaagccctgtcataaacttacctagaagtaagcgctctcttctctggccttaccaactgcggctacaagtaatcaatgagcatgggaggagtgtccccaggcagcatctggcaccaattattattggatagttcaggggccaggggaacctcagcccatccactgccagggacggacttgacaggatccttgcccagcaagcctccttttggtcacaaaactcaaggagtctggttgccagccaaactccttgagttctgcatttgtggctcattcagttctgtggaaatggcagcatggctctgtggttgatagcctggactctgaaataaggccacctctgggccgggcgcagtggctcacgcctgtaatcccagcactttgggaggctaaggtgggtggatcacaaggtcaggagtttgagaccagcctgaccaacatggagaaactccgtctctattaaaaacaaaaaaaatcagccaggcgtggtggtgggcacctgtaatcccagctactcaggaggctgaggcaggagaatcgctggaacctgggaggcagaggttacagttagcagaggtcgagccactgcactccagcctgggcaacaaagggagaccccatctcaaaaaaaaaaaaaaaaaaaaaaaaaaaggccacctctgtgaatctaagagaactcacataactagagtttgttttctcatctgtaaatggggcaggaactcatgtccacctcacagggtcacatgttgaaagtgttcagaatggtgtctggcaagaattgggtgccattagaacaactagtctcgtttctttccgttaaagatcctattttttgcaggggggtgagaggtagagtcttatggataaatgttaagatttctgggccgggcgcggtggctcacacttgtaatcccagcgctttgggaggccaagacgggtgaatcacaaggtcaggagttcaagaccagcctggccaagatggtgaaaccccgtctctactaaaaatacaaaaattagccgggcatggtggtgggcacctgtcatcccagctactcgggaggctgaggcagggaattgcttgaatctgggaagaggaagttgcagtgagccgagattgcgccactgcactccagcctgggcgacagagagagagtgcctcaaaaaaaaaaaaaaaaaaaagatttccctaagaaaagcaaaaagtggactttctcattaaggaagtggtgtgcacttatagtcccagctacttgggaagctgaggcaggaggatcacttgagcccaggagttcaaggccagcctgggcagcatagcaagactctgtctctacagaaacaaacaaacaaacaaacaaacaaaaaaaacagatgaggaaacaacgtgtatatacttaagcatctgtttccctataaaatactagtttaatgtgggatgattatttatttcctaatatactgggtgtattacaccacctagaacttaaaaggtttttaataattcctgcagaattaagtgatagaagcaagcacagaacaagtgacctttgatctcaagagtttttctaaattaatctgctattattctttaccaatattaaatcctatacacatggtagtaattcaaattatttatctctaataatctcaaaccccagaatctgcattagaatgagggaagaagttaaactataactccttttttttgagacggtgtctcactcttgtcgcccaggctggagtgcaatggcatgatctcggctcactgcaacctctgccccctgggctcaagtgattctcctgcctcagtctcccaagtagctgggattacagatgcctgccaccatgcccggctaatttttctatttttagtagagatggggtttcaccatgttggccaggctggtcttgaactcctgacctcaggtgatccacccaccttagcctcccaaagtgttgggattacaggcgtgagccaccgcgcctggccttagactataactcctaaatgtcaaccaagtgtttaaattcttatttgtcttatttgtttgaactgcttttcaaagtttcctgcccaggctccccaacttacacaatttctttttgacttctcccccatttttttaaatctctttaagagacaagtacataaagcacccagcagaaagcctgaaacaaggaaattttcttcatttaacatttattaaagcaaggggatgaacaatatagcctttattctccagaaacaaacaaagcacctccccctaaatcctcagggaagctacgcagatggaagctctagagagcacctcccagtgtccaagctgggcaactggttgagagtggctgggttccacacaccaggaaacctgtgcagttacagtgcccggaaccttccccacagatatggccccatgtcttgctgtgtaatgttaaaggcgaatattgtcaagctgaattgtgtctttaaatatttcagagataacaagagtgttgcgatttttgtttgtttgtttgtaatattttgactcaccgtcaatcagattacacattttatttctgaaatattcagtgagttttctcactcctaaatagtagcttatctcttcagttgaaatacgtgttagtccgtaaaggtccagatcgaataccatttctcccggaagttttttctaattgttccagcaagaatgtcatgttcccgccactaaaatgccaaagcagttaattaatttaaattctaccactctcagggcacacgtcttttcatttcgtagatttttcttcttcttttgcacgtatatcttctgctcccaaagaagagaaataatttttagtcactttcagcactgagctcattgctctctatataatagaggcgcaatatctaatcgttaaataaataaaagctgccattgaagttgcaaactattaaaaaattttattatatcacagctgaaaccaatcttcagagacaattttatccttaaagctgaggaaaattgcttcattaattggcttactccaagtcacacctcacatttcttagctcctactctattctccaatatttctttactgaaaaaactgctgacaaattatttagaaggtatatgtgtgtgtgtgtgtctgtgtgtgtatttggagacagggtcttgctctgtcacccagggtggaatgaagtgacaatcatagctcactgcagccttgaattcctgagctcaagagatcctcatacctcagcctcccaagtagctgggactataggcacacatcaccactcctagctaaatatatatatatatatatatatatatttatatttagagacagggtttctctatgttgcccaggctggtctcaaacccttggtttcaaactgttcccccactcttcgttttattttttaattttaatttttttattttttttgagatggagtctcactcttgtcgcccaggctggagtgtaatggcacgattccgcctcctgggttcaagcgattctcctgcctcagactcccaagtagctgggattacagatgctcaccaccacgcctggctaatttaaaaattatttttggtagaggcggggtttctccacgttggccaggctggtttcgaactcctgacctcaagtgatcccccaagtgatccgcccaccttggcctcccaaagtgctaggattatgggtatgagccaccgtgcctggcctccccaactcagtttagcaccttctcacttttccctcccccagtccctggaaaccacccttctactttctgcttctgagtttgactatgtcaggtaacttgtagaaggggaatcatgtggtatttgttctctgtgcttgacttatttcatttagtataatgtcctcaaggtccatccatgctgtagcatatgacaggccttccttttcaagactgacttgaatatgtatagtatattcaagagagtatattcaatatagtgcattcaatatatgtattggtatgtgtagatctcattttctttatccattcattcctcgatggacatttaattgtttcctcatctccgctattttttaaattgttttgagacggggtcttactctgttgcccaggctggattgcagtggcactatcacagctcactgcagccttgacatcttgggctcaaatgatcctcccacctcagctggactaaggaccacaagcatggaccactacgcctggctaatttaaaaagaagtttttttgtagagaagggtctggctatgttgcccaggctgaattcctgctctcaagcaatcctcctaccttgaccttccaaagtgctgggattatggcatgagtcaccatgcctggtccctcatctcatagcaattgcccctattttggatttccaccaacggggttccaatttcttcacatcctccccaacttttgttgtctgttttttgtttgttttctgttttttgataatagccatgtaacaggtgagaggtgctctctttgtgattgtagatttgcatttccctgatgattagtgatattgagcatcttttcatatacctgttagcctttctatgtcttctttggagaaatatctgactctttggtccatattgttatctggctattagtttttttgctattcagttatagaagttccttatatatcttgggaattaaccccttatctgacatgtgatttgcaaacagagtcagccctccaaatctatgggatctgcatctgttgattcaatcaaccgtggatcaaaaatattttttaaaagactcattatggggccagtcatggtgggtcacacctgtaatcctagcactttgggaggcggaggtgggaggatggcttcaggccaggagcctgaggtcagcctgggcaacatacaaagaacatatctctacaaataaaataaaataaataaaaactatacaggcatggtggtgtgcacttgttgtcccagcaactcaaaaggctgaggtgggaggatcactgcagccctgggggcctgaagctacaatgagctatgattgcaccactgcattccagcctgggtgacaaactgagaccctgtctcaaaaaaaaaaaattatgttccttaccttgtttaaaaattgttctttctagcacttataactacttaatatatatctgtttttgatcttatgcttctccttactaaaatataaattccatgatggtagagattttcctttattttttcctaatttctcatttataaagaaaaagctggggtgttcatgttatttgtatttctttcacatgtgtggttctttgatcttctgaaaatgttatataatattttataattttatcactcctgtgcctaaaatctctagcaattcccatcgattacagaaagaatttcaaaacttggcgtaacacagaagcctattgtgattggctctctgctcaccctcacctccagcccgactcccacttcgtcaggttctacagtctgccaaaacctctaagttttctatttttgaagtttttttgtatttagaatgttaactatttggatgccacatgcagagtgtgggggaaaaaagcaagagcattaaaaatactttaatacttaaaaataaataataaatgtgaaagtctgcaaatgtaggcttttttgggtcattctctaaacaacacagtataacatcgatttacatagcatttacattgtattaggtattacatgtaatctagagatgatttataagtatacaggaggatgtgcagggttaatgcaaatattatgtcattttttttccgggactggagtatccctgaattttggtatctgcaggaggtcctggaatgagtctcctgcagacgctgaggggccactgcattttctttcgttccgcagaatatgcatcttcacgctgtcgatcgtttcctctgctgtgcaggagctttttggcttgatgtagttccctttgtctgttgttgctttttttgaccatgcttttagtgtcacagtcatgaaattccatacttcttctgtgctttcatctacacaaatacatatgtcaacatctatagcatgacctcttatttttaggaaaaatacacaaatagtggaatataatttttattatttagacaaactatttttgagggcaaaaatttatttccccttaatgtcatataatggatgtcatatcatgttaatgtatgtaaacagatctgctttttaaaaaatgtctatgtagtaagatgaagggctattattttggcctggtgtgatggctcacgcctatagtttcagcgctttgcgaggccatgacaggtggatcacttgaggtcaggagtttgagaccagcctggccaacgtggtgaaactccatctctgctaaaaatacaaaaattagccaggcatggtggtgcacatctgtaatccccagttactcgggaggctgagacatgataatcgcttgagcctgggagccggaggttgcagtgagctgagatcacgccactgcactccagcctgggcgacagagcaagattccgtctcaaaaaaaaaataatagtaataaaagctattattttaagtatacattcatgtaagactgctccataatttcagagtatatatttgacaactgttgcaaattctctttcctagaaatatataaataaggtgaaaaaagcaataaaaaaggaaacatatgagtagaaattcatacttgggaaaaaatagacacactcccccctgcccacgcacacacacatatatcctgtatttatctacctggaatatacttcggtataagttgctgggtagagatcaactgaatttatttttccagatgactccctgactttccctaaactgtgtgttgagtaacctatcttttccagactggcatgaaatgacagatatacagaggacccttgaacaacctgggtttgaactcctcaacatggacacttatacacggatttttctcaataaaagtgacaccaagaatgcctgcctctcctgctcagccttccacttcctctacctatctggcctctgccacccctgagacagcgagaccagccctcccacccccacctcctcctcctcagcctactcaaagtggtaacgacaagggtgaagacctttatgaggatccgctttcacttagtgaatagattttctcgtaataacattttcttttctctagcttatttgataagaataaaataatacatgtaacaaaaaaatatattaattgactgtttctgttattgataaggcttggtcaacagtagactattagtagttaatgttctaggaaagttaaagtgtatttttgactgtgcaaggggtcagcacctgtaacccctgcattgctcaagggtcaattgtatttttttaatctcgctctgtgcccaggctggagtgcaccggtgatcatgtctcactgctggcttcgtctcctgggttcaagtgattctcgtgcctcagcgccgagtagctgggattacaggcacccgccatcacgcccggctaatttttgtatttttgtagagacagggtttcaccatattggccaggctggtcttgaactcctgacctcaggtgatccacctgccttggcctcccaaagtgctgggattactggggtaagccactgggcctggctaactttatttttaaagctaggctttcaagcaatgtatttttcaaataagctcccaactagtccaccgcctcatcaacaaataagcccttactgtatctataaagttcatttttttctgcatgtgccaaccctgatggcatctgggtgatagttgtgacagtgaccctcttggagtactcctagcatcaccctctcaggagagaaaggccagagaagaagctacttgagttgttgatctcagaagccgtgtctggtagtgtgattgggtcatatattttgggaaggctggtctattctatgaatgcatttcatctatgaattaagcccaagcaaaatgttgagaaagatggtaaggaagtctgccttcccaagagtgaatgtggtcagtgatttcagatgcctgtcacaccatcactccataatgacagctgtctgacttccttctcacagcaattggacaatgttcatttttttttttgagatggagtcttgctctgtctcccaggctggagtgcagtggagcgatctcggctctctgcaagctccgcctcccgggttcacgccattctcctgtcttagtctccctagtagctgggactacaggttcccaccaccacatccggctaattttttgtatttttttagtagagatggggtttcaccgtgttagccaggatggtctagatctccggacctcgtgatccacctgccttggcctcccaaaatgctgggattacaggtgtgagccaccgcgcctggcctgcaatgttcattttattgagataactggaaattttcacccactcacaagtcaacaagtggatgcagtatagtgtgttgacaaaagagaaagactgggaggtaggcgctccagtttcctagtcctaatccggcgtatgtggtaagtgagtatcaggagatgaatttaatttattctagcctcagttttcctcagcatctgtagaaggtagttggactatatgatctcttgacttccagctaaatataagactatgattccataataatatagttcctctattcatttataactcattaacagaaaaatcgagccacgtgcaaagaattcttgtagtcatcaatgaataacacgtggttattgtgttacgatgcctataaaataaaaaaaattatctggaagagggaaacgggatagagcagatcagtgtgacttgaacagagactatgccagcctccctattccaaattggaatactggctctgtgatgtgctataactgtattgtgaggcttattctaatgattttggtaaatgttaaagactcctcctggggttgtgttgaaataacacactgaatggagatggtagttcataaattctttttctagtggtggcagttagtgttattgtagtctttttttttttttttttttttttttgagatgggatctttctctgtctcccaagctggagtgcagtggtgggatcttggctcactgcaacctccacctcttgggttcaagtgattctcctgcctcagcctcccaagtagctgggattacaggcgtgcaacaccacacccagctatttttactttttttttttttttttttgagacagagtttcgcttttgttgcccaggctggagtgcaatggcgtgatctcacctcactgcaacctccacctcctgggttcaagcaattcttctgtctcagcctcctgactagctgggattacaggcatgtgccaccatgcccggctaattttgtatttttagtagagacggagtttctccatgttggccaggctggtctcgaactcccgacctcaagtgatctgcctgcctcagcctcccaaagtgctgggattacaggcatgaaccactgcacccggcctaattttcatatttttagtagagacggagtttcaccatgttggccaggctggtcttaaactcctgacctcaagtgatccacccacctcggcctcccaaactgctgggattacagatgtgagcaaccgcgcctggccaaactttttttctttttttttttaagactcttacaagactaactcatagcaatattctgaagctgtgacaagttagtatcctggaggctatcttggtagaggtttcatgatgccaccctgatgccacctctcttcctctttacagtagtataactctttgctcttattttttcatagcttaaattctcatcctagcaattcacgtatgctttacaagggatgtataggattgaaacattttgaattaatgatttcagaaaggtgagttttgactaggagaaaggaaggtggaggaaaaaacattctcagccagaaaacttctttttcccaaagttcaagataagaaaacatccaacatcctgttggaggtaagtgggaaagaagtagcagttggagccttgaaagtcagaaaccaatgaacggaacagcctgagtaatggacccgactcgtggaaggctgccaagctggagagtgaggggacggagacagaaatatggcgtgatgagttcgtgggaaggtcaaactcgctggcctttgaggaagagcttttgaggtgcaacttcctggcatgcagtgagcagaaggcaggccaggacaggagctgactcccgagcaggggacacagtgaatttgtggcatttgttaccaatctcggagttcactgtgcacagtctccacactaggcatttactttttcatatgtccgaaaaaatgtctgcacacttcatttctgtccagtaagaactgataatcagggatttgaaggggcctagtttggaaattttcaatgggtgaaaataagtgagcaaaattacatttatactaaaatataattctttccatctgctccatagtgggatagcctcttgaggcaacttccaattagaatgtcattttagatgctttccaagatggcagatgggtgagtactagggtgtgcagggaagatcaataaacagctctggcaattcatcgtgcgcctaacaccaaggaatacttcagtggaagagctctcattttgttgggatgaataaaattaaataaaagtacacagtacccaataaaggaacaaaagcttaggctttggtcaagcagaacaaaaggggctaatgagaaaaggactatgtattacagttttcttctctcagttctcaactaggttttattagtggagttcccaaaagatttggaccaaatttccaattcagatattattagagatcatcaaaactcaaatctctttactggtttacaccaaatcacccaagcttccagcctaaaacccacatgctcacatggttccacagtgctgtttatgtacaataaccagttctcaaaatggtaatcctgttagaagccagaatcctcagcctctagcatgtgtgcttttcacagagataagtctcaaagtttggggttggtgaggagcccagtatacaggagttccacattaagtcataattggctttgtgttggacagtgtatgtcagctgg

SEQ ID NO: 689 - DNA, 445396 bp, Homo sapiens
gcaagaattttgaaacattaagtcacaattttccagtctataatcatcgatcaactgcctaattaataaataaccttttaaatggtttggacttcattttggttagaatcacttaggcaaatggcaaatattaatgtgaaattagagctcgcaagtaagtagttatgaataatttgatagattataacagcccttttgtaatattttaaatcactcttattgcagttagcagacaataattgtcagagtatttgcatattactttagttaacacatgggctgttttaaaatgaagtatttttgctcttatccttccactggaattaatgggtgatgtcatgtatttgctttgcttcttaccattgtattgattttatcacctgattgtatactgtacaacataaaattattattatttttgccatcaataagaaatttacttgttttaaaaaaatccaaatgctttttaaaactagtgtaggggaagaaaatatacctaatgatgcctgctcacttggaacctgctttttagaaagcagcacgtagggttgagataagctgctgtgactagaatttgtaatcttactcagctggtattcaaagacagtaaatgtgaaggggctactgaaagcaatgaacttaataaccacataccagagaggacattagctgtgatattacagatgaatgcaggctgctatgtaactttgtgtctttgctttttaaagtgataaatggaagccctgcgaaaatccgtgaggtgagcataagatagccgctgactctagaatgaacagtattaaccccactggtttggcgcatgatgaaatgaaggacagatccattgtgttttcagtaaaggacaggatggtatgtaaattcagtgtcagatcttgatatttaactcaacagctaaaatatttccacaacaacttcagctctcagaaaaaaaatgtaatcctaatatttccttcaattaatctaaattcttctttaagacaaatataatttaaacttgccataaaaatgatgggtacttgtgggaacattcaatcactcctattttaaaattttgtaattttttgtgtcttattatttataatcactttaaaataactataattatttttctcaaggtttgacacattatagctatttttaacatcattcaatctttactgtcaggtaatttttgtaaaattgaataatatacaacatatgagctcaagatattgattagaaaactaaattattataattatggttactcgatttgcaatgagatgttaaatttcttctttggtatttagtgagacttcaaagattctgtgttctgtatatggtatattatagctcacgtgtcttaattttattgataggtttcaatacctctgttttttttgcctgcttgatataccactttctgaaaagggtattttgtaatctccaactacaattgttgatgtcatgatttctccctacaatttaattgttgcttgatacactgtaatcctatagttagttacatatgtgtttgtttgtggtaggcatggtggagaatcagttctattattccctgaaatattttatacatatttaacattcttttttccagcatgacatttttactgtaaaatctttgtcagatactgagatttctactcctgccttcttttggttcatattaccttagtctctctttttccatcctttgagcctcagttatcctgtttttgatatctacctcttccttttcctgaatcagaaaatactttaacatatatttatgtcctatggtctactggtccacacccccaccacagctatatcatattgataatgtcttcattttagttttggattaacttgaatacattttcttttattttgtcctggctttattttttttttagacaacaatttaaaaaataacttctactttccatattactgggtataacctctactttctatatcacttataacatacttgaatattgtcttcaatttcttgaggatactcttaagtacatatctgtccattgcaaacattttaaaaactgtatgcctgagaatatttttattacagtcttacaagtaatggactaaatagctgggtagaaaattctagctaaaatgattctccttcaaaatggtaaaaatgggtttccattatctgtttgcattcaatgtgttggtttgctcatttgtagatgatcttttctatttaaaagttttttgaagtttgttcttgtatacaatattttcaaattttcctagaatttatctgagtgtgcttttttttttcctttcagttgtttggtcctctgtgagctcttttacttaagatcattcatctttcttgaattctgagaaattcatttccattatttcttatatacttcctcagcttcatttttatttctctactcttgagactcataatttcgatgctggcacatttatttctagcctgtatttctcttagattttctgttctatctcctctgtgtcctttattgctgccctctggaaggtttcaccacttatcttacgtctatcctactatttatatgaaccatttcttcttcatttcaactgtgacattgttcatacttacatttttacctagttcaggtttagagatgctttgctcctgtttgataccgttattgtcctccctatctcataagcatatttaccatgcttagctgagctccttgatctgtgtgttcttgtaattatgtttctgatgcatagattgtctcaaggatcagttttgaacttctccttctgtcttttttttttttttagacagagtttcgcttttgttgcccaggctggagtgcagtggcacaatctcggctcactgcaacctctgcttcccggattcaaacgattctcccgcctcagcctcctgagtagctgggattacaggtgcctggcaccacgcccagctaattttttgtatttttagtagagatgaagtttcattgtgttggccaggctggtcttgaactcctgaacctcaggtgatccacctgcctcagcttcccaaagtgttaggattacaggggtgagccaccgtgcctggcctgaacttctctttctatctatactctttctctggtgatctcatcctgcttcatggctttaaatattattgctatggcatgattcccacatgtttacccccagttggaacctctcactgagttccagactcagatatcccactgcctatttcttatctctgctgtctgtataacaggcctcttcaacctcaatgtgccagactgacatccaagcattctgcacatgtgccagctgacctgtcgtcttctccatttcagtgaagacatttcattcttccagttattcagaccaaacgtctttctaccttccacattcttgattcctttctttcgtacatattctgcatccagtttaccagaaagctgttggctttacactcacagtatatccaggatgtgaccacattataccactccactgccttatctctgaccccgaccaccacgttttgcctgcgttggccccgtagccggtcttcttagtgtacttttgcctctttctactcaacacagcagacagaggagagtctgttagcaggcaggccagatcatgtcagccttttgctccaaacagtctaacagctgtgtctcactcacagtgattgtcaaagcctcgctgtgacctatggggctctacctgatgcccatcccccttcacctctgactcaaccctctgacttcagcctctacctctctcttttactcaccctgttttgcccacattgatcttattcttcctcaatatgccagacttctttcaggacttctgtcaaaagtcatctttcttccctcacccccatctaaaatttcaccaacattgttgaccattttatagctcccctccctaattcacttttctttcttagcatccatcacaacctaatattatatatacctgtttatcctatgtatcaattaaggtacatttacatacagtaaaattctccctttttcgtatacagttttgtgtgttttcacagatgtatacagaagtcgaaacaccatcacaataatgatataaacagtctcattgtcataacacactgccagactctttctgaaactggctgtaccattttgcatttttatacaaaacgtgtgagtttcaggtgctcaccgctgacagctgcaattggcattatgagggttttctttttttttggccattctaattggtatttagtagtatcccatggttttaatttgcatttctgtaatcattaatgatactgagcattatttcatgagctcgtttgccattttgatgtttttcttgataaagaatctgtttgaatattgtgcccattttcttacttagggtttttcttattaaatttgagagttctttatatgctctggatgtaaattctttatcagcgaaatgatttgcaaatgttagttttcagtctatagattgtatttttactctttttgtttttttttttttttgagacggagtctcactgtgtcgcccaggctggagtgcaggggcgggatctcggctcactacaagctccgcctcccgggttcccgccattctcctgcctcagccccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccatgtctggcctgtatttttactcttaaaagtaattttcaaagaacggagatttttacctttgatgaagtttaattatcacctttttcttttatggatttaatcaaagttcaaccacaaatgtaaacacagtagaaaatctatctatctattgtctatctatctatgtatctatcatctatctttctatctagatcatctattctcgacagcaagagagaaagagatttattacaagaaattggcttacataactgtggaggctggctaagctagttcaatatacgtagggcagacagtcatgaagatgaagcccctcaacaagttgaaccgtgggcacgggcgtgggcagtatttttacagaatttctactctccaggtgtttattcctgatatatagaaatctgattgatgtttgtacattgaccttgtgttttgcaaccttactgaagtcacttattttgttctagcagcttttattgcaagttctctgggattttgcacaaagacaattatgctgcctacacattgtgacgtgtttctttctttccaatctgcatgccttctgtttctttttattcgcttattgtgctagctaggacctccaatgtcatgttaatttggagcggcttgattagcgtccttctgttgttatatatcttatgtactgacttcccccgttcctcgccagggttagcaccacagggagggatgtggaggtagggctgtttctttttaggattcttggctctttctccaatgccagtaacaacgctctagtaagcagtcaataaatatctgatctttattatgctgtttagtttgttttctttctcttgagggagttttagttcttgtcttggaatttgggcctgtgaacacatatttgcaaggtcataccacgtcctaaagaccagaccccgcttggtgggtttaggaaagagagggagggtgaggcccagtgtggagagcccaggcccctggaactctggtggaccactgccatctgctgccactgcttccagcacatcacggcccttgggaagaagtggtgctggaggaggccccgcctcaggggaaatgcaccagtctggggacttggaggaagaggatggaagggaaaggtctaagagcaggtggccattctcgctgatttttgccccagctaggatttcctaaaccttcacgttaccccaaggacacctgcataggtggtgtgggctgtccttagcatttttgcagtgtagcgtcacgcaggaatcatcgaaaagcattttctcccaccttttgactgctccatccagtgactatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctgccacagcttttacttttctcaggtattccctctctttccttttctttcttaataactttttttttcttttttttgagatggagtcttgttctgtcacccaggctggagtgcagtggcgcgatctcggctcactgcaacctccacctccctggttcaagcgattctcctgcctcagcctcccgagcaggtgggattacaggcgcgcgccaccacgcccggttaatttttgtattttagtagagatggggtttcaccatgttggtcaggctggtcttgaactcctgacctcgtgatccgcccgcctcgaccttccaaagtgctgggatgacaggcgtgagccaccgcgcccggccttaaataacatttttaattgcaggaaattccaaatcgatgtgcagagaatattgtcatgcccccatgtccccttcctcccagttaaacactatttgctcgtggccaacactgctaggctcctgatcgatgccgaaagccacctcggggcatcacaccggtggtgaatttgcaccgcgtcagtttagcaaagccgctattgcacttcctagaatttcttctgcggcacagttccagggagcctggcccacaggggagctgcgtgagatccggaaggccgcagagcgctgggccaggttgatttgatgcgtggggggtccgtgcggggcatgaggctgccgcttccagacatgctgttgcttctcttccgtcacaggcagagcgggccttgccgctccccgtgctccgtgagatcctccttcggcttctctggtttctggcccaggccagggtctagctccatgtgaaaagtcaccttctcctgcaggcacctgcgcattgagggtgaaggcttgaacgtggcgagagatgaacccggctcacagcttgtccttgtgtgggctctggcccattctcccaagttccagtgtcgcccctgttcacccgctgtacatcatgttccctgcccagctacccgcctgaacactcagtctccagcaccagcagcagcagccccaccagcaccagcagcagcagcagcagcagccccaccagcagcagcagcagcagcagccccaccagcaccagcaccagcagcagcagcagccccaccagcagcagcaccagcaccagcagcagcagcagccccaccagcagcagcagcagcctggcataaatggtgtgaccagctcccctaggacccttactgtttacctctcctaggggttctgcttctctcattgaacgcttactggaaaaatatcatttcatctataaatatcagtatggatctccaaaaaatacaaactcatttaagtaacgaaacctgcatgtccttttctaaaacacacacaaaattaaaaatgatttctctcgagtctctttcaccctcccaaacacactttgagaatctattttcccagaactgatctttgggggagaaactcatgtaactcccatcttcctggcccactaaaatataccatctgatgaaattctattagcatattattgttttaaatactggtatctccgatagagggcagatatcttgtaaaaagataggctattataaattatttgtgaaaagcattggcttgtctagaatatcttttgattgttttatggtcactttaaagtcacttttaaatgtatttctttctttcttttcttttcttttttttttttttttgagacaaagtcttgttctcttgcccaggctggagtgcagtggcacaacctgggctcatagcaacctctgcctcctgggttcaagcaattctcctgcctcagcttcctgagtagatgagattacaggcgcccaccaccacgcaaggctaatttttatttttatttttagtagagacggggtttcaccatgttgaccaggctggtcttgaactgttgacctcaggtgatccacccacttcagcctcccaaagtgctgggaatactggtgtgagccaccgcacccggccctcccttcttcttcttttttttttttttttttttttttgagacagagttttgctcacactgttgcccaagctggagtgtggtggcacgatctcagctcactgaaacctctgtctctcagattgaagtgattcttgtgcctcagcctccctagtagctgggattataggtgcccaccaccactcctggctaattcctgtatttttagtagagatgagtttaccatggtggccaggttggtctcgaactcctgacctcaagtgatctccctgcctcagcctcccaaagtgctgggattacaggcatgagccaccctgcccggcctaaatgtacttatttcttaatgatattagaaagtttgtatattaatgtgttggcacagagtatgcacctatgctagtatagggacaattattgtgatggatataatttaaaaagccctgttattattagggaatctaatatattggtattggtgaaatttcttgataaaatttcctggattttactccatcatccattaatatttgactgaatttatgagccactagaaaagtaagtagattatatctgaacctgttgacgtaatgattgtgaatctgtttagcattggaagtgacttttgagcaaatcagattgtaattactaacttggtaatcaattgatcattgttcagggagattagtgtaagatgtccttccataatcagaaactgaagtagtcagtttcccagcatttatttttatcaatactagtagcaccaaatgatgctttatagcaaaagcaagtaaagaaaagagaaaatatatcctttttggaatttgaagagagttttaaagttagagcccaaggttgaaatagccatcacaaaggaaccgaggatgaaattaaggagtaggtcagggatgacattaaggttttgataataactgaaaattagaatccttgccctgcaagaaacattcccacacacaagcaggaagactgctacacaaaacccatttgttgttttacaagacacacatctgctaacatattgtatttggttgccagttaccaggaatagttttctgtttgttttataaccaaaatgtgatgattactctgaattaaggcaggaagaaagcttgttggttcaggttttatggcaaagaagttggtactaatagttaaggcccagactcctaacgcatactgataattcttaccttgtctatgtgtggtgaggagattcttccacagtcttagaatttaggataggattacaacgccagtgtgctgactataatgagcaatcatttatttttcaccagaaagggaaaacaacctttctgagaaatatttgctggaagcctggaaattaaaatcttatgggacaaagtaagatcattattttcctccaatatgcagacttgattatatttctagccctatttaaatgtatgaaaaatcagtcatgttattaatgattatttcaagttgttccatttttcagttaaactgattatgtgtaataattttagaagagtggcatcattaccgcagttaaaattcatagactcttcctgtttgcctgaacatttctaagcatatattttaaaaaataaaactattcaaatttttgctacaaagatgtttttctaattgattgtcttgtttctgtattgtaaaagcattttgaaaaacattttttagagtttaggtaagtttagctgtatattctattatttacttattggcaagatgttaaaaaagttgatatttcagaattattgaaacatagcttgtgttcttttttttttaaacagagtctcgatctgtcgccaggctggagtgcagtggcacgatctcggctcactgcaacctccacttcccaggtttaagtgattctcctgcctcagcctcttgagtagctgggactacaggctgcgccaccatgctcagctaatttctgtatttttagtagagacatggtttcaccatgttggtcaggctggtctcgagctcctgacctcgtgatccacccaccttggcctcctgaagtgctgggattataggcatgagccactgcgcccggcccatgtgtgttctttaataagtgaataaagcaaacataatatggtttttagaaagacatatttgtttagtttgtaaattaacttacatgaaagcattgcttaaaatgtcctaatgtcatgtaaagacttcaaatccatttagttattaaattcttccataaatatttaaattatattaatgtataatatccaacacccaatccaagaacatttatatataattggatacaagcattgaaaatgcttttgcaataaagtaaaaaaaaagtttttgcacattttccaaggctaaggaaaacttatatagaactggagaagacaatgttaagaggtgcaggtgaactaatataaaactgagttgtagttgtcttacgttttccatccttcctcactcaaggctacgggaattgcagccacttaattgagatttatttgcaacacactattgcaagggaaataaagagtttagctggagtcaccttttagtttcacagtttaatctattgttgttcacatgatatgtcttctccagctcatgacgtgtcctgttcttccaggtcctaaagtaggatccccagagaaaagcaaagtcagtccgggcacggtggctcatgcctgtaattccagcactttgggaggctgaggcgggcggatcacgaggtcaggaatgtgagaccagcctgaccaacatggtgaaaccacgactctactaaaaaatgcaaaaattagccgggcgtggtggcgggcgcctgtagtcccagctatttggcaggctgaggcaggagaattgctgggacccgggaggtggaagttgcagtgagccgagattgtgccacttcactccagcctgggtgacagagcaagactctcaaaaaaaaaaaaaaaaaaaaaaaaaaaagcaaaatcaaagaagataaatacctatgcccgtatttgcacatgggttaaattcctcctgggacaaagggagatcagtcagtcttcaacagtctggagcagtgtgttaacattatagggtggcagtcatatttatgctacaggtcaaaagctaatagccactgtagaattctatccattttaagggaaaacttagtcccataatataatatgatgtaacctagcacaaaatagcatagaataacacaacgtatcaatctataatccaagtaatagccaacaaaactaaagagtttacaatcttgttatattttcttacaaacataaaataattcaacatttctaacattttcaaatagccccttctagtgaatagcagctgtttcaaatattacactcttattgcaaagtgtaattttgtattacctaatgtcataaaatacagaaacatttgactaagcctgtcagccaattaaaaaaatatatacacctagtgttttcattatgtacaatggagtttataaataaatatgtaatgagaataaaatctaacttcacagtttgctgaacttttgaccaactgtttttgggtaatttggatatagactatctcctcattattaattcattcaaaataaaaattaactaaaaggtataaaagttatttattcatttaactggcatacatgtatgcccatgactgccaagcggtcgactaggcactgagtattacacaatggtaaataaacaggcaaaattgtagtttcctcggtggaaatcagtctaatgtagtgctacctactgtaattaactagtagagtgtatatgtgtgttttgttttccttgtttttatatagaacaaaaggaaaaatacatcaccatgataaagaccaagtctttcttctctctttccccgtttctagaggattccagaaaagtgatgagtgactaattttgggaaacatggcttcatcgcaggaaacaggtgaatacatccccatcctgtgtgggaaggaaacaggacagccattgttgggtggcagaacctacaaggggcattaccctgttgatttactcactacaggcaagaatcccaaatgcaggtgggaaattttactgggcaccgatgactcataagagtccattgtagttaatagaagtaaagccagaagtcaccttagatcatctactgaccacatgggaaaagctgaaataaaaatcataacactagaaacgctttactcaacctctgctgatctgatttattgaatcaaagctttcatttgcttgagatgtgaaacatactgatctcaacacactgaccagggtctacgcagtggtgcatacctgtggctcctggaacacgtcctctctaagactcccacatccttctattcctgcctggtgacaatgcttaataagaatggttgttcccaaactgatttacgttggttatatttcataattacaaaattttattaaatattatgtaagtaggcagggcatggtggcttatgcctgtaatcccagcactttgggaggtcaaggcgggtggatcacttgaggttaggagttcgagaccagcctggccaacatggtgaaaccccgtctctactaaaaatacaaaaattagccgggtgtcgtggcacacacctgtaatcccagctgcttaataggctgaggcatgagaatcacttgaacccgggaggcggaggttgtagtgacccgagattatgctactgcactccagcctgggggacagagcgagaccttgtctcaaaaataaataagtcaataaataaataaatattatgtaagtaacaaaatgagtgtggaaaagaaaattgtttctataccagctaagtaaaatggattggaaatatttgatgaagcaagtaggtaagaaaatcatgagtggtgtagaaggcacgtgttacgaaggagggtcaaaccccagatgggttctgcattcagatcgcttctcaagtggctccttttcaaaggaagctaaacttgaattcatagatcaagaattacggttttagtttaggtcagaaaaataatacctattgccagtcagaatcacatatgcaaaaggcctcagctctatggcaaatgttgggcaaatgaatgcaaatttatttgttttgagttaaaataacatgtttaggaaatgtaggtatatattttaaaaataattcatttaaccacagatcttgatagtttcaaataaaactatttctcatatttacataaatcattgagacagtctgaattattataacttaaacagtaaaagaagtaaatagattagaaatgtgtgaacaaatgaatgggtgtaatgagtaaatgtttctattctaaaattcaaactttggcagggtgtggtggttcacacctataatcccagcactttgggtggctgaggtgggcagatcacctgaggtcgggagttcgagaccaacctggccaacatggtgaaactccatctgtactaaaaatacaaaaagtagctgggtgtggtggtgcacacctgtaatcccagctactcgggaggctgaggaaggagaattgcttgaactcaggaggtggaggttgcagtgagctgaaattacgccactgcactctagcctgggcgacagagtgagactctgtctcaaaaaataaaaaaaagttactttcaaataagaattttaaattattattttctatagggacaatagaaaaaaatgccttgcttcttgcatggttgatcgaaatttgaatttcaaaaagaatttttttgagacattctaaaaaaaaataattttgcatgagttttcttaaagagtacctccaaaattgtacagcctaggctgaagttcactgttgcagtcacggcttattacaacttgaccacccggactcaagtgatcctcccacctcagcctcctgagtagctgggactacaggcatgtgccaccatacctgtttagtttattattttttgtaaagataaggtctcactatgttgtccaggctggtattgaactcctgggctcaaacaatccttctgcctcgatctcctaaaatgctggaataacaggcatgaaccatcgtgcccagcctagaaataattattttagctttttaactctttattggcaatgtgaaatttttaggattattgtcaaagtttggaaaacttctattgagttgcttttgcataagcactgtaagattgagaacatttttgctgtgttagtgacaattccacacctcttacagtatgaggtaggctaagatatgtgacctgaaacggtgggctctgaaaagcatgtggatgctcctagagtcacgcagctatgcctgctgaccgtagtgttgccacaatgcttcacggttgcaagaattcaggaagtcatgcttcacctgattcctttacaaaaaaaaaatcataacgtgtttatattgtttatagttggcttttttttccccctgagacagtgtctcgctctgttgcccaggctggagtgcagtggcacaatctcggctcactgcagcctctgcctcccgggttccagtgattctcctgcctcagcctcccgcgtagctgggattacaggcatatgccatcacgcccagctaatttttgtatttttagtagggatggggtttcgtcatgttgaccaggctggtcttgaactcctgaacccaggtgatctgcctgcctcagcctcccaaagtgctaggattacaggcgtgagccaccgcatcggcctatcgttggcttttggaagtggcttatgcaatagatggtcctgacgcttaagtttgactagattcacagttgacctagctggaagaaccaatcattcacagataggtgagggaaggaactgggtccagaggaataacatccaaagaaacttcatgttttcacagtgaaatattcgctcatgctgtgtgccaaactgtctaggattctgcactgctgttgatggccactgctgcactcccttctactctgtgtgctcaggtgtcattgtttattgatgttttcatctttatcataaccataagactaccttaagttacacagtgcttttgatttttgaggaatgtacacacacacacacacacacatacacacacacacacattatctcatcagtttttgcttttttgttacatccctatcaggcaagtggagtaagtagggttgactcgcccagggtcacctgtttcaactagaacattgtgataccacatattcagggtttgctccaggctgtatcaagttcttttctgtatcgtatttatgatattatgatatttgaacacgttcataagtctgctggcattttaggttagttaatgtgaaccgctgccacagacgacctctagtcatagtaatcacagtaaatgcttatttctcagtccaatatcttaaaggccaatgaaggtacttctgatgcgatggctctcacccttcctgaggggcccaagctgcttttgtctcatggtgcagccacctgaaatgcagtctccagtagaatgagaaggcatccaggagagggcatgcaggcatcaaccccgcgacacagatggctgctgtcacacgctgcggtagtggtcacatggctgtgcctacatgctgtgaagtagggaaacatattccctggcttggtaacaactttctgtacagggaagaagtaaggaaaaaatgtactttatttcaaaaatcagttatttcagtcaagtttttaaaaagacaaggccaaaagaagagacaaacttataaatagtttcttcttggctaccacaccaaaaccttacttttaagcttaaaccatgaagaaagatgctcaggatatgaaactaaaaagacattcagagggcagagtacctatatataattcttttatatttatattttccatatccatatcttgtgtgaatgcatttttgtttggaaacctgaaatataatttattatagatttctattctaatgtatattctgatttaacccccatatatttttagaagcatattattaaacattttgaattcattcaagagcattttttttgttttttcttgtgtgtttgttttgttttgttgcatgtggtatttcagaataccttatgggacatgaatccctttccagggagctgcagtttagtgggcagataaaccgcattcatgaagtcaaatgcagtgggaaaatgcaaatgcctgagagatgcatgtagagtacttgggaagtctgggcaggaggaagcgggaagggggttgaaagttgaaaaactttggtgatagcaagataggcttgtccgttcaatttttatgttttccttcatttaaagaaaaagttaataatccaagtgcatttttaactaccagaaaatagaaaacgatataaatgtttttgacagagtaaaaagctatttcttggcaaaacaaagttagtattagtttttcttttgtagaaatcattctcagtaaccaaaaccgtatggtactggtaccaaaacagagacatagaccaatggaacagaacagagacctcagaaataataccatacatctacagccatctgatctttgacaaacctgacaaaaagaagaaatggggaaaggattccctgtttaataaatggtgctgggaaaactggctagccatatgtagaaagctgaaactggatccgttccttacaccttatacaaaaattaattcaagatggattaaagacttaaatattagacctaaaaccataaaaaccctagaagaaaacctaagcaataccattcaagacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaagttttccaatctacccatctgacaaagggctaatatccagaatctataaagaacttaaactaatttacaagaagaaatgaaacaaccccatcaaaaagtgggcaaaggatatgaacagacacttctcaaaagaagacatttatgcagccaacagacatatgaaaaaatgctcatcatcagtcatcagagaaatgcaaatcaaaaccgcaatgagataccatctcacaccagttagaatggctatcattaaaaagtcaggaaacagcaggtgctggagaggatgtagagaaatgggaacgcttttacactgttagtgggagtgtaaattagttcaaccattgtggaagacagtgtggcaattcctcaaggatctagaactagaaatatcatttgacccagtgatcccattactgggtatatacccagaggattataaatcatgctactataaagacacatgcacatgtattgtattctagcactattcacaatagcaaagacttggaaccaacccagatgtccatcaatgatagactgggttaagaaaatgtggcacatatacaccatggaatactatgcagccataaaaaatgatgagttcatgtcctttgtagggacatggatgaaattggaaatcatcattctcagtaaactatcgcaagaacaaagaaccaaacaccgcatgttctcactcataggtgggaattgaacaatgagaacacttggacacaggaaggggaacatcacacaccggggcctgttgtggggtggggggaggggggagggatagcattaggagatatacgtaatgtaaatgatgagttgatgggggcagcacaccaagatggcacatgcgtacatatgtaacaaacctgcacgttgtgcacacgtaccctagaacttaaagtataataatttttttaaaaaaagaaatctttctcatttgctcaccaaaaagatttagtggagatatatgtatctccactataatatatgcagcagatatatttctatttcctatatacatataataggaaatagaaaaatatgttgataagcacagaaattatgtattatgaagagtttcaagatagtttttactagttttataaattaccaatgccttctcactgtctaagaatttaaactccgtagaaatatttcttttttttttcttttttttttttgagatggagtctcactctgtcgtccaggctggagtgcagtggagcaatctcggttcacttcaagctccgcctcccgggttcacgccattctcctgcctcagcctcccgagcagctgggactacaggcgcccgccaccatacctggctaattttttgtatttttagtagagacgaggtttcaccgtgttagccaggatggtctccatctcctgacgtcgtgatcctcctgccttggcctcccaaagtgctgggattacaggcgtgagccactgtaaactccgtagaaatatttcaaacatttaaaaattcaaagtgacggcaattagcccggcagaaacaaatctgactgtgctttccttgtcccttgaaagtgtcattgaagctcctgtctaatgaagattgtggcatcagtgttcaggcttgtcacctgctcctcgtaagaacaaatagggatacttagagggaaacagtttgctacaggtagtgttctcccagagagacaaaacgcgaggggccgagttgtataatcaggtgtgctgaaactccacggggcactgcttaacaaggttgctttttgtttttgtttttcctcagtgtggttagcaaattaattgactggagaaaaatgcacatttagaaacaagctaatgtgcgcggcatgcaaagtcgagccttctgcacctgccagtctctcctccccgctgctgccgggaactccccgcgatcccagatcggcctgcgctgccttcctccttccctatccccgggacgccccgtcaccctcagcctcgcgtgcacggtgcactcccgccagggccgctcacgccctggtttctgtcccggctctactcccctcccgctcagtgattaaacaggtgatggctgagcacctgccagggcgccggcggtgtgcagggccccgggctccaggccttgctaagcgggctggcccgctcccggggctcggtggaatgaggggcaggactcggtggcccgcaccgccactgccagctccttgtttgcagacactcctctgcgagtctgacgattgtgcccttgcttaatcctcggacccgttctccgttctcctccgcagtaggaagcaggggtgccgccggccccatctgcccgtgcccgacacggacgaggccttcacgcagccctgaccctttccatttcccagggacttgcttctcgttggctcagccccagggccctggattcctctgtcctcgcgccggcccgcggccaggccgctccctttgctcgcagtgggtcttgtagcttgctgctcggctgggacggccaccttgcacctgtcggtgctgcagggcgctctccctgggcctgggacatcggtctctgcttcacttcacctcacgggtgggcccggaaggcttcgtcttcctacgcctcacctgaagctaggctgtgattttttaatgagctcttccatacatttatggagtccctgctataggctcagaatcgctctaggtgtcagagatgcagtggtgaaaaagaaacgagtcttatcatccagcctgtgtgtggacagaaaaggtttaaagccaggccctgttgtgcctcattgctccaggagacattttcctggctgagtcaaaaacagaagctgcctggattgcacctatcataggaataaaaactagcatttattctgtatttactatgaatcagactcttgtgactgttatatgtattaatttaatcttctaaaagtcccacaaggtggatacccatgccatcccattttacaggtgagagcactgaggttcagaggggtttaaggccacccaggtagtaggaagggccagattcagtgtttcctcttaagtagtcttcatagatcctttatgcctagtcaagtgcctttgaggacaaaagaagagagaagcagggagctgtgaagaatagagaggtggccagaacaatttcccttatgctgggaaggggaggtaggcttgtgagcagggaagacccacatgccacatgctggtggtgcctgggaagttgacaggaccccagaaagagggtatgcccagggagactgcaggctgtcagcttctcagcactggccaacactctcatacatcacgcgtggcacagaaatagagccctcagatgcaagggtcctcatgatcttgaaccatgcagttgtcagtggtgaacaatgaggcttaagaataatggtcctttcccatttatttaggtggtcacaactgggtcccagtatgatccttggagggggagagggccctataatgtttgtacttaaatgtcctgacattcccagggatggaggctcagaatgaggactgcgttctttaaaggaataaagaaatggccgtgtcttgcacctgcatttcctgtttgattcatagctacaacatggcaaatgtcaatgaatacagaccctgtgtcaaggggtgtgctatttccttgatgcattgtggtgaataaaaaagcctgacttgggccgggcgcggtggctcatgcctgtaatcccagcactttggaaggccgaggcgggcagatcatgaggtcaggagttcgagaccatcctggccaacacggtgaaaccctgtctctactaaaaatacaaaaatcagctgggtgtggtggcacgcacctgtaatcccagctacttgggaggctgaggaaagagaatcacttgagccagggaggcggaggttgcagtgagccaagattgcgccactgcactctagcctggcaagactctgtctcaaaataaataaataaataaataaataaaaaagcctgacttggctgggcatggtggctgacacctgtactcccagtactttgggaggctgaggtaggtggatcacctgaggtcaggagttcaagaccagctgaccaacatggtgaaaccctgtctctactaaaaaaaaaaaaaaaaaattagctgggtatggtagcgcatgcctgtaatcccagctactttggaggacaaggcaggagaatcacctgaacctgggaggtagaggttgcagtgagccgtgatcacgctattgcaatctagcctgggcaacaagagtgaaactctgtctcaaaaacaaaaaaacaaaaaacacctgacttaataaagtccacagttgaatgggcaaagccaatattaagtaaatacaaaatttaaatacaagttgtgcattataagaaaccaggatgctctgagaggagataatggggagatccaccatgactggggtcagggaaagtccgtcctgaaaacttcccacagaaagtggaggtgaggagctcaggaacacagggtggggaggagagattctgagcacagaggacagacagcacaagcaaagagtagaaaacagtcacagaactgaaaagacacctgggtacccaaggcatagtaagggaggggcacgtgggattcagctgaagatgtaagtcaatcgggtgggggtcagtcctgtccaacccatggcccgtgggccgcatgccacccaagatggctttgaatgcagcccgacacaaattcataaactttctgaaaacattatgagaattctttgcgatttttctttctttggctcatcagctatcgttactgttagtgtattttatgtgtggcccaaggaaattcctcttcttccattgtggcccagggaagccagaagattggacacctctcatgtaagtagcagccggaaactgaagaacctcatgtgtctcatcaagggcttgtagtttaatcttacctgaaattggaaaacattgagggctttacaaaatagagaaaacaattagatttactttatacaagatcatttgaatggagagaggaaatggcaagatcaattgagaagctattgttataggtgaggaaaaagttggaggtggcttacggtggagacaggcagcgcaaagagaacaggatgcaccagcaatggattttagaagcataactgataggactgggggaagtgtggtgtgtagggggcaatggagaaggtgatgtccgggagatccctagcgtgctggaggtgatgtctactgagatggagtagaaacagatttaggatcaagattaagaattcagatgtgcggctgggagagatggctcaagccactttgggaggctgacgcaggcggattatctgaggtcaagagttcgagaccagcctggctaacatggtgaaaccccgactctactaaaaatgcaaaaatcactggatgtggtgtcgtgcacctgtaatctcagctactggggagggtgaggcaggagaattgcttaaatctgggaggtggaggttgcggtgagcagagatcacaccactgtactccagcctgggtgacagagcaagactctgtctcaaaaaaaaaaaaaaagaaatcagatgtgtgagctccaagaagacatttaatcatactgaatatctggatacttatttgtcaatttaaaacccacacttaatttacagatagatagatacatctagatagatcttatatacacatagataggtcttttatagtagatcctatgtatattttatagtggatcttttatatgtatcgatatagatcatatatatctgttgctatttgtctaaagcaggagaaatctgaagactaagctcatatgtgctgattttatcttgaggtattgacataaacaaccggaatgaatgcaaataaagtccacaatgcttctggaatgttctataaaggcagatctacatctgcagaataatatgcttatgttagtcagcagagctttaattatttaattgtcttaccacactagcccaagaaagattttaagcctaagcctttaaaataaaaataatttacagatgctatagagagagaagtaaagtcgtccactattgatcctgtgtccttgatctgccttaccctcatgatcataaaatagaaagtacataaattaaggttttcaaataaatattcatggcatggtgatgtctaggcaaatttctttgagtagaaaagctacatgctggcttcctctaaaatactgagaggctatggtcacgagctggagggaggcagtcctcctgtaggtgatcagtgatttttttaatgctacagacttggacaccattttcattttggttgtaaggattttcatttttcctctgtgttttacatattttctcttgtttctacaccctagataccagactgaaagctgtgagcaaatgagaactctaaagttctacctttcactgtcacacaccatttctgtagcctaatcaaaatgcggcatctttttcctaaggcaatgccatatttttctctcatcatgacacttaatttaaaggtggcagactggaagatgcagtgtcctgtgacaaatttgtaagccgtgaattgatccctgccccacacacagcaatatccaagcatggtctctggcaacttaccataaatcatcttttacttctttgctcttagactttctgagagctgaatggcaatgcggagacagatgggggtcagctcttcactgtcatccatagctgctggtaatttacgggcgatatagaacacctgtgagttatggtgtcttttgtttgcctgagttgtcctttgctgaggactgcaatgcctacatcataatgtttgagtgtttactatcatatactacaaaaaaatacctaagtcatagaagcatggcattatacccatgagctttaaggtttatccaatcaaaaagccatttctctttgggcttgataccctgcgtctgatgtacaaggatgctggaggaatacgaatgccagtaagccacatagagctacagcaagctcttcatttcatggtcattaagagagctgagagggacttcattatagcaggtcttcgacagatgaaatggttctgcctgttccccggctctccacaaacaaccgcaggaggaactgtgcccacgttgttatgaaaatgcactttataaaaagtaaacataagcaccatattaagaggaatggaagaaataagtaccttgctgtttggaaaatctcaagtgcgagtttattcctattagatccttttaatttgtggaagaaagtacagtcttaattgcatgaacattattatcattaattaatattaatcaaccagatatactctcccaatttttcaagtattttctgcactctttataatcattgatgtttatcactggcctaagaagtgaaacacaaacctgcaacatcaattaagagatgatggattatggccaggcgccgtggctcacacctgtaatcccagcactttgggaggccaaggcgggcagatcatgaggtcaagagatggagaccatcttgaccaacatgatgaaaccctgtctctactaaaaacacaaaaattagctgggtgtggtggcgggtgcctgtaaccccagctactcgggaggctgaggtaggagaatcacttgaacctgggaagcagaggttgcagtgagccgagatcgtgccactgcactgcagcctggagacagagtgagactccgtctcgaaaaaaagaaaaagaaacaaagagatgatggatgatataatagtagaaggatcagttattatgagtggcaaacatgaaggagctgtgatgggccataagaaaatgttagcatttatttaacaccggtctaatgatccccacctggcaagcataggcaagtcttcattttcacttttaatttacctggcacatacattcacttatcatactgtgagataatcataggtttatacatctgtacttctattgatataagttctgaaataattaagaacattagagatggggtggtgatttttaaaaaaaattagcattcaaaactaattctagactagttctcatatattaggcattcaccttttaaacaaataaaggaacagataaataaatggaaatggaaaaaagaaatagggtaacagaaatacatagttcaggggccaaggtgtaggtctatgaatataaaatcagtgttttcacagtttcgtataatttaataaatttgaaatagaaaccacatagggtgctacatgaacttttaaaattaaatgtacagtctctgatttgcaatggtttgattgaggatttttcaactttgcaatggtgcttaagtgacaggcattgaatagaaaccatactgcgaccattctgtttttcactttcagtagggtcattagtaagttatatgagatattcagccctttatttacacaaaataggctttgtgtcagaggattttgcccaactgtaggccactgtaaatgctctgaccatatctaaggtgggctaggcatggttgtgatgttctgtatggtaggtgtattcgtgcactttccacttaggttattttcaacttaggatgggtttaatggggagcagggggtgcacacaactccattgtaagttgaggagaatctgtgttctgttttcaaaatccatatgttaaaaatgattgatgtcaaataggcttccaaaacatactctaaaataggcaaatccgctgaagtatggaaagagcacgacacagttttactgcacattcccctggaaacctttgtctgaaattttccaaatattcaaaataaggtattataagttctctggagagggatttatttttaggaaaaggctgtcattgcttgtggagtccatattcataagtggtttttgtatttggtattaattcctctatactataagacccagaaagacatgttctgtagggtaagtatactaactctgatacggtttctttcaacagattgttctcaataattaaaatggcaacaatgacaacagaaaaatcagatatgaatagactctatgtcttctagtctttatcacaataacctgatattttaatcctgttaagtactatattattccagagtatacaaagagaaacagtggcggtgtgtaggcgggatagattaggctggtataaactcttttcatataaatgtatgcattgacgtgcaggcattgtgatgcttcctaagtcaattcaattaaagtcataaaaacttcacaaagctgaccacacctgtcaaaaaaatgtcaacgctcatcagccttctatttcttctttttttttttttctagcctaattcaggccactccccattttaggaatttctagattgcaagacttaaacttaatgatttcactgaactttgcctattatagtacattttccttctttgtgtcagaaaggcatataattgtgagaaatgtgatttagaataagggagagcagtgatttttaataaaaaataacatgatcgattccacaaaatacaacaccatttcagagagcttgaaggtataataaaattctagagtgaataattatataacggcttatgagctttcacaaagcaaatggtaatcaggctaagataaattaactaagattaagaaataccagattattaactactttttaaaatagtctttttagacaggaagatttggaaaatgctatcaacatgtcatatatgaatttcaataaaaaatgtgacaaagacattctggggagtattttgggcaagctagtgacttgtagattgtatagtcacccacgtgaatttgtaattgactgaaggccttctttcacagatgctgctgctggttcatggctgtcctggacagacgcctgcagagtgtgctcaggcccatgtgttcagccctgccgtgctcactatttcatggactggtgatcgaaaaaagagatggagccactctaatgagataaaacaataggaactgtatagaaacagagctgggtagatggagtgtaagagtggtacatgtggccggggaggtggctcacgcctgtaatcccagcactttgggaggctgaggcaggtggatcacctgaggtcaggagttcaagactggcttggttaacatggtgaaaccctgtctctactaaaaatacaaaaattagccagacatggccaggtgcggtggctcatgcctgtaatcccagcactttgggaggccgggacgggtggatcacgaggtgaggagatcaagaccgtcctggctaacacagtgaaaccccgtctctacgaaaaatacaaaaaaaaaattagccaggcgtggtggcgggcgcctgtagtgccagctactcgggaggctgaggcaagagaatggcttgaatctgggaggcggagcttgcagtgagccgagattgcaccactgcacttcagcctgggcgacagagggagactctgtcaaaaaaaaaaaaaaaaaaaaaaaaaaaaaggaatggtacatgtgaaaaggacttatagcccccccgcttttattcttttgtaattttgtaatttatatttacagattgtccttttctttttttaaaaaaaacacttatttaaggataagcaatctgtttgcttgaactggcagtgttgtagaaaggttccagtaaagagcgttttcctccagtggagctgactttgtgctcagtctttacaccacgaaagtaagggtcatgtggttgtggtatctggggaaagagaaaaatgtcaaattcagacatagctccgtaacttgaacgtaacttcctcttttaaaaattatttttaatataacatagttttctgtaaaataaagtaaaaatattaataatagtggatttaatgtcgagcaggatacataatttacactatctacaatacttacccactgataaactccacacgattacaactgattcatgaaaatgaataaataaacaattcagctcagttgagttagaaacatttccaaaattaaatggaaggcaagtgttataagcaaacaaaaagtgttacatgaaagtgaggataaatcttttgcagtaaattattaatagatacccattttttattttgaagattgaaatactaccacattttaaatatagtaagttcaagcacaatttaatgaggaatagtcaataatattcaatataactataaaaccagtgatgtataataactggtacataaaattctaatacagagtgttaatttttttggtaaaatatagttaaacaacaatcatattaaatcagattggcattacctacagtgccaattctttcctgagttagaggttaaataaacatgtgattgagaatttcaagttgaatctaaggacaagaagttagtctcgcccagttgtgttgacacaatctggccagatgggctggctggaactggatttgacaaaaagtagtggggactgctccaaacctccgtgtatgcagcaaaaggttaaaaatgcgtttcaaacatttctgctgaataaagttagaaacgagcatactgtgtctcgaagtcgacatttccatgaagatgaaggaggcattgagtgcctgtccgcgtgcctccatggccagtgcattgaaaggaaagttacacctttgaagggagctggtggacctttggctgattatagaatacaatcatggcgactcacagagccacataaattaaaataggaactgcctggatggttgtttaaaacctccagaaaaatacctcaaaggcgagatgttaaatgcttgaatcagacatctcttgttataagtgaaatctctgttcctgctacattttagtaacattattgcaggaatttggttaagtgtggatgcaaaggacagttgtatcgttaaacagggctaactacagttgcaatattttagacaaaggatcacgtagaatcagaacctggatttttacatactgtggccttatctgcagtccatcttcgtgtttgcttgcttagctttcacagaagtaaactacatttctaataagggctcataaatttgatcataaatgtattttctttaagaacttcgagactttcattggcaattgattatttatttttcgctgatcttatggccacacttatttaggtgacattctttaacctgatttgtgaatttaaacttggcaattaaaaagcggaaaacaaaacacaactttgcattagattgggtgtagtgaagtctgtgggttagcccatatgtaactttacctttcacactgaatttatgtttctatttctgaataattcagtaaatctatataaattatgtaaatgaccaatacctgaaacacaagctaaacctacacaatagatagtcacacacacatatatacatctgaaatgtaatgaataattcaaaatttgaattgtaaaaagcattacagaataaatttcaatgacaagagatttgatcgacacagcaaaataggtcaccacagtcaaaagtttgcccccatttaatgctggtgcctgagccgtcctaactggtccgtgaaaacttcgacagaagaccatgcttctttttatttgctttgagcagtgcgtatatacctgtcttgtactttttacggacagtttcagttagaaccactttgatacaagaatactactgaacatttacatttttagcagaggtgctttcttttcttcaaccagcaacaggcatagctgctgcaatggttctctctccaaggtagctggagctggcgcttccaggagggtggggatcaaagctgcgaagagaaacctaaagaactggtctcaggctcttgcccatgtgaagcataaaagtagagagaggaggccgggtacggtggctcacacctgtaatcctagcactttgggaggccaaggtgggcagatctcctgaggtcaggagttctacagcagcccggtcaacatggtgaagccctgtctctactaaaaatacaaaaaaattagccaggcatggtggtgggttcctgtaatcccagctactctggaggctgagacaggagaattgcttgaacctgggaggcagaggttgcagtgagccgagatcatgccactgcactccagcctgggtgacagagtgagactccatctcaaaaaaagaaaaaaagaaaaaaattttaatcagatgccatgtacacggagaacagaagcttggagcaaagatttagaaggggctaatttatgtctattcagggtaggcacagaagttttttggtaaggtgcattacttctggcagagctgtatattgtaaagtagacagaggatgatgtgctgtgtgaagaataaggtttcccagtggtcatggtagaaaataatataacaagtaaatgaatgttatcttcaggttgaaggaaatttttcatatggctttttttttttttgagagagagagaagggagccttgttatctttcccatgcttcagcctcctgagtaattgggattacagtcaccagccaccgtgcccggctgaatgactttttaaaagctttccatttagatcaccatattatttatacagtgttgggatgttcaagtaaattatctctttgccttttcttttttttttttccaatgagataaacttaacaatgcagagcaggatttctttagtcttggtggcttaccctaaatcatattgcaaatgaggtgcatttagtttgtcttcagcatagcatgtttaccacctgagaatgataatgaagcagcaaatagttactatctactgagggtgcaatacactgactatgccatgtgttgagttcattcattcctcctgacccatggaggggtagaacatttcagtaacttagactgtaggattcgaggtctttaacattaaagtcattgctccaaactcctatattaataattgcaaattgcttattcacacaatgatttacaattattaatattctttgttcctttgcttttcccgcaaatacttatcaagcatcttttctatggcaggcactgttttttagggcacaaacattgcccaaagtctttccccttgttttgtgtatgttctaagggggaaacagacaatacaatatgtataatgaagaagcaaacaataataagacacaaggtcaaatactgttggtagtagcgcagctgtgaggcagatatacagtatagcggatatataatatagcagtttgctatattaaataggattatttaggaaggtgacatttgagcaaaggcttgaaagccacagacactcttcatgatgctagaacaagattgaaaacaaccccttccttcctgtcaacttacctatccccaggctgctatgggtattggaggacatgctaccattgccatactcctgggacgcagtgacaggataatagatgttgaagtggtggctctttacccaaacagagcatttacatttagagatctggggctagatatgtcaggcaatattccctatggtctgtctgactgtgcggtcctgctgttattggggtaggctagttccttggtgttcatgttgcatttgcctctcttccgaatgcagtatcagtgccttattcctctttatatacccatgtcaccacttccacaagcccagtatttatgccaatgcattgcagaaaagtactaagtaaatttttagatattgcaaaaatgttttttattttcaagatacatctttttacaaacataatacttttagtgaaaattactcacgaatggcaacaagaagaatcaaattgtactggcaaacataaaatgctttagtttaatcagacatttgctagtgttgtcttgttttctggtgccaagaagaaacccttaacatgcaagagaaagtgaaaaagtctaggggctgagaccatgtgaacaaacgtctttctgtcctctttatggtgaattaaactttgctcctctgacaggccaaatacaactaattccatattgggctgctttttcctatggtaaagcatgaaaaatctatccatgaatctatgtatagttataagttaattcaggcacattgttgccttagaatgatgaaatacatgcttacggaaagcaatctattggttgagactaggaaaatgctggctggagcccatgctgtctgttggaaacggagctgtggaaattgccagctctaaatgagataggaaatttgttgattggtttgttggatttctttttctccattattttccaaaagaagaagcaggcatgaattctggcaattttctatttttcccttgcttcccagatttagctcactgattgcataattttcttactgctcatttttcaggaaagtccataggcattagccactgccttttgatgccagtatgcatcagaaggcagtggctaacagggagtgtgtgtcatttccccgggggccaatcagctcaactcagtcacatggtaagtcagttgaaaggaggcagtgggaatcatagatatgggtgatatttttttttccttcccatggtgctcagagggcacaaaggaattctaaacaaccatcttattagttataaaaaatttttcacctctgcagaccttcacactacacttcaatgacactattaatttctcttaattgaacaggtgcaaacctttatcctgttttatattaataaacaggtttgaaacctctttgtttcaaatataccatttaaaaattagtgctaatgtttagttatgatggtctctgctgtaacacattcatgcatcaagcaattagtcatttcctagtgtgcacactgtattgttttaacctccaaagaagaatccagatttgctcccaaatctagaaacatggtcagatgcaccacttgatgatgaatacaaaatcttgacaattcaattttggtaaacagtaaagaatgtgtatatgccacacctatggaacatatcaagtaagctgacatcaaggagcacacagctaatatccgagcacttaacaataaacactttctagtgacatttctaggaaatcatacaaagtaggagcatgggtcaaaatgattagaaggcagccaggaaagtcttcacactggcatcataaattttattctttatatacatttctttttctagttgctaaaattaggaaagctggtagaagaagaatgggaaaattgaaggtaaataagtgatagagtgtttatttacaactgtgcctaagttcaaaaaaaaaaaaaagagagagagaattggttacctgtgaaactgttacctactcatctgggacagctgccctctggtttccttcagaactctacagaaaagactgacttagacaaatgcttgtttggaaaagatttttctttcacctggcagcttctttgcattgctactgcattaatctttttccatgcctgttttgttctcattttttgtttgtttgtttttgagacagaatcttgctctgtcacccagattgcagtgcagtggcgcggtctcagctcactgcaacctctgcctcccggattcaagtgattctcctgcctcagcctcccgagtagctgggattacaggtgcccgccaccatgaccagctaatttttgtgtttttagtagagacggggtttcaccctgttggccaagctggtcttgaactcctgacctcaggttatccacccaccccagcctcccaaaatgctgggattgcaggcatgagctactcagcccggcctcatgtggattctttggactccagattctcctccttcaatccagttttatatatgcaaccaccacacatagctttctcaggcagagttataatcacattcctattttgcttggaaaactttgcacaaatttgaaactagtacatgcacaaggtttataaagatgtaaaaacaaatatatagttagagtataattaaaggaagaatttatcaaatagcaactaagattaggtgatgtgaccatatgagtacttttaaaatgtcgtttgagttttcatatttatcaaattctctaacaaattggtattaatttagtaatttagtaatcagatacaaaatgttataaatatatttataacataatacttttttttctggctctttctcttattttgtacactaagtgcagtaagatgtacccgagggtttctttcaagtcttgggtctttaaaagatcaagcgacgcttgggagaggacagggaaaataaaatatggactgagtagtgtagatgctcagcctagcattcatgaggtttttaaagtttctgcatgattcattccagctcatgagctaaactgctacatgacacattagaactgaaggactcactggtgctgacgagtctgcctggagtgtccttagacatcgaagcggtgtcatggtgataggagaggctggtcagggaacccagactcttggccatttcttcttaagaaccattgctaacaagaagctttgatcagctgcagggaagcaactcattcctggggaaagggcatgaaaagaaccaggaaccatttgagagcacaacttaacagactgacacttaagaaaagggttggaatctttttttttttttttctttgagacagagtctcactctgtcaccgagcctggagtgcagtggggcgatctcggctcactgcaagctccgcctccaggtttcaagccattctcctgcctcagcctcccgagtagctgggactacaggctcctgctaccacgcccggctaattttttgtatttttagtagagatggggtttccccatgttggttaggctggtctccagctcctgactttgggtgatctgcctgccttggcctcccaaagtgctgggattacaggtgtgagccaccgtgcccggcccggctgctgccactttgcacccttatctctttcacacttccattgagaagcgtggctatgagcctgtgattggaccttctctgagaatccagcgagtgggcactggagaggaggaggtgggggactggacaccccactgcaacacttccccagctcctgaagtgggttgctgtgtccatttggagagttagagagagatctttcccaatagcccttctctaccatctaatgcctttctgtgaagagatgggaatctattttaaaaacttggtccgtttcttcctcttcagatcttctgagttgacgttcccactttgtgagtttactgaaagcaaaaaacaaaaaacaaaacccaaacaaaaacctatcacaatcagcttttactcaaaggtagtttggggagtagttagtcaaaggatggagagttggacaaaaatcgtcctatgtcccaggcacttagggggagactgcaggtctttctctaggcagtcacacatcacagctttctgggcaatctgggtctggcttcttacttctgcagtgcagatatagcagagggtcctgtgctatgtgttgtgatcactacatactgtgatcccagtatccccaaatgggattactcgactgctaggcaaatagcactgggtcctttaatgatggggtgttgacacacgtagtgtgatgaatccctcattgctaaccttccaagaggaggtattgcagtcccctgctggctggatttcaagtgttggaaaagcctaggattgactgcggcaattgcagcgctgggtagagttcagtgggtggaagccgggaagataccacatcgttaaaggcatattcatcatcttaagagcaggcagccccggggaagagtgtatttcagtttttgatagtttgtcaaggcacagtacagttcctttgtttgataatcagttcattttcctaattcaaaaggccaataccaggacgaaagacatctgagatggaaagtagaacttggtttcagcgtgtatgtgtgttaagtgcatgagaaaacctgtaagctacatgtcactcggagtcttcttttaaccttaacattcactctgtttcatattgtctgtaaagttcaatgccctcttcaataattctgcaaatctgtggataagagtgtgtgtgtgtgtgtgtgtgtgtgtgtgtgtgtgtgtgtgtgtgtggaggggatccatatgattaatttctgggccctcattctggtctctgttacgttctttgctgttattcctttatctctactctagcatttatgtgtatgtttaactcactccattccttgatttttccaccaaaaacaaaaccaaaccaaataaccagagtcctttgtttaatataactatgccttttttttgatctcgtgagatagaggaggatttttatcactgggatgtgaacgactgttctaaggagggaagctgtccagtccttcagagtgccctgttgtcctctgccgctcccatttttctcctgtgtgtgccctgttccctctgcttcctcagattctcctcctcagttactatcaatttgtagaacagcaggctcaattattttattcgcttcctgctaccgtatttgcagagtatcacctttcaccccaaacagcttattaagataatttccacaaaggatagcaggattcccagtgccagcttttaagataattactcaacaatcctgacacctgatttttttacaggcttgacgacattgtaatgaagtccattctacttagaatttcagtaacaaaatcttctggaactgccttccccgattacagttcctgtttatcccccaaacacccaatttgcccccatccctcctccttcttccctgcttagtggtagagcatgcccacacctcccttcctctttggaacggatgagacacggccagccctggttttccttcaatcagcagtgtggaagcagatcatcctagctcttaaaggctctctccctggccagcagacatatctcaaactgactgaacgctcttcttccagaatgtgctaaggactgtctgacattcttccttaaggctgaaccattattcatttttgagagtcctggaatttggaagataaactccctcctactctagcttttgggactcctttctatttggccactcagtagtataactgtacaaaagaaataaacagctaaagttgagtggctttttctgagtcacttcacaggttcaataaagatgcatcattccatgtcttcctccatttgggctgctgtaacaaaatatcatagatggatggcttataaacaacagacatttatttatcacaattccaaaggctagaagtcccacatcaaggcactggcagacttcatgtctggtgagggcccatttcctggttcatagacagtgtcttcttgctgtgtcctcacatggcagaagaattgaggggatctctggggtctcctttagaagggcactaatcccattgaggggccccacccttgtgacctcatgtaacccaaattacctcccaaaggcctcacctctatcaaaatgggggttagattttttttttttttttgagacgaagtctcactgtctcctagtctggagtgcagtaatgcaatctcagctcactataacctccacctcctgggttcaagcaattctcgtgtctcagccccctgagtagctgggattacaggcacgtgccaccacacttggctgatttttgtatgtgtgtgtatttttagtagagatggggattcaccatgttgcccaggctggtctcaaactcctgacctcatgatctgcccacctcagcctcccaaagtgctgggattacaggcatgagccaccgcgcccaggcgggggttagattttaacacagtcagtctacagcatgcggttttcttttcttttttgtggggggacagagtctcgctctgttgcccaggctggagtgcagtggcacgatctcggctcattgcaacctccgcctcccgggttcacaccattctcctgcctcatcctcccaagtatctggctctacaggcgcccgccaccacgcccggctaatttttttgcatttttagtagagatggggtttcaccgtgttagccaggatgatctcaatctcctgacctcatgatccgcctgcctcagcctcccaaagtgctgggattataggcgtgagccaccgtgcccagcccatgcctttttcttattcattgtgaagactgaaaacagacgaataacttgctttatgtcagtatctttatttccctgtcagtgtattcaatgacacagaaaatacttgattccataaatgctcccacagaaaaacacttcatgcaaaccttcctctccatgtcttctgtccattggagaacccaaactaaagaatgtctcacacgtagttctgcacattccttcccattagcctagttgtttcagatgaaaatttagaagacagtgtaggaggcgggagaagccaagaaggaaggaatctgcatttgaagaagggtcatatgcataatcacgaatagctatttggatttgataaagaactgctattgtgtttggatatacagaaaataaatgtttggaaatatagaatatacacacccaaacatatatacacacacatgttggacacatattggactttgttacaacagctacctatacctttactgatacagatctcactacttgccaggcacctggttctaggcccattaagaactgtctcagtgacctcagtggggcccctcatcaatggctgccatctaggttgagcactctcggctgagttcccagtttctgtcattcacggtccttcctcttcagggatgcagccaccttgcagaatgctataggggcgtcaggcactggccttgacatcgaagcctctgtcttcttgctctccatctctttgagttggaccactctcttctgcttaggaagtaccaggctctctgctccctctttttcccaaaccaaaccaaaccaatgtgtttttactgccgatggataggcctgccacttagaacagaaacataccttagcttcagatcctgttgtcatatgagtttgtaggttctaattgaatataaaaattcaaatttcttttacataaagtatctctctctctcttttttttttttttgatggagtctagccctgtcgccaaggctggagtgcagtggtgtgatctcggctcactgcaatctctgcctcgtgggttcaagcgattctcctgcctcagcctcctgagtagctgggactacaggtgcgaccctttacacctggctaatttttgtatttttagtagagacggggtttcaccatgttgcccaggctggtctcaaactcctgacctcaggtgatccaaccaccttggccttccaaagtgctgggattacaggtgtgagccaccgcactgggcctatctcatgtttttttgttttcagctaattattattactttagaatcactgtgtgagctagatgagagacatcttcatattttaagcaattgcagtttctggcttagcgcctccattcattcagcaaacagctttttagccctggtttgtgccaggtgctgctccaagtgctaaggatatggcatggcacaaggtgcatgtgacccccagtcttgcagcgttgatgtttagcattataatacaataattggctgaacttgaggttttaagagatgagggtgatgttaagagatttatcttttcactgtttccagttcctattgtagcagtaggaacaagaaaagtatgaatatctcaacagttaatcctgttatatgtagctataaggacattgctacaattaatagatagcttagaaatagcaggagaaaggacgggcatggtggctcccgcctgtaatcccccagcactttgggaggctgaggccggaggatcacgaggtcaggagatcaagaccatcctggataacacattgaaaccctgtctctaataaaaatacaaaaaatagccgggcatggtggcgggcacctgtaggcccagctactcgggaggctgaggcaggagaatggcgtgaacctgggaggtgaagcttgcagtgagccgagatcgtgccactgcactccaacctgggagatggagcgagactccatctcaaaaagaaaaaaaaaaccaccaccacaacaaaaaacaacaaaaaacaaaacaaacaaaatacaaaaattagccgggtgtggtggcggacacctgtagtcccagatacttgggaggctgaggcaggagaatagcttgaacctgggaggcagaggttgcagtgagctgagatcgcaccactgcactccagcctggtgacagagcaacactctatctcaaaaaaaaaaagaaaagaaagaaaagaaatagctggagaaagcagaactgatgtgagaaacaatagattctagaaactaaatctaaatttgcaataattgctgcaatttattgagcaagtacatattagatggctaagtttatatacactctcatcataacagcagctctaaaaaactggaattattatgctcattttacacatgataaaactaaggtgtagaaaggttaagtggcttgcccaagggtacatagctaatagaaggacatttaaaatcaaggttttttttttctttttctttttaaattttattttagattcaggagtgcatgagcagatttgttacaagggtatattgtgtgatgttgaggtttgggctgctattgatcaagtcacccaaatagtaaacatagttcctgatagaaagtgctgtagcctttgttctcttcccttcctctctctcctcttttggtgttgccagtgtctaccgtttccatctttttcatctttttttttttttttgagacagagtcttactctgtcactcaggctagagtgcagtggcgcgatctcggctcactgcaacctctgcctcccgggttcaggcaattccctgcctcagcctcctgagtagctgggactacaggcacctgtcaccacgcctggctaatttttgtatttttagtaaagacggggtttcactatgttagccaggctggtcttgaactcctgacctcgtgatccacccgtgttggcctcccaaaatgctgggattacaggcatgagccaccgtgcctggcctactgtttccatctttatggatgtgtatacccaaggtttagccccacctataagtaagaacgtaagatatttggtaaaattcaagttctacatgcatgttcttttctaaacattgctaccctgaagaataaactgagaacttttatcagaattgagtctaagctgacacacaacatatcactagagaggtcctctcacgtttccatgataccattttcctaccatcatggtgggcctgatggacattgacttataagccagagagtccttccagtttggattgcacattatttttctagctcagagaccggcaaattacggctgcaggccaaatccaaccctctgcttatttgtatattgcctctgaactaagaacatttttaaatggttgaaaaaaatttcaaaagagtaagtttttttttttttgagatggagtctcgatctgttgcccaggctggagtgcagtggcgcgatctcggctcaccgcaatctccgcctctcaggttcaagagatttccggctaatttttgtatttttagtagagacaaggtttcaccatgttggccaggctggtctttaactcctgacttcaagtgatccacccgcgttggtctcacaatgtactattattacaggcatgagccactgcgcccggcccaagttaggtaatttttgattcggctttataggcaggaaaatgagactcagagaattataatgccctgctcaaagacacacaaagtagtaagtggtagaaaaggaggtttaagactagatctgtttttatagaaataaatacaaagcaaaaccaaatcactttgtaccgtaatatgtcatagttcatgaacaaaaggcactgtgtgcagaagccttatgtgcagaactccattccaaatagataatcttttttccttcctctattgttagaatcaggaagattttttgtaatttaagatactgtgtttctccctataacccactccattggcagcactgtggctaaccctgtttctcatggctccttctacctttaacaaaatttaaaacaggtaattgtgctgttaattggggcttgggggatgttacccttccttcctctggaagggttcaatgttcaaaggcatctagtcattatttagtggtgaggtaatgtctctagaatttggaagtgaagctcaaacagaaagaaacagcaggactggacgggcttccaaagagtgacttattttaaagagaccgattcatcttttactaattggagatacctagttccaattaatttaaggtagtgcctcatcaaaatatgaccaaagtaaaaagaatattttgcaactccatcaagttcattgtaaactttcttaagaaaaaaaagttttggccgggcacggtggctcaagcctgtaatcccagcactttgggaggccgaggagggtggatcacgaggtcaggagatcgagaccatcttggctaacacggtgaaaccccgtctctaccaaaaatacaaaaatttagccgggtgtggtggcgggcgcctgtagtcccagctactcgggaggctgaggcaggagaatggcgtgaacccgggaggcggagcttgcagtgagccgagatcgcgcccctgcactccggcctgggcaacagagagactccgtctcaaaaaaaaaaaaaaaagaaaagaaaaaaagaaaagaaaagaaaagaaaagaaaggaaaaaaaaagttttaatctaatgccatgtacacggagaacggaagcttaaagcaaagatttagaaggggctaatttgtatctattcagggtaggcacagaagttttttggtaaggtgcattacttttggcagagctgtatattttcttttgtgggagaagggagaagttttttttttcttttctaattcaaatttcaccatggcatgagctcaatattcttcaagacaaaagaatcttgaggtcttgcttctcactgcatagaaagccaatcacagagatgatgtgtactgccagggaagaaggcattttgggtgttgcagctgaaaagatggtagatcagttttaaatccacctccctagctgactaaaatgaggggtttatatagcagggaagaaatggaaaacaggaattcgggtggggtaaggaagaggagttggttgacaggcagcaggtgatcagttagacaatcgtgatgggtgaggggtctggcatctcatcgtccagaggctgtgatgtggtgagtttcagcttctttgaccaggaggcctgatggttggtttcctgttaaaggaactcaggtaagacaaatgtacctttttcaagtttcaagactgggagggaaaatttctacattgtattagtcagggttccctagagtgacagacagacacggttctctaagttcatatatatatgaacttatatatataggagtttattaagtattaactcatatggtcacagtgtcccacaataggccctctgcaggctgaggaacaaggagagccagtccaggttccaaaactgaagaactcagagtccgatgtttgagggcaggaagcgtccagtatgggagaaagatgtaggctgggaggctaggcccgtctctcttttcacattttctgcctgcttatattctagcaaccctggtagctgattagatgatgcccaggcagtttaagggtgggtccaccttccccagcccactgacttcagatgtcaatctcctttggcaacaccctcacagacacaaccaggatcaatactttgtatccttcgatccaatcaagttgacactcagtattaaccatcacatatgtttacacaaaagtaaccataaacttcaattatatgggacaactgggtcagtttcatttctaccttcgttttctcagagcccatgttgattaatgaatattttgaagatgaattccatttctacagtacactgagtacaatggagagtagaagaaatcagtattcaagtagctgcaaattgatgactttgcattccggtttaactctagcagttgactagagtagcctgtcttaatgagtttattcaatgctatgttccctgagaacatgtttgctgtttgggtagtccctgatctgcagggaatcagctcacaaaggagtggccaacaagtgaggtgggagggtgcggtcagggttgactgtgaggttccctccgtggcaactttgcagcctcgacaatactttttttttctttttttaataacgttttgcttttttggttcacatacttctttcgtgttgccatgtttaaacattgacaacactgctgaccaatttatttaacaggtccatattctaaattcattgaggaacatgacaaaaatgtggatcctactaattagtattttgttccaccactgataaaatatttagcagatacactaatctaatctccgttcttaatgttggctttagaggaaacaaaatcatgtcttaataataaagagaaagctggatggaaagtaagaataatcagcttgcattctgcatttccctttgaagtgaaaccagagaggtagaagagtttcagttgcgttgcttacatcaatagatcaaccatttaaacagaagcgtaactaaccgcaaatgcttaaagatttggcgtcattccaaagttgagtttttgttgttgttgttgttttttgtttgtttgtttttttcttgagacagaatctcgctctattgcccaggctggagtgcaatggtgggatctatgctcactgcaacctccgcctcccaggttcaagtgattctcctgcctcagcctcctgagtagctgagattacaggtacctgccaccacgccaggctaattttttttttttgtatttttagtagagacaggttttcgccttgttggccaggcttgtctcaaactcctgacctcaagtgatccacccgccttggcctcccacagtgctgggattacagtcgtgagccaccgcgcccggccagttgagttctttagatcattgtattttgaaccattcatataaacttgtttttaatgagagatgacctccttgatcttcctacagcctcacaggatgggactacagtctacattgagaggctcacctcaggaagatctagctactggtagaggtcatcagtcttgttaataagctgactattggcctctctttggtgtgacatcctggcacccttgatatctacagaaagaaatcagtgctggcattcaatgtaaatctccaaaggggcttaattggactttttcaggttaagataaaatgttcaatttttagcttaaagatgattctgggaccataaacatgccagatttgagttcagttaaggtaattatgtgggcaaaaataaaagtgcaattaggttgttctagccttaactaagtgcaattatcaagaacactaacctggagaaaataggttcattctttacattttactaagcttcccaggtttgctgtttctattttcacctgtcagtgggggtagaactatccaagacacttccaaacactaattccagatagtctttcttttacaaaaaacagtgttaaaaagtttttaaaaagaaagtaaaggaagatagctttcttaggtattctgtctcttttttgtaaacaatgaaaaaaatgagagaatttttgggtgtattttgagtactattcgttgaattgataatgtagtcagaatgtagaaaagaaaacatgaattataatttaaaagtttgactgttttggtcaggctgattgtttctagttaattactgataaatcagttgctttctcacacaacaaattctatctaatcattaaaacatccctagtgtctggaacacaagatgattcgtctgatcactttggttcttataatgaacacatgaagttgagtttatggcaagctctggactgtggcagcgactggcaagattaaaacaggagcctggcaattttcgtttacaaaatacaaaataatatccatttcagaattgtcagtttagcaaggtttctagtttaataaaatgaaaatatttattggcaaaaatatttggatttgttaaaaatctgagaattgtctaatctttcatggcaggtgatcaatgcatggaagaggatagagctcttcatcctagttcttctccaggttccaacctgagtctttgttcatgtgtaaacatgctatacaccaactcagcccactataaatatgctatatcatgaactgtttcatcaaggagttcctttaatccaacaatttcaaggactctttaaaaaaatttttttttttttgaaatggagtctcactctcttgcccaggctggagtgcaggggcgcgatctctgttcactgcaagctccgcctcccgggttcacttcattctcctgcctcagcctcccaagtagctgagactacaggcacctgcaaccacgcccagctaattttttgtatttttagtagagatggggtttcactgtgttagccaggatggtttcaatctcctgaccttgtgatcctcccgcctcggactcccaaagtgctgggattacaggtgtgagccaccgagcctggccttaaaaaaaactttttttttaagagatggggtcttgctatattgcccaggctggtctccaactcctgttcgaagccatcctccttctttggcctctcaaaatgttgggattatacacatgagtcaacatgcctggccccagggagcctttttaaaagaataaatatgtatgtgtatattttcttcaaatattaaatttggaaacaaatgtatcatacttttttccagtggagtttatttgcctaaatataggaagtaagactaagaagctaaactgttacttctagactgcattcaggaaatttgtttttccccaaaatttttattcattttactattttttggatgttatgaaattttttttctactgaatcggcggaatcaactggatttactaagttaaaaaaacagtaattttcaattagccatacactgtatatctaatttcatgttattgttgtatttaattcatgcaaccttcttagaaggtaaatgtcactgcagttttcattttgcagagaaaaaaatgaaagttagtgaacttgcctaatgctgggcaactatgaagtggctgaagccgtgtgtctttatttctaagttaatagcagaatatgtatagttaatggtttgagcactggtgttagacacatttggaattgaattctgtttccatcatttacttctctagatacttaattttacttttctgaattagaaagatacttaaatttacttttctaactcttggtgtgttcatctctaaaagatatagtaataatattgcctcctaggatacattcacgaggtttcaatgggataatgcaaacaatgcttttagtgctgtgcctggaaatttttagattttaaattttcaaaaagtatttatattattacaggcataaagtaagccaaaatttagcccaggggaggtacttgacgttttaaattagtttttgtattcttagcctggatacatgtatgtaaacccaagtttgattgtttgtttaataaaaaataaataaagaaagaaattcttaagactcctggaatcttgagcttcaaggctggaagtgttttccaagagcaaaaggttgatcagttacttcacgtcctggcttcttaaatattactaacatttcaacaccagaatgagaaggagaaagtgagggaaggaaggagtgaggcagagtgtagagtatgctggtgatagtatgcccagagagataacatttgcaatgggactttacaaacctcagctttacacagttagcctttgtgtaggatacattctaaggagaaatcctatgagatgtttcagattaaactgtagattccaaaataaaaacaattgggccgggcgcagtggctcacgcctgtaatcccagcactttgggaggccgggacaggcggatcacctgaggccagtagtttgagaccagtctggccaacatggtgaaaaaaaaaagattgtgtctgttgaaggaactcaataaatgcttcctaaacggtgtcacatgaacagttttaatttctcactcattaagagcaggactgtcctggggtctgaggtgaggctgagcttattaaaggggacaaagtcattacctattatggaggagataactctaaggacagggtacgaaaagccatagagtcccagttttcatgaatgcactcaaaaacctgaaaaattatgaaagacagggagaaagtcattcaaatacctctgagcaaggaagagtcaactccacactgaaacccgcgatggctgtcacatttcatggtgaagtacgaagcgggtaactgcctagacagagtgaggccagttggtcctccaggtgaggggcctgagtgccaaggaaacccttgcttctgacaatatccaagtgtttcctggttcctccatggttggcattttcaggcagaagtgcctgtggaaagttaatgtgtctacttagttactcagttttcttctcttttttcttttctttctttctttcttttttttttttttttttttttttttttttgagacagagtcttgctctgtcccccaggctggagtgcagttgtgtgatctcagctcactgcactctcaacctgccaggctcaagcaattctcccacctcagcctcctgagtagctgggactgcaggtgcactccaccatgccaggctaacttttctattttttgtggagacggagttttgccatgttgcccagactaatctagacctcctggacgtggtggcacatgcctgtagtcccagctacttgggagactgaggcaggagaatcacttgtacctgggaggcagaggttgcagtgagctgagatcgcgccactgcactccggcctggtgacagagcaagactccgtctcagaaaaaaaaaaaaaaaaaagattgtgtctgttgaaggaacttaagtgatcctattgccttggcctcccaaagtgtgggattacaggcgtgagccacagtgcccggcctagttactcggttttctaggagaagtgtcttagggactgatgtggcttcgacctgttgcttagaaaaggacaagcctgtcagaaatacatatccctgtggaagaaattagaacatattagaaacaaaacctctgccaaatatgcaaactttgcttcaatacttcatttgatttgaacaatggaagtgaaacttaccttggacaaaatcaagggaactttacacccttgtcttccctcttttcacgtactttcccctctgcatttggtggggaaagtcattcgcctggacgaactcttcagaccttcagatttacgtctttaacacctgcctatcaactgcatgattttctgtctttttctgacctggaaaagaaaaaaaagattttcttctccagaccacatggcaaagtctttctgattatccgttggtccttaatataacatgaaggcaactgtcaatttttttttttatactttaagttctgggatacatgtgcataacatgcatgcttgttacataggtatacatgtgccatggtgtttgctacacccatcagcccgtcatctacattaggtatttctcctaatgttctccctcccttttccctccaccgcctgacaggccctggtgtgtgatgttcccctctctgggcccatatgtctctctgttcaactcccacttgtgagtgagaatgtgtggtgtttggttttcggttcctgtgttagtgtgctgagaatgatggtttccagcttcatccatgtccctgcaaagaacatgaactcattcttttttatggctgcgtagtattccatggtgtatatgtgccacattttcttaatccagtctgtcattgatgggcatttgggttggttccaagtctttgctattgtgaacagtgctgcagtaaacatacgtgtgcatgtgtctttatagtagaatgatttataatcctttgggtatatacccagtgatgggattgctgggtcaaacggtatttcttgttctagatccttgaggaatcaccacactgttttccacaatgaccgaactaatttacactcccaccaacagtgtgaaagcattcctatttctccacaacctcttcagcatctgttatttcctgactttttgttgttgttgttgtttttgagacggagtcttcctctgtcgcccaggcttgagtacaatggttcgatcttggctcactgcaacctctgcctcccagttcaagcgattctcctgcctcagcctcccgagtagcgggaattacaggcacttaccatcacggctggctaatttttgtatttttagtagagatggggtttcaccatgttggccaggctgatctcgaactcctgacctcttgatccgcccacctgagcctcccaaagtgttgggattacaggtgtgagccaccgctccctgcctgtttcctgactttttaatgatcaccattctaactggcgtgagatggtatctcattgtggttttgatttgcatttctctaatgaccagagatgatgagctttttttcatatgtttgttggctgcataaatgtcttcctttgaaaagtgtctattcatatcctttgcccactttttgatgtttttttgttgttgttttctaaatttgtttcagttccctgtagattctgggtattagcccattgtcagatggatagattgcaaaaattttctcccattctgtacgttgcctgttcactctgatgatagtttcttttgctgtgcagaagctctttagtttaattagatcccatttgtctattttggcttttgttgcaattgcttttggtgttttagtcatgaagtctttgcccatgcctatgtcctgaatggtattgcctaggttttattctaggatttttatgatttttagatcctatatttaagtctttaatctgcagcaattgtcagttttatttattcactgcttatctgtattttctaaagttgcaaggaaaaaaatagtatttatttttaaacttttgttaaaattatttatttatttatgtgggccaatagagtttattaacctattgatctctgaggaaaaaatggatatagtgatttgattatatggttatttgaaatctttactgaagaaaagtcacaaattcttctatttgaagttaaatatgaagcttctacaagtgactggacaaccttgtttatttgtacctgtttagtactttccacaagtaacattttatctgtaatgctaccaagattttttaaaataaataacaactctattttgaaggaatctaaaatttacatggagaagcaagaacttttctataatattttgtgatatcgaatttaatttcaggaaggtaatccatttgcaattcatactcaagaacaggacagaccagaagcatatagtacagctcaattgtaattttccaaatgttaatttcatgttgtttcttcctttgatttttattctctttaaaatatttttcattataattctcaattcaatagatgcctacttatgcagcgctaacatattttcaactttcatttacacattctacagatatgcattaaacacctactgtatgcgaatcactgggtgaagaactgccaagcagtgaaccagcctggcaggtttgtctgctctcgggcagccttcgttctaccaattgagcattggataagaaactgtgatgctctgaggtacaaagaggactcaggtgtccctaatccagtcttcaggacaggcaccctaaaggaaatggccttcacactgggaaaatggagcatgagcaagagatagcaaagccagcaggggtggggttggagaagacatctcagacagaacagcacaggcagagaacagtctacagccttacaggacacattagtttcaagcctttaacttggggaaaaacagatgctattgaaagttttcatcatgggagtgacacgcagggctgctgcatgttaccacacacattacaacatgcatgttacaacaccttattgtacacaggatggtacctgggatgcatgaagaagagtacctcatttaagtgagtgctactcacattgtggacatctgatatttatatatttattagagtggttttctggtagatggagataaaatggcttgttctaacaaaataagtatcttctgacaattttttgacagatggaagtaaattgtcttgaggaaagggccttttaaaaatttatacaaaggcagtggatccggctagcagcagactctggctgtaaccgtttgcattttaaaatacccctctcatgaacatttggagagtaaatcaggagaaggaggtggctgtgggatgccatttaggaggctcttgtgttgtctgtgtgaggcatgatggtggtttggactaggatggtgacataaggtgaaagacaagtagacgtgagagatatttagtgaggaaaatcaacaggccttgacagttgaacagatgtaggttagagattcctagatttctggctcttaatttatcaatttcacttgtgattttaatagaaattaatcatctagctctcagatgtctagctactctcctgacaagccaagggactcccttaacaagacctgatttctttattcaaggttgaaatgcatctcttggtattctgcttcagtcagctttggccttttttggctgccgaaacaatcgaaaactgttatgcagttggtgtctgttataatcctcagtttgcattggactgtcctattttttcatttctccagctgctgaatagctgaattccttatgattacatcctccccctctctagtgctctctagaagcttaagctcaggattttccatggaaattcatttagttatttcctcttcattatcatacactcttcaattcaactcttttgaatttttcttctgttctctgatgagtttatgctttctaacttggtcatggctgaaaatatcattaacctgctgctgttttctgtatttgtcattaataacaacgttggaaatttggtttgactcccaccctgaggagctaggcagtgggcatgcacacgcgcacacacacacacacacacacactcacacacacacacacacactcactccagctcaaatgctttgcaattggaaacaccattcctcttcaggcctttgtaagaattattatgagtgttgatagcaattcaattctgattaagtttattaaaaagtaaccaacatctcatgtacattcaaaagtgttccctcttccattaattatataattgagcaaaaagttattttatctaaaatgtttaaagcctggccactttactatgcttctttttcgataacttaaacataccaatttctctatataataatttttaatcatttgactttgaggattctactttaatggaaaataggaaaaatggatgtcataatacattctcagtagggacttatcagcaaacagaaacaatctacaaatttcatggaggagtttgatggtggttacatttgccacaagacatggtggtttccgatgcccagatgatgacctgccctcgaccactgcagatttagtgtgttctttgctccattagcagcagggactatgggaaagacatttcaataagattagaaaacaaaaaaacagggtggggcctttggttaacacatggttaacagactattcaaggagaagataacagcataactgaagtatttcaggtaatcgggattttaactgcactcaactcaccatggtgaactcgcccttagaaaacacttttcagctatgggtgatgacgacttttcaattttcttcctcttattttccttgatgtctaccttctgtgcatatggtcattaaggaatgccaaaaggtgatgtaagaaaagtagaagaaaatgacattattgtatggcattctctacaaagaaatatgggcagtggaggaataattgtctcatataactttgggattatatgtaaatttctattactaattgctgtctaactttcatttatataaatttctgcatctactgtattttaactacacaaattaatatactttcaaaagattactgagttctgtttctcctttcaacattcaagatgttgggtttttgtacagtggggtcctctgcaatattggcttgcaagaaaaagtgaccacgttagagcattcctaacagtgcatggagaaatgacacaaggcaatatgctagcgcacaaacattgtcagtgtttccaactctagtcaggtactataaggtagacagctcaattgaagactatgatgggggtttgtgctatcagatgtcagaaagatattcttgtaggaagaaaagaacaaacttttttaaagtagcatctctcaatattattctgagtaaatggttccaagaaagcagaaacaagtttattacataggagcttcaggactaaatggaaatccaggctcagggcttgcaggaagagggttagaagccagaggctcagaacccagttgagaaggtggagcaggaggagcaaaaggaagtcatcaagtgaaaagacacagtgggagtcagaaaataccaaaaccaatagccaggtctttgggagcttcaagagcagtgatatacacataatcaaagactaggtcttaagagtcacaaccactgaaggatatttaagaaagagattttaaaaggttcctcaggaaacgttgttgagtgcctgtggtggggttccactaatgagcttcaagtgtgcatcacacacacacacacattatttttcctaaaaaaggtatcgtagctttcattagattttcaaaggggttaccaacatctcaaagaactaaacccacagtgttgtaaaggccttcttagaagctaaggatacgtatgaatggtatgttgtaaaggtcctcctggaagctaaggatatgtatgaatggtcattaaattatgatatctgggagcaaatacgtgtaccaaaggaagactgacaatcccacattgatgaagaccatcaccagcctccatgtgttggaaatttaactgccaaacaaatgtgtaacactgatgtttctgtatgtgatgaaaatgtctattctgctcacagttaatctctacttctggacactcctgctttctatagaaggtgattagattagaaaaaaagtatctgaatgttgaaagagaaactgggtatcataaaattaattattgaatgttgccaatatcacaaaaatacaaaagataattcaaggctactatgaacacctttatgtgcataaactaggaaacctaaaggagatggataaattcctggaaatacacaaccctcctagattaaccaggaagaaacagaaactctgaacagaccaacaacaagcagcgagattgaaatagtaataaaaaaatttgccaggaggcggaggttgcagtgagccgagatcacaccactgcgctccagcgtgggcggcagagtgagacaccatctcaaaaaaaaaaaaaaaattgccccagggcctgtcgggggcatgggggacaaggggaggggagcattaggacaaatacctaatgcatgcggggcttaaaacctagatgacgggttgataggttgataggtgcagcaaaccaccacggcacttgtatacctatgtaacaaacctgtatgttctgcacaggcatcccagaacttaaagcaaaaaaaaaaaaaaagtatttgacattaaaaaaaaaattgccaacaaaaagaaagtccaggaccagatggattcacagctgaattctatcagacatccaagtaagaactggtaccaacgctattgacactattccacaagacagagaaagagggaatcccctctaaattattctatgaagccaacatcaccctaatatcaaaaccaggaaaggacataacaacaaaaaaagctacagaccaatatccctgatgagcatagatgcaaacattcttgacaaaatactatctaacagaatccaatagcatatcaaaaagataattcatgattatgaaaccatgatcaagtgggtttcataccagggatgcaggggtggtttaacatacacaagtcaataaatgtcggccgggcgcaatggctcatgcctgtaatcccagcactttcggaggccaaggcgggcagatcacgaggtcaggagatcgagaccatcctggctaacacagtgaaaccccgtctctactaaaaatacaaaaaattagctgggcgtgatggcgggcgcctgtagtcccagctactcaggaggctgaggcaggagaacggcgtgaacctgggaggcgcaacttgcagtgagctgagattgcgccactgcactccagcctgggcaacagagcaaggctctgtctcagaaaaagaaaaaaaaagtcatacatcacataaacagaattaaaaacaaaaatcatacgatcatctcaatagatgcagagaaagcatttgacaaaacccagcaaccctttatgattaaaacactcagcaaaattggcatagaagggacatactttaatgtaataaaagtaatctatgacaaacccactgccaacattattctgaatggggaaaagctgaaagcattccccctgagaactagaataagacaaggatgcccactcttacctcttctattcaacatggtactgaaagtcctagccagacaaatcagacaagagaaagaaataaagggcatccaaatcagtaaagaggaagtcaaactttcactgtttgctgatagtacgattgtatacctagaatactataaagacgcctcaaaaaatctcccagaactgatagaaaaaaattcagcaaagtttcaggatacaaaattaatacgcacaaattagtagctctgctacacaccaacagtgaccaagctgagaatcaaatcaataactcaatcctttttacaatagctgtaaaaaaaaaaatacttaggaatatacctaaccagggagatgaaagatctctacaaagaaaactacaaaacattgctgaatgaactcatagagaacacaaacaaatggagacacatcccatgctcatggttgggtagaatcaatattgtaaaaatgaccatctgccaaaagcaatatacaaattcaatgcaactcccatcaaaataccaccatcattcttcacagaactagaaaaaaaatcataaatttcatatggaaccaaaaaagggcctgcatatccaaagcaagattaagcaaagagaacaaatctggtgacactacagtacctgacttcaaactatactataagtccacagacaccaaaagagcatagtactggtgtgaaaataggcacatagaccaatggaacacaatagagaactcagaaataaagccaaatacttatagctaaccaattttcaagaaagcaaacaaaaacataaagtgagaaaaggacaccctattcaacaaatggtgctggaataattggcaagccacaggtaaaagaatgaaattggatcctcatctctcaccttatacaaaaattactcaagatggatcaaagacttaaatctaagacttgaaaccataacaattctagaagataacattagaaaaacccttttagacactgacttaggcaaagactttatgaccaagaacccaaaagcaaatgaaacaaaaacaaagataaacagatggtacttaattaaactaaaagtcttctgcacaacaaaagaagcaatcagcagagtaaacagacaacccacaaagtgggagaaaatctttgcaatctatatatttgacaaaatactaatatccagaatttaggaggaactcaaacaaatcaacaagaaaaaaacaaacaatctcatcaaaaagtgggctaaggacatgaatagacaattctcaaaagaagacatacaaattgccaacaaacatgaaaaaatgctcagtatcactaatgatcaggaaaatacaaattaaacctacaatgtggtactaccttactcccacaagaatggccacaaaaaataaaaaaataataaatgttggtgtgaaagtgatgaaaagggaacactttcacactgctggtgggaatgtaaacaagtacaaccagtatgggaaagtatggtgattccttaaagaattaaaagtagaactaccgtttgacccagcaatcccactactgtgtatctatccagaggaaaagaagtcattataggaaaaaagatacttgtacacacatgtttatagcagcgcaattcacaattgcaaagatatggaaccagtccaaatgcccatcagccaacgagaagataaagaaattgtggtatatgtatacaccatgaaatactactcagccataaaaaggaacaaaataatggcattcatagtgacctgtatggaaatggagaccattattctaagtgaagtagctcaggaatggcaaaccaaacattgtatgttctcactagtaagtgggagctaagctatgaggatataaaggtataagaatgatacagtggggctgggcctggtggttcatgcctgtaatcccagcagtttgggaggccaaggcaggcagatcacctgagatcaggagttcgagaccagcctgaccaacatagtgaaaccctgtctcttctaaaaatacaaatattagctgggagtggtcatgggtgcctgtagtcccagctacttgggaggctgaggcagaagaattgcttgaagccaggaggcagaggttgcagtgagccaaggttgtgccattgcactccagcctgggtgacagagggagactatctcaaaaaaaaaaaaaaaaaaaaagaatgatacagtggactttggggactcggttggagctcggggaagggtgagagtgaggtaagggataaaagactacacacccggtacagtgtacactgcttgcgtgatgggtgcaccaaaatctcggaaatcaccactaaagaactttttttttcttttttgagacggagtttcgctcttgtcgtccaggctagagtgcaatggtgcgatctcggctcaccgcaacctctgcctccagggttcaagcgattctcctgcctcagcctcccgagtagctgggattacaggcatgtgccaccacgccaggctaattttgtatttttagtagagacggggtttctccatgatggccaggcttgtctcgaattgctgacctcaggtgatccacccgcctcggcctcccaaagtgccagattacaggcgtgagccactgcgcctggtccaccaccaaagaacttaaccaagtaccaccagttccccaaaaacctattgaaataaaaaataaataaaattattgtgtgttaaataaatacttctataaacaaatagaaggcatttttgtcagctcagtaagaaataaacacacagacaaaaaaccaatgctgctggctgccatcaagtgactacctgaaatgtcttatagtggcgaagtaaattcacaaatttccattatagggagacatttaatatctgtattttacagacttaactcacataatagcactactaaatgtccctttctattaacatttcagttaaattttcctccaaagtgatatgttcaagtggaggtttcagtaaaattgacacatttggcatataaattaatcatcaggcctaattatgccagtaggtttgttttttaaatcgggaaattggcacaatatatgtataagttgttgccaagacacgtattatatatttgtaatcattgaatattgctctaaattattagtagtgactaatatcagaaataaatttaatagattaccttaattaaatagtatgtatttacaaaacaataagagaaaaaattgtagagatatttagttgcacctgttcaatgattagtttaccaaaaaaactgagatttgaatatgccgagctgtgcatgtaaatgtattatgatgctatgctaatggcttaagagagggaatattcttttaaaaagattattttacatatataacgtaagtatactgaattggaattatatagggaagatggcaaaatataaaacaatttagactaaattatcatcattctgaagtttcacgaggttatagatagaaaatagccatgatttaggtttgtttattccctattttttcattgtttctcactaagatttatttggaaataaatgaaaataatactgaatagatttttatttaaaaccagcaaaattcttttattattatttttttcttaagtcttatcacaccaaagtttaaatgaagggaaaattgaagaagaaagagagataattgatataaatagcacagaagagtagaaagcaagaagactgctttaggctactaattaaaagagacaagataatttgcagtggtgtggattcaagaataaagagaaaaagaatacaacaaattattcttgatgggaattaagactgcttttagtagtaattcttatattagaatgtaagtatgactctaattaaaataatacccacagttgtcaagtagaaatatgcctgtaaaattagcatattgacaagactcgtattttttccaaaatgtacttgtaccattattctccaacagtctaacacatttaatggtatttggaaacctattagaaaaggtgtaagtattgcattccaaaggctatttaaaacctttcccaagagcacacaatttccataagactagataaaaaacttcttatttttacgagtgcattttacctcaatgtaaagcaaatgcaatacactgtctcatgcaacattgttaatttttccaacttaaatcaaagaggctataaggtagataactcaactgaagactgtgatggtggtttgtgctatcagatgtcagaaagatattcctgcagggagaaaagaactaacattctagagtagcagctttcagtgttatctgtgttatctcctcaaaaacctcacaaaatccctgtgaggcagttactgttaccattttacataccaggaaactgagtttcagaaaaaggttatgtaacatttccaaaagttgatctaattagtacatacctggcaaactacagaaacaaccagctattcaaataattgatctttagcaaaatattaaattgtcaaatatctaaacaataacttaaagctacttcagtaattaatttgaaaataattcaacatatttaaaaattttatcttccccattatatatgtaataaagatgattagaataaatttgaaaacaatgaaagaaagaaagaaaaccacagtattgatatgatttaaagaaagcctctcagtatttttgtgagatcctcttcggtgttctttttcttttcattctctgttgttctttctgttctttttgttttctttgtgttaatatttgtggttataatatattatatttatatttaatataaatttaattctgcttccaagctactttaaacctaagtatatgattaactgattctaataatttatcaagtaaatgtaccataaattatttaactcttgaagcatatttaacatttaatggtctcccatgttttgctattataaacaataccaagctgaacaacttgcacataaagtcttttaaacactgtactttagatagatttttcagaagttaaatcactaaatatatttagagcttttgataaatttagtcaaattcctttttaaaaagttaagccaatttatgcaaaagagataaacattcaaatgtttacattacgttagcctgggagcagctccttggctgcagcacctgatgaaagccttcttctttggcaatactcatcgtatcagtactcatcgtatcagtactcatcacatcagtactcatcgcatcaatactcatcacatcagtactcatcgtatcagtactcatcgtatcagtactcatcatatcagtactcatcgcatcagtactcatcatatcagtactcatcgtatcagtactcatcgtatcagtactcatcacatcagtactcatcgcatcaatactcatcgcatcagtactcatcgtatcagtactcatcgtatcagtactcatcacatcagtactcatcgcatcagtactcatcgcatcaatactcatcacatcagtactcatcacatcagtactcatcacatcagtgatgagctttctgtgcagtgagcagcaggacctagatggaacccctggtgtttcagtaacaccaatattccatctctgtcagcaggaagaatttagagaaatgcagaagaattatgcttttgtacttgttcaaacttacccatgaaaacaaaaatagccagggttggttatcttataattaatcttttcttttttctaagtctgaacttcagccaactgcagacagggaaaatgagtctgtgattgctgtatcatccctgaagcaaggcacctaaggatccttactccaacagacaagctttagagcgggcatccatcagcacagatgcaaataaagatcagtgatcaacagagactattaggatgatggaggaaaatgagatctggacaaatatatattgtaaacagcttatttttgctaaggatcagatgacagttaacaccagaacagaacaatgcttaacataattctcaactagcatatatttttgagaaaaaaaaacacattcagcatattcatgtaaggttgcagaaagattcctgaatagggcagacactaatgacatttgctgttaaaactgttccccacaatatgcacacgagaatcccagaatggtacatgaatgaagcccattctttctttttttcttctcctttaaaaaattatgatgaagtatacataacataaaatttactgctttaaccatttatagatgtactatttactggcatgacccattgtttcttgagtatgctaggatgacaccatgtttttaaaaggcacacataagttcctataagaaaagagatgaaagccattatttctgctcagggagatcaaggaaagctcctgagatgctatgacatccaaattgggtcttacagaagaagtaggcgtttctagacaggtaagagaaaatgacacttcacatagaagcccctgagcagtgccagaatcattaaagtgtaggacctgcattttgaggggcagtgagtaattggtctgagtagagcttagactgatattgcattattaataatagggaaatgaatttcacttaaaatttttattttttgaggctctcgcctgtgagacaagagatgcagaatctatttcttacttcatcctgttgccctctcctgaacccatagccacatgtaccttatgagaggaggtggccttaatcagtggcaagcattttctgtaaagagacaggtagtacctgtcttcccgcttcgcacaccatacggtcttggtctttgttgcagctgctcaactctgctgctgtagtgtgaaagctgtcacagacaacctgtagaaaaatgggcaaggggagatgtcacctgcagagtgcactttaccagccctaggactagatcatctctaagataatctcctgcattcatattttagaactctagcattcgtttttttttttttttttttgagacggagtctcgctctgtcgcccaggctggagtgcagtggcgccatctcggctcactgcaagctccgcctcctgggttcacacaattctcctgcctcagcctcctgagtagctgggactacaggctcctgccaccacgcctgtctaattttttgtagttttagtagggacggggtttcaccgtgttagccagatggtctcgatctcctgacctcatgacccacctgcctcagcctcccaaagtgtggggattacaggcgtgagccaccacgcccaccctagatctctgattctatttctattttccaaattgtgttgtttcacatcagcttgattacaaagaagaatatttttggatgaggggatttaaaaaatttacattctattgctcttttccttgcaaagcagtaactgagtgtcttcccttagtctctgcaaacaatcgacgtggacactcagtttctaagttgaaggatatgaattctagattattctctaagaagtcagaacaggaatcacaaagcagctaaagctaatgctctgtagaggaatatggctaaccttactctgggctaatctaggtaatgtgaaatataaattaataataatttacccttgactgtaactacagggattgttttaatggtagatgtgttctcaattattttggttttgtgtggctcaatagcaagggaatgtaactctctggtgtgcgattccatttagtgtccatattaagtcaaacttaagcatgtgtttgaataatgcataacaaatgagaattatcaagaaaaataagattattaatatttctagtccagtaggaactaaagccagcctggaagtggaatgaagacaatgagcccagctcttatcctgcagaatcctgtggaggcataaactaattaaacagttttgctttaataatctttgtatctttctacagggtgaactctcagattgaatagttgcatagaagcagttgggaaatggaagaagcttctcagttgatgaaaaactgtgagatatcagttagcattgtcaatcaaggaaaatttctaaggaaagtctcaattattttaggagatttacctgccaaagttaaggacatgtacctgggagacaggtctatgccgttcttcaaagaggattttgagggcttcaatatttaaagggggaaggatgggatattgagaaatacacaattctcatgtgagggggcagcaggggaaaatagccattcgtgcctttgcctggttcagtgaatctgcttttttttttttttttttttctaattgagatggagtcttcctctgtctctgtcgccaggctggagtgcagtggtgcgatcttggctcactgcaaactccatctcctgggttcaagcgattctcctgcctcagtctcctgagtagctggaatcacaggcatacaccaccacacccggctaatttttgtgtttttagtagagatggggtttcaccatgttggccaggatgatctccatctcttggccttgtgatcctccctcctcggcctcccaaagtgctgggattacaggcacaccgtgctcagccgaatctgtatttttccataagataaggtagacaatagggcagaggaaacaaacagatatgcatttgtctctgctgggcagagggacaactgagttacgtaatgtgtccccacatctgtgaaaacgagctgtcgatttacattgccctggtgaattttaacagaaatgtttagatctcgggaccacaaggaatttccttaagggcaaaatgtgagggaagtatgtagcttttgatctttgtagccatcttttaggaactaaaatgggaggcaggtttgcaggacccagttttcaccttgacttttccctttggcttagtgagtttggggtgctgagtattgacaaagagtcaaactctgtaaaatatttgaagagatttattctgagccaaattcaagtgcccatggcccatgacacagccctcaggaggttctgagaacatgtgcccaaggtggtcggggccagcttggctttctacacttcagggaggcacgaggcttccatcagatacatttaggaaatgcattggtttggtccagaaaggtgcgacaacttgaagcagggacttccagcttataggtagagtaaaacattttctggttgactgtcgagtttatctaaagacctgggatcaatagaaaggaatgtctgggttaagataaaggcttgtggagaccaaagttcttatttgcgggggaagccttcaggcagcaggcttcagagagaataggttgcaaaatgtttcttatcagacatcagacttgaagtctgtgttgctgttagtgctggagaggtagaatgaggcatgtgtgaccagactccccaccatggcctgaaccagtctcaggttaaatttcaagagtgccctggctgacaaggaagtccattcagatggttgggacgaccttagattttatttttggtttactcgagattaatttttctttcacaattataaaacaaagaacactttttaaaaaaatgtaatttttagagctagtttcttaagtctgtgaaggtgtattaaaagatacattaatctcagtttacctagtaagagtgttttcaggaaaaatgcagtttttttgttagtttgttttttgttttttattttttggggggacagagttttgctctgtcgcccaggctggagtgcaatggtgcaatctcagctcactgcaacctccgcctcccaggttcaagtgattctcctgcctcagcttcccgagtagctggaattacaggtgcccgccactaccccctggctaatttttttatttttagtagagatggggtttcaccatgttggccaggctggtctcaaactcctgacctcaagtgatctgcccgtctcagcttcccaaagtcctgggattacaggtgtgagctgccacacctggcaagtaatgtttgtaaatcaacaataaaacacatttttcgattttagtttatgtctctcttcattccgtcctttgtgaggaaaaacgttggtgtatggagacaagttcagggtcggaaccgagagtcagggtgccctgagagccagcccagagagtggcagcacagcttctccttctgtcagaaatggagctggccctgggtacttgacctccgcactagagaccgcattcgcctctgtccctcacaatgagatgacaccatgcaataaggttctctgctgtgaacttcacctcacagtctcaccttactaagtaatgcacgccaggcccacacttctgatacttagaaacactgacggctgagcaaccttagaatcctgggtttaagttgaggaagcgttggtgagcagctagggcctctggctgacttcctggggcagagctgccccatcggcctgagctggttacaacaaaagtcagcaaacttttcttattaagggtcagagggtacatatcagcctttgtgggccattcagtgttgctcacaactcctcttatctgcccttgtgaggcaaaagcaaccatagacaatgtgtaaatgcatgagtgtggttgtgttccaataaaactttattggtgaacacagaaatttgaatttcatatcatttccatgtgttacaaagcagccttgtttttttttcccccaaatttaaaaaatagaaaagtctttttttgtttgtttgtttgagacggagtctctcactcttgtagcccaggctggagcgcagtggcgcgatcttggctcactgcaacctctgtctcccaggttcaagcaattctcctgcctcagcctcccaagtagctgggattacaggcgtgcgccaccgcacccagccacaaaagtcattttcagctcacaggttatgcaggtcatacttggcttatggtctgtagttcaccaaatttcaggttacacaattttgtgggagagaaataaacttctgttttttaaaaataattctgaagtgtcttggtaattagatgaacttagccttaactctaaattttagacgatctctgccatttgtgttagaatccattcattcagatacttctcctttattgccgccagggcatggagggaggatgagctgcacacgtttttctcctttgcttccctcttgcactcctttccttaactactttgattccttgcatggaggtggacctgccaagacatttttaagagcatgctagggacacctcaaggtgtttttataaccatttcaatgagttagaactttttctttttagaagaaatatataaggattatttcttcctcataagttaccaatgaataatttacttactacacatcattatggatggaattgttcccctaaaatttgtattattgaagtcttaacctccaatgagacatatttggagataaagcatttaaagaggtaatttagattaaatgagctcatagtgtggggacctaatttgatagaactgatatcctcataggaagagaaagagaagctgggcatggtggttcaagcctgtaatcccaacactttgggaggccaaggcagaaggattgcttgagcccaggaatttgagaccaaccttggcagcaaggcaaaacttggtctctacaaaaaatgcaaaaaattagccaggcgtggtggcacacgcctgtagtccaaactactaaggaagctgaggtggtaggctcgcttgagcccaggaggtcaaggctgcagtgagccaagatggcaccactgcactgcagcctgggggatagaatgagaccctgcctgaaaaaaaaaagaggaggcaccagagacctctctctctttgcactcacaggggaaaggtcatgtgggaacacagctaggagggagcaatctccaagtgagaaagagggccctcaccaagaaccaagtatgctggcaccggatggtgggtcttccccgccttcagaactgtgagaaatgagaaaatagctttctgttgtctaggtcacaagactgtgtcagactttgttttggcagcctgagcagactaatatattccatatatgggggtgataatagtttgctagtcagccttttttagtaccctttaccttatccttaagcccactagtcaaatagtgtcaacagttttctatatattctttctttggataaaaagaaaacttcatgagcatttttgacatatacctcattgatcagctttgactctcaaaataaactttgaaaaggaacaaaaaggaaacagcagttttgaaagttaggcttttaaaaaactgcaagagccaagcacttgagagaaaatagacttttctgaattccaggtttaaaatagcaagagccagaatttatgttttgaataccaagtctgggtgtatgtcagaaactatggaaggatagaggctacgaagtaaggagaggtttccatgacagagcaaagaaaataggaggatttcctggaacaggagaaggagcttggggattggacgtgggtctgggtagtggaggttttccataggccctcagagaatattttagacataagaggcaaagtgcatgacaggaagtgctgccttttggggaagatgtgactaagctctaagtagcaatggtgggacacagcacacgtggaaagatgctgacatcagcagcagattcactggtattaaaggaggagctcctggctgggcgcggtggctcacgcctgtaatcccagcactttgggaggccgaggcgggcggatcaccaggtcaggagatcgagaccatcctggctaacagggtgaaaccccatctctactaaaaatacaaaaaattagccaggcgtggtggggggcgcctgtagtcccagctactcgggaggctgaggcaggagaatggcaggaacccgggaggcggagcttgcagtgagccgagatcgcgcccctgcactccagcctgggcgacagagccagactccgtctcaaaaaaaaaaaaaaaaaaagaaaagaaagaaagcaaaggaggagctcgtaagcccagtaagactagacatctctgggaaagccaagactgaaggctaggggcctctttcccaatatgtgtgtgtgtttataatctttttgccctcagactaagggaggagaggtgtatctttaagagtgagaatcagttcagatataagtttaagtttttcattgagagaaaccaaaatattacatttaagtatctatgtaagcatctaaattttagagcagggtgactgcattaccttgaagtagtaaagcttcaggtcaatccacataagcagaagctaccctgtgtagaatcagaggaaactgagctcaattatggaaaaattaaaatgttatgtctgcataactaaattgtgactataacgttgactcagctgcagggattggctaatatctataataaaatgaaacaaaacgattgctgcaggtatttatctaaactacttcatgaaacagtcccaataaacttgtcaacagcatgtacccattatagtaactcagatgtgctacaagtttctgaaattctttctgaatcataaaaaagccatattatgttcttggtatgtatatgtattatgttcatggtatgtataccatatgctatggtaagtgaatatttctgtactataatcattgtaaattggtaatacacatatcctgttaggcaggacatttggctacatgtaacattctatttcccaagaactccactaacagaattattttgatagaacccccttaacatttgtaataatataatgtttctttttctcataggggtattcagtttaacaggctcattgatcaattttgatcattccacttttctgttctaacactttcaggggctatcactgcctatgaattttatgaattcctagcccatgcatattggactcactaagacatggctccaatgatcattcaaaattccagatgggctacttattgttccctgataaccctatacatcccgatttgttcttttcctcctactttctccttggaatgccttctccaacctttttagccttctcccaaccccccttgccattcatttcatccatctcaaatgtaccttttccctaaaggatgctcggatctagctttttgaatatgctcgtttcagtatcccataacccgcattttggacttctcttgagacttatcctgttctgtttatattatatttattatgacattttcttatctgtaccccatatggtattctctttgtagtaatgactatgtcttattttttaaaaatctctctcctcatattactgtattgagcatcatctattctgtctatattttttttaaaaaataacagaacaatatagtttaagctgctacaatgtcttcaatctggaaatctgtgtttgctccatgaaagagcactttaaagaaaagacgtgcatgaatttgcatgtgattaatcatatgtcactctgctttcaaatctccttctaggcaagaaaaaagaacagtgaagtgtggaagcttgagagctcagtagggctgcccaaggatatagaaaatgagggagagtgattacagagtaactttccagggatagaagggcccaggatgggggagctcctgctgatggctgagactatgaggacagcctggagagcaggagggagggcatgaacaggaacagagtttaagatatagaggacaactcaaagctacagccccagccctggtgaaaatagagggagaaaagaaaaatacacatatcttaaagatacagttgaaaatagtgtgtgaagtcagtaggagaaattgtatgacaagcaaggagtgtgtgattagtttacctgatagagttgcgattggacactgagctaggttggatgtatagtgggaatagttttgatttttaaacgtacactgcaagtcatctgggtgtaaagcaggttgctatgccgagttccatgcacatagccagttgtcaggcttcatatatgcctataatgggttcccacttcctcacctgtgagagagctgatcaatgggtaaattggtccaagaaactaacaccatttggatacagaaatcacacaaggcactgaaccagaaggagctgctccagatgtgaagcgggctgctaggaaatctgacgcctagcggtgccactgtcactggccgtttgttgttccagaaaaaggccaaaatcctgggagactcttttagatacagcaactgcctaggatagaattgaggctccacaaaggtgttcttcatgtgggaactacaagatcatcagcggagagagccttccaggaaacccgcgtacatcaggctcctcccgttggaggtgaatcctcactccccacaccccccaatgctcccctttatcctggacacagaggggtgctctcaggcttctccctagctctccctgctcaccccatgcttaagagtgaattaaatatgtatgcaaatgtattttgcagattgtacattaaattttaaaatgcaagattttttttttaatcaactttctggctactgggacccagcatattttcactaagagtatcaataatagcatcttcatcttttcttgacaaatagtttggacagttgtgataattttctgatcctccaagcttttattgggatcgacttccttgtctcacctccacgttttcttttttccactatggaccttgtttccattccacactttctctcttcttcttcttcttcttctttttttttttttttttttttttttgacacggagtctcactgtcgcccaggctggagtgcaggggcgcgatctcggctcactgcaagctccgccccccggggttcccgccattctcctgcctcaggggttcccgccattctcctgcctcagcctcccgagtagctggaactacaggcgcccgccaccacgcccggataattttttttgtacttttagtagagacggggtttcaccgtgttagccaggatggtctccatctcctgacctggtgatccgcctgcctcggccccccaaagtgctgggattccaggcgtgagcccccgcgcccggccccccaactccacactttccagtcgctaatgagacattttcctctgcgccccagtgttcagcccccacccccacctacttctactgtcctcgtacttcagcttcaccggagctttccttcgtttaacaggtattttaactcaagtcattccccttctcccttaaaaaaacagaacttggccaaacaaaattggatccaggaaaggcgtgaccgcggatggaggactgtgttacttacctcaactaaggcagaaggtgtttctcatttgcttttctaccattccttcaaactcattctattacgttcccttttcctgccatgacaggcgtcctagttgtccccttaggagttctccgatgtcctgtatgggacccccaacgaaggccatttctcttccatacgaacccttggccatcctcattcctgctctgaaggctgcctgtgctgagcgggtccctgcagggcgactggagcttagcggcgcagcacctgcttgaggcgtgggggccccgccccgcccgggagggcggtcctgctgcctcccccggctcttgccgcccacctttcccatctgctgtcaagactcagcactagcggccgcttcacgaggccccgcaactctggagaacgcagccgacgctctcgagtgtatggaggagccctcaagtttctgcagctcagcacccaagcctggagtgcgctttaaacctgctctgatggaaacaaccccagctccaacagaagcatatatgtgacttgaatttgtggggagcaggggcagtcattgaagctgccgcagaataattactcttgggaattccagtccaggaaagctctctttcaatggaccttctctcagaaatacttcctggtcctctctttcatggcctgaaggtagatgatttggattgatagagacttctgggcttcctctcgctgagtcttgctcagaggaaggggttatttatcttctacatagtcatcaactgagaggacctcagtcaaaacattgaagcaaaagaaaaaagtctcattggacattcttttacatgtgcttccatggcattgtgaacatatggacatagcaatgatcaaagcggtagttttgcatttattgtggccatcatttggctagtgtctgtcttctccactgtgctggaactccatgaaggtcggggccgtctttgttttgctcactacttaattcctaaggtcttacacaaggtctaataggaggcattttaaaattaatgatcagataggccgggtgcggtggctcacgcctgtcatcccagcactttgcaggccgaggcgggcggatcgcgagatcaggagatcgagaccatcctggctaacccattgaaaccccgtctctactaaaaatacaaaaaaaatagccgggtgcggtggcgggcgcctgtagtcccagctactcgggaggctgaggcaggagaacggcgggaacccgggaggcggagcttgcagggagccgagaacacgccaccgcactccagcctgggcgacagagcgagactccgcctcaaaaaaaaaaaaaaagaaaagaaaagaaattcttgtatattgcatgtaagtacggattctctttttatgaactaaaatgaaaacattggatagcctattaacttataattttaacctcttcttagtggtcatttttgttttgtttttaatttttttctttttgtcagaaactgatgaatgctaattagtggtcattattgaggaataagtaaaatatgcatttaattactcattcattcactcagcaaaatcaatgatcacttactactcaggtactgggattatggagataataaaacagctgattcctttcaagcatgtaccacggagtgaatgaaatggacacccaaatacaataaaatgtgaagatctattaggacaaagctatgtgtttgcgagaaacattttctggatgcttacgatattccagcccctttgtgcgcacataatttcttatttgatttttcacaactgtcctgtgagtcatgctttattctctttttcttttcccaatgaaaaaaaactgaggctcagtgaattttaacctcttgaaaaaattggtccattgttcaggcgtaactctgtctgctttcaaagcaaacagttttttgtttatggcacattactgagaactgcagttttaactctctgcgggtggacagcagcacaaaactaattaaggtgcataagtgagaacactaacaataatcataataactgcatctattatttatggagcaactgtgccgtgccaagcatcacgttagctcctttacaaaaataaaccaatctcaccctaaaacaactctaaaccattggtcttagcgttctccttttgtgtaatgggacatcgaggctcctcacattccagtaacttgctcaaagtcatccaggcagtaagagacagagctaggatttgaaatcagttgtgatgatggtaaatctatgctcttaacaattttttaaaaatggctcttctgggattatttggcattaacatgggccagatgaatacagtgtgtttgatggcaggtagaaaatagccttcaggaactttaaaccaggctgcatttcaatgctgaagtttaaaaacttgttttgtttctggctccctatgtactcctgagcttttggtgcccctgaagagatgttttctatcttatattttgtcaggataattcagacaatatttaccaccaatcaacaggtgcagaaaaatccaacagctccctatgggaaacaatggaacattggttagtataaatattaccagcaaggatctcaaaggcctctcatgttcttgttccttcaaccaaaattcattcatccatgggccaatctgatcctaaatttgtaaacaactgtccagtaattaactcactaaaatgaatactattctcaagcaattgcatgcagtttcacaaatgctcttatcatcagttgcccatctctgtgatatctatgagctgttaaggcagtgaaagtggagaagaacatttttcataaacgtgcacatggtgacttacaattcaaggttctaatcaccgcttgaactcttaaaacatcgatttgtctttctaatttagattgtgtgtctcctgagccctgagcacatattctttatgcctggtacagtgccagatccatcagtattacacaaataattaatcttcataatgatagcttgcagaggtagacccgcaattactgaagggcaccttgacatcccagggaaatctgctttgaaaatatatgtgtgtgtggcagataccactgtatatgaaggccaatcatttaattttttaggtcctcagttcctggttgagaaaggaaatagatgctcaactgttggactagaaattcagaaacgtaatcatccatggccctttatattttaaacattcttttaagtttagacaataactttatatttctaggtttcattcactttattctaaggtttgtaatacagaatctgactagattccaatgtataatatttggcgtatctttatgtttcatcccattttggtagactggatattgcacagcaaacattctttcttataaaatggtaccactggcgtagtgttcagggtagcaagagtccagcacagttctttgtccttgtctacttacatctacttacagcacacatggcactctttttttttttttttttgagatggtcttgcccagcccaggctggagtgcagtggtgcaatcttggctcactgcaacccccgcctcctgggttcaagcgattctcctgcctcagcctcctgactagctgggattacaggtgcgcacctccacgcctggctgatttttgtatttttagtagagacagggtttcagcatgttggccaggatggtctggaactcctgacctcctgatccaccagcctcagcctcccaaagtgctgggattaaaggcgtgagccaccatggccagcctcctggcactgtttatatatccagaagcctccagtgggaggacgagggacttgggattcaaatctgtccaccactgcacatgaagcacgtagagcgcccctgtttaatagcttgctcgagtgtacagtgatgtactgtgcagtgagcaggggagaagacacttaacatccccgagcccagttctgtcacctacatcataaaagtactattaacaacttccagcatttaatgagaattagtgcatataagttacttgacaatagagtaactgctcaatcaaggttaattttcttctcttccggttccctctgtctttgcactctctcattctagtagcctcttttcatcggtgcataattccatattatttaaaacaaacattcatcagcggctcatttgtcataaatctggaagaggtgaaattaaagtagttatgtgcatggaaagcccacctttgaagtatttctacctgacccgcatatcccacaactaacttaccactctgtctgaagccacctctgggtgaaggtattaaatgtgcctgttgaaatacaaataccaggagtgggggaaccactctaaagaagtagagatggtctttctccttacagttataatcagttggggaagaaatgttttcaagcttcatacttgattctgagttttctggcataatcacagtgagatatactctcagagtgagtcaccattactgaaaatgtgtcttatcaattagtcgtgccagagagtggagaaaaaagaaaagtaacgttatagaaagccaaaattaaaacagcttctctcgctatatttttcaaaatgttcttaaaggatttcagtatgtcccaagacaatgggttcatggaattccattcaatccatacctgcatgtgcctaccgtgagtgaggctctgaaactggtgttccatgcacaaggccaattcagtctgaataacactgaaggggacagaattaagaggagaatttctgggccacagggtagaaagcgtaagaatggccttgcaatgggcaacctattcagccagggccagcgtgaggacacatacgactctagagggcaggtaggagctgaaagtgaggagagccgaggtctcaccctgaagaggaaaggggaatggaaggtcaactccactaattgagaatattattcagtccaacctcaatacagatttatggtcagtgtcaccctttcctaggaacaggcagcacgctgtggtggaagggtcacagactcggaagaaagcatatctttgatccgtcctaactcagtttctcctaagagacgcagtcttgtgcaatacccttaatctgcctgagcgttagttttcttagctgcaaaatggagtttataattcttgatctgtttcacaaatatgtcataagaataaagaaatatgaactaaaatgttttgacaatgatggattatctaaataccaaccatgcttgtagatgttcttaaagttcatatcaaaggggttaggagaaatgataaaggattactctaggtttgctttttattcaggtatttattcatgtggttgaacatcttaaagccgaagaaagagtaaaatgctggtgaaaactcaggtattattttctgtatcactggatgctagaaatgattactggaaaaaactctttaatgaaacatgctacctgaacactccaggagggagatgagcagaggaaaatgtctttggccttttccccagtgaagcctgatcctttatgacttggctttcatcgatattttgcgcactcaacagagaccctcaaatatgtttattgagaattcactgtgaaaaccgcactcccttaggcactgtgtgaaagggaaagaaaagaaggatgtgagaaagagggatgtttatgcgctttctagagcttctactcagcctggtatgattccaagcagacatttactgtgttacacagatgctatatcaggttctggaagaagttttcctccataaagataacttgcatcctaattgtgttaccatgtcacttaaatagcttctatcagggtcatttctgccagtaaccctcataaggaatcaaggactctctgatgtcagtaaaggcaagatgtcaaggaagctgcaccaactttcttataaggacgggaagagaatatatatctctgcttacccaaagacaaatatttgaacttctttttctgttttctcatcagtggtagaatgctgtgatatttcccttctctttctcttttggccacaccagacaggagaagggaatttaaggaaatgtggagcatagtagttacagggaagatggaaaaagacatgtgttgtttgagtttgtttcaacattgatgaggtgtgttgggcagtatgaagagggagaagagagtgagagcaagaaggaactgtagggaacacaaataggacagaggacagggagaaaaagaagacatgcgtgagattaaaagaaactggccgggcaccgtggctcatgcctgtaaccccagcactttgggaggctgaggtgggcggatcatgaggtcaggagattgagaccatcctggctaacatggtgaaaccccgtctctactaaaaatagaaaaaattagcagagcatggtggcgggcgcctgtagtcccagctactcgggaggctgaggcaggagaatggcctgaacccaggaggcggagcttgcagtgagcggagattgtgccactgcactccagcctgggcaacagagcgagactccgtctcaaaaaaaaaaaaaaaaaaaaaaaaaaaatagaaaagtccctataggcaaggttagcataaggcaaaattgtgaagtacttagtgtgtatcgtccggaacaggtcttttttgctctgcaatccttcacatgctacagaaacattgcagtctcttttatcaggatctagtctatgatttgttatgatctgtcactttgagataaacatgattggtaagtgttaaagtgttactctcccctgtttttcatttcttttattttgttttgccatttttttagggggaggcagatgaatacattttgtgttaaaatttcatgcattgatactatcggggaagtatagacttctaagagaatatctgattgagacagaaaattatgtaatagttcagaacatgaattttgaatttgcctttgggtaagctgatttccctgaggctgtttttttaacgtggaaaatcagagtaataataattgctatctcgtaaatatattttttaaatttctttttaatttttgtccttttttaagtagagacgggttttcaccatgttggccaggctggtctcaaactcctgacctcaagtgatctgcccgcctcggcctcccaaagtgctgggattacaggcgtgagccaccatgcccagcctatttttaaaatttcataaaattttttacactagaaattgttcactatgttgtactattgtcgttattatttttcaactcattttggctatgagcactaaactctaacctgaatatcatagtttcctagtttctgaggcaatttggactaaggcagtttcagaactaacacaagagaatctggaattgtctttataagactgatgtccctgtgtctgaagggaggccacggaagcccagccattccctgacatgcgctccagtttcactcttagagagtaagtaggagtgggcgggctttgtccccagtcctgccacccagcctccttttccctggggtttcctatggaaggagctgcgtgtgtaaagagcaacactcagcgacacatcaaacccagtgtctctctggctggacccgtcctcagcagagcccctagagcgcttctggttccagctgcatttgaaaactggcttttggccgggcgcggtggctcacgcctgtcatcccagcactctgggaggccgaggcgggtggatcacgaggtttggagttcgagaccagcctggctaatatggtgaaaccccgtctctactaaagatacaaaaaattagccgggcgtggtgtccggtgcctgtagtcccagctactcgggaggctgaggcaggagaatcacttgaacctgggaggcggaggttgtagtgagccgagatcgagccactgcactccagcctggcaacagagcgagactctgtctcaaaaaaaaaaaataaataaaaataaataaataataaaactggctttttccaggaggcctgcgtgaggactcttgcttcctcttcactctcttacatctaagatgctggactgaggaggaggctgcggcctgatttgccctcccagccttagctgagaagctggaaagagtggagggagatgaggatttccagcacagcctccacttggcagtccacctttagaggccaggccaggctacagcagggagtctgaggaccaacgggactcagggcagggcctgggttccccggtaagaccaggttgggccatgtactggcaaatgtggtccaacgactgacctaatggaaaaataatttctgtaggcaaaaggtctggccagggtataaggagggacaaaaggaagcggtaggaacatggggaggaagttctctccttataaaaattgtataagatttgaactgttctatctcaacatgtttttgaatgtgtatcattgaaaaacaatggagtcgggtgtggatgctaaaattattttagatagttctttcactgtggcccccattgccccgagaaaatgttccctgagtcccatcaattctaaaaagcactaaacattttgtttaaaaaatagatctggccggtgtggtggctcaggcctgtaatcccagcactctgggaggccaagacgggtggatcacctgaggtcaggagtttgtgaccagcctggacaacatggtgaaaccccgtttctaccaaaaaatacaaaaacttagctgggtgtggtggcgggcaactgtaatcccagctactcaggaggctgaggcaggagggctgcttgaacccaggaggagggggatgcagtgagctgagatcgtgccactgcactccagtctgggtgacagagcaagactccatctcaaaaataaataaataaataaataaaaataaatcgatctgaaaaaaaaattaaggaaatgatgactagaaacttcacaagtgagaagttatttgtccaggagaatcggtgacttactgtatttcttttagttagattgtatcaaggtatgattacaaaaatcaataacaattttatagaaaataaacagagaagcaacaagctaaacctattgagagaacataacttgactgtcattttatgtatataatacagtattatttataaaactgtaatagataagagtcaggtatacagtatacatttcaaagtattaccacagtatttacagttatctataattgtagagttgttaacatgtacttttatctggatttcttaccttaacaaaatacggtcactctatcaatctcagagaaatgtctgtgcaattagtattttggtgttaactttgagtctttataaggtcatatactcatttttcaaaacgaaaagtatttccactgtagaaagatgtctgttgagaaaataaatctcccttcagcacaattttaatttcaaaatgctgcaatacccagaccacaatcctagctagcattaagaaaaatcacatcgtacaaggaattatcactaacaaaggaataaggattttgaaggccgttctcaaggaaagagccgcattgttgagtaggagtaatctcaggggatggctgatatcaaaggaacggtggagtctttctgcttccagtacaggatggagcacaaagcaagattgattgtcatgttttacctgcaatcagggtgagggaaaaaacgaaagggcttttcaagagttgaaggaaaaggctttaaggcagaacaagtggagattagagcttttgtttcacagtgatgtttgctttcatttatacacattcctgatttatacttaataacatgaaagtggctaattttcctattcgtaaaaaatattgctaagtgtgcaaatatgaattactcactgcttctctttaaatgtactcagttaacaggtcaggttttcttttttaattttttttttttgagaccagagtctcactctgtaccccaggctgaagtgcagtggcgcgatcttggctcactgcaaactccgcctcccaggttcaagtgattcttctgcctcagcctcctaagtagctgggattacaggcatgtgcccctacgcccagctaatttttgaatttttagtagagacggggtttcaccatgttggctaggctggtcttgatcccttgacctcgtgatccgcctgcctcggcctccaaaagtgctgggattacaggcgtgaaccactgtgcctggccttaattctttttttttttttaattagcaaacgaaacaatcaacaaggtgaagagacagcccacagaacgggagaaaatatttgcagtttatcgaactgacaagtgattagtaaccagaatatacaaggagtccaaacaactcaaaaacaaaaaaacaaataatctgattttaaaataggcaaaagatctgaacagacatttctcaaaagaagagatacaaatggccaacaggtattaaaaaaaagttcaacatcactaatcatcagagaaattcaaatcaaaataatcatgagctatcatctcatcgcacttaaaatggcttttatcaaaaagacaggcaataagggatgctggcaaggatgtggagaaaggggaaccattgtacactgttggtgggaattaaattagtacaaccactatggagaacggtttggaggttcctcaaaaaactaaaaatagacctaccatatgatccagcaatcccaccgggtatatacacaaaagaaaagcaatcagtctattgaagaggtgtctgcatttccatgtttattgcagcactgttcacaatagccaagatgtggaatcaatctaagtgtccatcagcagacgaatgggtaaatgaaatgtggtacatatatagagagaatggaatattcttcagccataaaaagaatgaaatcatgtcatttacaacaacgtgaatggaactggaggatattatgtgaagtgatgaaataagccaggcacagaaggacaaatattgcatgttcccactcacgtttgggaagtaaaacaatgatcttacggaaatagagagtagaattgtggttatcagagtctggaagggtagtggtgggggagatgaagaaagaattgttaacaggtacaaaaatacatttagatagaaggaataagatgtaatgttcagtagctcaatagggtaaacatagttaacagtaatttattgtgtatttcaaaataactagaagatgggaattggaatgtttctgacacaaagaaatgataaatgcttgaggtgatgggcatcccattaccctgatttgatcattacgtgttgtatgtgttgtatgcttatatcaaaatttcacatgtaccccaaaatatggacgactatgatgtattcaaaaactaaaaataaaaaaattatgaatacgagcaactagcatctaggcaactgggtctgctctgtttaatgatttcaataattcaacaaatatttattgactaccactcatgtattagacactaagatatttgataatgatacaatggtgaatcaacagataaatgatttatcctgatgcttatacattagtaaggaagattaaaaaaactcgtaatcaagttaagtgtgacaggcatcatgtgcttattggaacatgtagaaggggtttctgtgtccctgcaatcaggacaggtctttctgagtctgaagtatgaatcagagttaggtaaagcagagagggaaggcagtttagtttccttggtacaagacagtgtattaaacactgcagtagagagaattgtaaatgataattctgcacttacagaatttgcaattgagtaaatatgagaatattatctaaatgtactgaatgctcattgtgtgctaggtgttattaaatactttacttgtattgattcctttaatcctcacaacaactctatgaaggagttactgttattgaccatctaaaggtgaggaaacagaggaacagaaataggaagtagcttgcacagatcttcctgatctccctcatagccaatgacaggcctaacataacaaatacaatgacaggcctaacatacaaatacttggcgtctgggtccgaagcatgaacttttttttttttttttttttttttttttttttgagacgaagtcttgctctctcacccaggatggagtgcagtggcacgatctcagcttactgcaacctccacctcccaggttcaagcaattccctgccgcagcctcccaagtagctgggattacaggtgcccgccaccacacccggctaatttttggatttttagtagagacggggtttcaccacgttggccaggctggtcacgaactcctgacctaatgatccacctgcctcggcctcctaaagtgctgggattacaggcgtgagccaccgcacccggcctcaaaaacctgcactcttaagaagcattttagtctaagaaaagattgacatatataattgcagatttacaaataactgcaatgcagtaaattacagttactataagagcatccttatgtcggagctcagtggaatgcctagggcttggtgtgccttagctttttaaggaaaatttgtattattttaattatttttatgtacagaaaactcaacagtgtacatttaaccaagtttagtgggaatttctttagcctttgcctttttgagctttggtgcaggtcttcctgtagactagacatcccagtcttgccttccccttgataatgcagtaagggacccccattttacgacacagggcaggcagaaaggtaaccagctcgatgggatccacgtcgtgtgcaatcaccaccagctgagctttcatgttctccaccaaggtggtgacggtgttaactccggctggaaggacaggtggtctcttagtggggacgtcccctttgccggcagctttcttctcagctggggccaacagcctctgccccttctcttgctttgtctttagtctgtacttgtgggccagcttaagcagctgagtagctgtttggcagtccagggcctgggcgaactggtcaatcgcaggaggcactttcagccgcttacagaggatggctctctgccgctgcaacctgatatagcagggccgtttcacaaggtgggcgaggtctcttttgggttggatgtcctgtccaatgccaaaattcttaggccttttctcaaacaggggattcaccactttcttggcctcctgcttcttcatgaccgcaggggccggagccaccttcttccccttggccttctttcctttcggcatcttgagcggcggaaagagagagacgccctttttctttctttctagactctcgctcccatggacttttggtaggtgcactagatagcacacacggttttcccttgaagcaaggcatttctgtctggttgaaagcacactcacggcctctaaatgcttgtcatgcagtctgcaaacaagatgtttaaaggaagttgaaaactcatgtttctccttgtggaagttcatccctctttctgcacaaggtggactacaagaggtccttctggctggaccaaacttattttcaggaagcagctctgaatctgtagaaaagcttgaacattactagttctcagagtgatgctgcataatacaagaagaggctaccttcatttgatgttcctatgattactgtatgtccgcctctaccgtgataccgacttgctaaggattgctaacatttaggcatacttgcatcgtaacaacttaacagtttaactttgactacaaaggccagtgaagggatcgtctactataattttcaattacgttgaaatgtttccacaataactatctttaaacactttatgtgtctagaaatgcaggttacttggtgaaatctaatctcgatggaaagctttgatgctctgtatcaaatgaaaaccaatttaagccatctatgctgcacattaatattaagcaattatattaactgaaagcactgtgaatacatgaattgctttcattaaaaaaagatttccttaattaccttctaagcaaatattctccactaaactttttaagtatttgcaatactcaaataaaataggtaatggagatgtcaatttacatgaaatacatatttctaaaaatctaacttgcattgcaagtttaaaatatgtttacaaaatccagaattaaatataattttataaggctatttttatttggatactgttatgttattcggagaaaacagtatttcttgtttttcatcctttactagctcaaggcttgtcaggatgccactcatatcatattgtgatgttatgatgtatgcccataccactttctgtctcaaggaaaaggtctgtctcctcttatccacattggccgctgtgcccatctctctggtttccatcttgctggcactaaggtagcccctcatgttcacagagaagaaaggctgaggaggtacatgggttttttgtgaccgcaagcttttcagtgcttgtgtgactctaacttctgtgaaatttcttgattttcctcaagtaggacttcagggattcatggaatataaaagatggagctaaaacagactatttcccacatgttcttaggcttaaatgttgaagtgtaaatgtttaagttgtatttatttatttaggacaaattataattgcatgtaattgtggggtgcacaatgatgttgtgatatatgcccacagtttagaatgattgaatcaagccaatgacatatccatctttttttttttttgacagagtcttgctctgttgcccaggctggggtgcagtggcaggatctcagctcactgcaacctccacttcctgggttcaagtgattctcctgcctcagcctcccaagtagctgggactacaggtgcacaccaccatgcccagataatttttttttttgtattttttaatagagatggggtttcaccatgtttgccaggatggtcttgatctcttgaccttgtgagctggctgcctcagcctcccaaagtgctgggattacaggcgtgagccactgtgcccggctccccattttaaatatatatcatttattcctcctgtttaaagcttaataccctttgaccgacacctctcattttccctaccctccagcctctggtaaccaccgttctaccctctgcttctgtgcatttgactttttaaaattccacatgagtgagatcacagggtatttgtctctgtgcctcacttatttcacttaacatagtgtcctccaggttcatccatgttgtaaatgaaataatttctttctttttctttttttctttcttttttttttaaggctgaagaacattccattgtgtgtatatatctcattttctttttccatttatccattgattgacacttagattgattccatgacttggctattgtaaacaatgctgcaacaaacatggaagtgctgatatctcttagacatattaatttcaagtcctaagggtatatagttagaatagggttgctggaacatatggtaatcctatttttagttttctaagggaactccacactgttttctgtaatggctgtgctaatttatattcccaccagtgtacagtgttcccttttcttcacatcctcaccatcacggttgttatctttcctctttttgttgctagctcttctgatagatgatatatcatagttttaatttctatttccctaatgattagtgatattgagcattatatatatatatatatatatatatatatatatatatgtatatatgttggccatttgcatgtcttattttgaaaaatatttattcagtttctttgcccatttttaaattggattttttttttttgctattaacttttttgagctccttatacatttggggtattagttccttatataatgtattgcttgtaaatttttttctgatctgcagattgtctcttcacttgtagttgttttctttgttgtgcaaatattttttagttaactgtaatcttacttgtctatttttgtttttgttatttgatcttttggaggtcaaataaaaaaaaaaaaaaaaaaacattgcccagaccagtgttgtgtagttttctcctctgtgttttcctagtactttttataatttcaggttttacatttaaatctttaattcattttgggtttatttttgtatactctgtgagatagggtgggactaatattattcgtctgcatgtgaatatctcattttctcattgtcctttatgggagagattgttctttacgcattgtgtgtgttcttggcatttttatcaaagtcaattgacgaagggcatcggttcatttttgtgctctctattctgttccattggtcagtgtttctgtttatactagtgtcatgctgttttaattactatggctttgtaatatagtttgaagtcaggtagtgtaagacctctagctttgttcattttgttcaagactgccttggctagtcaggcttttttgtgtgtgtttctgtatgaattttacgatttttttttctatttccatttgcatgaaatatctttttctgttacttcacttttagtctatttgaatctttaatagtgaggtaagtctcttgtaggtagcatatagttgggttttgtttttatacatcctatttctttgtcaagcttctcattttgtattatttttcatattttatttaatcttctatccttatattcttatagctgactgaacttctttaagagaactatattaattttttgttagttatttcatagctctccatttctttagggcctattgttgaagctttatttgtttcttctggagatgtcattattctgattcttcataatctttgtgtccttacattggtgcttgtgcatttgaagaaatggtcacctcttccgtcctttacaggtattctttggcaaagttatactctcactgaagtctagcctgtgattctaggtcggctacctggtaatggcgctaagcaggtagagcttggcgttagactctctagcttgctgagcctctgcctttgctttgagatcagatggatctgagctcttctatttggtgagaccactggctgggttctgcaatcaggcagagatggtagctgggtcctctgattggatgaagacacaatgtgtattccctagttaaatggtactgctgtttgacttttggaatttgggtagggctgcagattgggtcctaagcttaggctgagtcactgattgggagagtcaggatcagctgctaagtttggcagaaatgcacaatattgaggtttacttccctgcctggatgtagctttggtgtgggatttgaggttgaggtgagctgctatttgaactcccagactggggtggtctagcccctgtatgtagccaagatatgccatggtgggtgtctcactccatgagcagggtcttcttgggtctggttcttgggatggacttttaggttgagccaaactcctcttaaatgcccaggtggtgcaagtatagtccctgtgctttgccaaaatactctgtggtaggtatctctcttctcagcaggaggaagttgggggaagcctgaagctgagcatggaggctgagcatctagggatttaagctagattgatctttccactgtgcttctggggtaaccagcttagctttgcaggtgggctatggtactcccacctatgtggtgctgtttaagaggctactactggtacctctcatcaggtgcctctgctgacagtaatgcagagctaccaccaagatacaagccctgtctactgtgagtaacatctcctttctttgcttgtatttgaccccaggtgacctagtcatgccatgatcccatgtttcccatgaggtgagaacagattgggcttcctgagaggcatcttggagtgctagttaagctggatggccaccttatgttttatttttccactttagaaactgtggaccaggggaatcctctctatgtggcactgtgcccattggggagggggaaggggtagcacagtcagagtgacactgttgttacctgtctgatgtagtttttatgtggttctgtctcaggtttatttacaattttggaatttttgccaagatggtcttgtatagaaatagttgctagttgaccttttttttggaagggaagagctgagatgtcctattctgccatcttgctgatatcattccctttgtttcaaaatttttaatataaagctattccctaggttaattgcttctaaatgtgaaggttgtattatatcaaaagatataaatttggagtcacatcaaaagaaagaagaagagtgagaaaaactactttaaatcaattatgaggtcaaatatgtgctccaaaatattttttttcttttgcaatgtaaggatcaattcagaaaaaagaaaatgtttgcagaggcctttcttaaatgatattttttcttaatttttatcaacgattgctgcttgtgtttagttttattttaaacagctttattgaactatgatcgacatacactaaacttaaacatttgacaaattttgacatatatatatatatatacatatatataaaacatcactatagtaaaaaaatgagaatatccatttcccaaaagttttctcttgcccctggtagtctcttgcacctgacctttcctgccacctctcccttccaaaaacagtatatactccatttttttctggcttcttttatttatgtcattcagaatgaatattttgagatttatccaagttgtagcatgttattaatagtttattgtttttggtgttgtgtggtatttcattgaatggttagaccattgatggatatttgggttgttttcagtttttggctattacacataaggctgctatgaatgtttatatacaagcttttatgtggacagggattttaatatttattgggtaatacttagaaatggaacagctggtaggtatatggtaggtttacatcgaacttaaaaagctgtcaaaatgttttccaaagtggcagtgccacctcacattcccatcagcagtatatgagaatgtatattacaccacatcctctccagcacttgtatggtcagtttaaaaaacacttgtatagtctaataggtgcatggtggtagttcattgtggttttaatttgcacttcttttgtgaccaaagatgtatagcattgtttgtcattgatagatcttctgtggtaaagtccctattcacagctttggaccatgatttcaattgggttttttgttttttttcatattattgaaatttaggagccattcatatattttgggtccatctcctatatcagatatataattttcaaatttttttcagtctgtggtttatattttaattttatttatttaattaatttttggtggggggagacagggtcttgctttgtcacccaggcaggagtgcagtggtgtgatcacaactcaccgaagcctcaacctcccaggctcaggtgatcctcccacctcagcctcccgagtaactgggacctatgcctgcatggctaatgttattattttttgtagagacagggtctcactatgttgctcaggttggtcttcaacacttgggctcaaatgagtctcctaccacggcctcccaaagtgctgggattacaaatttgagccactgtgcctggccttaattttcttaataatttttatttttatgtttttgtttgagatggggtctcactctgtcgcccaggctggagtgcagtggtgtgatctcagctcactgcaagctccgcctcccgggttcaggccattctcctgcctcagcctagctgggactcaggtgcccgccactatgcttggctaattttgtttttgtatttttagtagagacggggtttcactgtgttagccaggatggtctcgatctcctgacctcgtgatccgcccgtcttggcctcccaaagtgctgagattacaggtgtgaaccaccgtgcccggctgaagagcaggagttttatgttttgttaaagtacaatttattactactttcttttatggctcatcattttgtcatctgtaagatattgttaccttatctaagatcaccgaggttttttttttcttttgtttttctggaatttttaagggatttggcttagtctcctggagatggagtgagaacaaagatcctagagaaatagtgatggagttatatttgggtgaggctgcaaagaagattggtgtggggttctggaaagagcaggggtctttttcaaaatgatcataagcagtactctggggatgtgtgaaaaactcagaaagaattcctttgactacttggtgctgtttaagaggctactactggccgggcccagtggctcatgcctgtaatcctagcactttgcggggctgaggcgtgcagatcacctgaggtcaggagtacaagatcatcctggccaacatggtgaaaccctgtctctactaaaaatacaaaaaaattacctgggcatggtggcgcacacctgtaatttcagctactcggaggctgagacaagataaattacttgaacccgggaggcagaggttgcagtgagctgagatcgtgacactgccctccatcctggagatcgagactctgcctttaaaaaaaaaaaaaaaaaaaaaagtggctactcccaaggcctagccattttcggttcccaaagatctatggaaatggcagaactggcaacctttaaggaatcacaaaggctaagaaaacaaacatctcagtcttagttacttaactagcacgaactcagatctgaggatgaggggcctccctgatgggcaggaacttggtttgatcatagagtgccaagaatgagctagaatatcctgctagctttgcaatacgcaaacttggtgccaggttaatgcagaattaatttaaagaaaataacaaaatgcaatatctttcatacctcgtagttacaatattaaaactaatacaccacatactatatagattaattccaagttgcataatttctttatactgttcttctcagaatggtagtctaatctaggtctataattcgtgctgacccacggcagtgacctgaaagagttggcactttcagattttgaatatgttgtctcagagcattttctctccacctttgctaaggacacgtctcccctcagctttccgtgtccgtccctgtttcaggcaaggtgagttaggctcacagtgagctccgccagctgtggctgtgtgtatttgtgtgtctgtgtgttgtagtggtaacagcatcagcagtgtttgttgcagatcagctaactctggtaagaagtttcaaagctggttgttatttactttttcgcttttttttttgttccacctgataattttccaagttaattatttatgctgcagaaaaattataatgcgttatgaaagcaattctgtgctgtatcagctttccattttctcttttgatcaaatatcactatatttcatacatattttttcacaattcgcagtttaggattgcagccacttctcggtttcatgatggatggaagtttagtttctagtttttgtatgtttaaataggtctccataggttttaagaatatgtctgatactattttaacaaatctttagcctctggagtatgtattctgtgtgtgtgccaatactactaagaactcagtttctctttaaaacatatttttatgccctccatccctgctccaccccatcatttttcctgggagcagccaaagccatagacagagtaggaatttaaatgtaatttacaaatgctgtccttctcattcctcctcctgtggtgatttgtcccaggcctcctctcttcctcttctaagtctgaatcaatatcagttaacactgtctcgccaacactcctatgagctccacctcacagattagcagagccttttctcatttcagaggtaacagttgaatgtgaatgagttgaatcaggctgatataggtttctactggattttcacttttccacctataaaaatgagaaaaatgagagacagctgaaaaaggaccaaagactgcctctgaggctgtatgagcaagctgcttatccctgaggctgacactgtttcactgacttcaataagatcaaagatggagttggatttgaaccttggtctctcttatttcgagtacattacattagattttgtatttactgtttccttctgttactctaatggaatatgatacggtcatagactatattaattaagacatacttctcaggtataagtgggtatagtataataatgctactgcttttcagtaagtggatcaatttgacacgggaattcacaatttggccattttataaacagaaattataagggactatcttgcagaaaattttgtccaaaattttgattaaaacaggataacaaaataaatttatacaaataaaacttaggaataaagaaggtgacacgtgaccaaacactgcatcaaatttctgttagcacctttaacacatatatcccgacttctaattttttccaaaaacccacatatttttatttatttatatattttttgagatggagtctcgctctatcacccaggctggagtgcagtggcatgatctcagctcactgcaagctctgcctcccaggttcacgccattctcctgcctcagtctcccgtgtagctgggactacaggtgcccgccaccacgcccggctgattttttgtattttcagtagagacggggtttcaccatgttagccaggatggtctcgatctcctgacctcgtgatcagcctgcctaggcctcccaaagtgctgggattacaggcatgagccaccgcacctggcgtccaatttttttatgaaaggtgattttcatatacagtcacaatacttgggcatttgtatgattattcaacaacttgcaaatgatgctgtcaataattttcaagaagaaacaatgctcttccctaatggaagagttgatctggtatattctaatgatctcactcggaacagtgaaatacttaggagagatcttcttcttggactaaatgtaaagacttttaaaaactccagattatactggttatgactttttaataaatatgactttattagatacattttgaagggacttgtgtcttatagaagtataataaaagagcagtctatcatgcgttttaaaccagttactttgaatatcagcctatggcctttaaagctctgaacagttagaactgagctgtatttctgtaattgaaggactgtccacatggcctagagcacattcaaatgatgctcctaaataagcttccagttatcaccgaggcacatgcaaatgggcagaaatttcacatccaatcattgtacaacaggagaaaattctgcttgtataatagaaatgataaccttgaaatacttgagcactcatctttgaggaaagcagaaagacccgaaacctatcatgtgacgagcccgtgaagcctagaatcacagggcagcattaatttcatgggatctagcgaaagaggatctagatggtcattccaagtcctatgtagcctgtttatcatccccattttacatttaaatgtatgcaataggtgtctttacatgagtagactttaaatataggtaatttataggcacaattctttacaaatatttaaacacaatttctaaaattattcaaggttttatcccattgcacagttagactctatttcagttgaaaaatacacgtcaaattgaaaggtgtgaaattatttttttaagccggtactataaattatatgccagaaatatatggtcactttctctagtcatagcaaatgttcaggtaccaagttaactttttaaaaacttttctagaagatccatggaaatcagctgtcacactgcaacaggactcaggaggcctaatatgtgcattcctgatatattcagctgttttaatataaggtagagtaatacagtagaaaacagactacatatggagtcagaaccatatgcagctttcttcactcagtgtttttaaaatgtttaaaaatgcttaacttttttttttttttttttttttttgagacggagactcgctgtgttgcccagcctggagtgcagtggcgcaatctgggctcactgcaagctccgcctcccgggttcccgccattctcctgcctcagcctcccgagcagctgggactacaggtgcccgccaccacacccggctaataaaaatgtttttaaaaacaaaagtgaaccacctttgttcactcattgtttttaaaactttaggtactatttagtgttttggaactttacctgcttattatctgcaacatgaatttaataatatcataaaaactgcatttaaaaagaagatgcactgaggtgatgagtcatatacaactgtgggcaggcaagattttcttgttccctgtacctcgttaactcattagtgcaggatacagattggataacgtctgctagtgaggaactctgtgttaaaatgcctttccataggtgtcactttctcctgtccctgcagtgccaccacaaaagcccagccagctgatggctttagccaatgtggcagcagggagtgtgaggcttctggctttgctaggactcaggccagctgtctccgtcactgggctcagggtgctccctttagttacaaaatcagaccccgtgttgtggagcctgtgcatgtttgcattgctcttttgagttaaaaatcatttagacctaatgagtttaggataaaggactataaacagcctgtcttatccaagttttctgcaatggagtctgccagctcatgcccagctaacgatgtgtctttgaagccattaggtattttctattatttttttgcacataaatatgctttgtggaccttgtagaaagaggtgactagagactggagcaagattcaggtcttcctggatgccctgctaaatgtcatatgattacattggttaaagtcctaattcttcattaataccaacatatgtgatggtgggttgctttcatgtatttctgatagtaatcattagtgctgtttattattaatatgatcattttatccttgatttcctagtatgctgaagaaaagtatgttattcaatcagctttgtgctaaactatagtatatttggcccttaaaagtcctttgcttgctccccgaatgttgaagtttcttactgttccttccaggtcttctcttttcactttccagcataatctcatctgcttttatggcattaattatctctgcattgattacttctaaattcatatctccatgcttaatattttatttgagattcagttccatattaatgtgtctactggattccccagaggcatcttaatatggataaaaaattcatttttatggccaggcacagtggctcacgcctgtaattccagaactttaggaggccgaggtgggcggatcatgaggtcaggagttcgagaccagcctggccaacatggcaaaaccccgtctgtactaaaaatacgaaaattagcctggtgtggtggcaggctcctgtagtcccagctacttgggaggctgaggcaggagaatcacttgaacccgggaggcggaggttgcagtgagccaaaacggtgccattgcactccagcctgggcaacagagtgagaatctgtcccccgccccaaaaaaatcatttttataaccacctacatttattttacttcccgttttaatgaacgaagtcaatagcattatcgcttgcattttcattcggatccactctgctccattctgtcccgtgtcctcttgttcacctgcaaatccacgtagttgctgagtttcagcctattccatctcagggcagagccactgcttggacttccacggcttcacctcagaccctcatccgatgctgccttggctattccaggaaactgctctctgcttctagtcttatcacagctgggaggcaggttctcagccatgctcgccccctacctggaaacagactcggggctgttgtggggggcacggtgagagtgagaccggccctctgggttgtgtgggatccgcccgatactgccacagctgatgctgtcttgaaagcaccacctcccagcaggagcccaaccagcacacaaatagtgcactaaacaaccaaagctaaggaccctcacagagtccacttcaccctcctgccgcctccaccagagcaggtgctggtatccatggctgggagacccacagatgtttcacatcacaggactctgcagacaaccctctttaccagcccatagcctggcagacttgctgggtggctagacccagaagagaaaaaacaatcactgcagttcggctctcaagaagccacatccctaggaaaagggggagagtactacatcaagggaacacccatgggacaaaagactctgaacaacagccttcagccccagaccttccctctgacacagcctacacaaatgagaaggaaccagaaaaccaactctggtaatatgacaaaacaagtttctttaacaccccccaaaatcacactagctcaccagcaatggatccaaaccaagaagaaatccctgattaacctgaaaagaattcagaaggttagttattaagctaaccagggagggctccagagaaaggcaaagcccaatttaaggaagtaaaaaaaaatgacacaagaaatgagggcagaaactttcaatgaaatagatagcataaataaaaaagaatcaaaacttcaggaaacaatggacacacagaaatgcaaaatgctctggaaagtctcagcagtagactcgaacaagcagaagaaagaacttcagagctcaaagacaaggttttcgaattaacccaatgcaacaaagacaaagaaaaaagaataagaatatatgaacaaagcctccaagaagtctgggattgtgttaaatgaccaaacctaagaaaaatcggtattccagaggaagaagagaaaaataaaagtttggaaaacatatttgggggaataatcgaggaatacttccctgactttgctagagacctggacatccaaatacaagaagcacaaagaacacctgggaaattcaccacaaaaagatgattgcctaggcacatggtcatcaggttatctaacgttaagacaaaggaaagcatcctaagagctgtgaggcaaaacaaacaaacaaacaaaacaaaacaaaacaaaaaaccggaacctataaaggaaaacttaccagattaacagcagatttctcagcagaaaccctacaggcgagaaaagatttgtggccctatcttcagcctccttaaacaaaacaattattagccaagaattttgtatccagcaaatctaagcttcataaatgaaggaaagatacagtccttttcagacaaacaaatgctgagagaatttgccactaccaagccagcactacaagaactgctaaaaggagctctaaatcttgaaacaaatcctggaaacatatcaaaacagaacctgtttaaagcataaatctcacaggacctataaaacaaaaatacaattaacaaaacaaaacgaaaaaccgaggtatacaggcgacaataacacaacgaatggaatgatacctcaagtctcaatactagcattgaatgtaaatggcctaaatgctccacttcaaagatacagaattgcagaacggataagccttcaccaaccatctgctgccttcaagagactcacctaacacataaggactcataaaatctcttgctaatttctcctctcctttgctccccaatcctataccagaaggcaagaatgttaatctcttccttaaaattgccgcttgcttcccatctattcaataaagtccaaattacctatcttacgcgtggtttttagttgtctgttgcctacctaatcctctgacctcatattcccaatgtttatatcattcaccatgacttggaacatttcattccttatattatcccttccctagaccttccctctgattatctcttccatctggacctttcccttcctcaatgggcaatttccattcattatttaaggctcagcttaatttactccgttgtggagctcttccttatcactccctagtcagtcgctccctccccagcactgtctctaggcttgtatcacagcaccacaccacctgctgacttgtcagcctggctcatgataccttgctgcctttaatcaagtctggttcttcaattatgatcacagtgtttgctacatagtagaagataaagaaatacttgtctgttggatgaatggtcaagtagcaatgaactttgcctattctttttcaacataagtaacttacaatacttcttttactctcattgaaggtatttaaaataccttcaccacaattttactctcattgaatgtattttaaaatactttcagttcctcacccttcaacatccatctcagccctcagttctactgcagatgcaactatttttaaggcaactttttagatatattgtaaatactgaaaataaaaaataataactatttaaaatgaagatcattcaggaaaacttactatttcatctgcgtttagttcaatatgccaatttcatgtgctgtatttataaaattattctttaataagcatcactaatatatctatgagaagccattaattactgcctctacaaaaggctagtgtcaaaggtaatgttatctcaaaatctgagatgtttaagttccaaactttgtcaattttttttctgtaatcaagaatccacatgttggatgttttactataaaatattactgagtaacatttaacatggatttaaagctggagccaataaatttattatggtgtaaattagcttctttatagaattttctccaaagttgttcgataacatgagagttggaatgaatggaatgtactcaataactatttttaatctatttagttatgaaggaccaaataaatgggtggatggatttctaggcactgtcttgggagacaaaagataaagagtaactaagctgaatttccttcctttggcaaaggctgtcccttaaacaactggtgtattgtcagaaagtgatttaaactatgttcatgcagcaacaagcatctgttttgtaaataaccaaaacattttgttcaggtggcaaagtggtatcttcaatttagaactgaccagcctttggtgaaatgcttctaattaatctaattgcttaattaaatccatgctcaagggatattttttcaaccaaagcctcctaattgtttatcaatgagtgtgattcacattctgctttatctgtgagctccttcttgagctccttaaagatagccaaagacaggggaaaagaggttttagaagcactgcctcacattgaatggaccttagtcggtgcgtagaatagaagctggcaggtcacagtgtttctaagtagagcacagccaaccttaggcttcatcttaccatgaaacatagagcctccttcctttgtgattcacaaagccctttccatcactctggccatccctccagctcttttgcccgtatttccccgtttctgctcttgtttccacacattctctctgaaactctcaaaaataccttctcctccctttccatattttcttcatgtatttttcttttttctttctttttactttttttttttgagacagagtcttgctgtgtcacccaggctggagtgtagtggcgtaatcttggcttactgcaacctctgcctccccagttcaagcaattctcctgactcagcctcctgagtagctgggactacaggcgcccaccaccatgcctggctaattgatatatatatatatatatatatatatatatatatatatatatatatatacacacacacacacacacacacattatatatatatatatatacacacatatataatgtgtgtgtgtatatatatatatatttttttatttttagtagaggtggagtttcaacatgctggccaggctggtcttgagctcctgaccttgtgatccacccgccctggcctcccaaagcgcagggattacagacatgagccaccatgcccggccttcttcatgtatttttcaaattagcaatttatattttttgaaattgaaaataacatccaatagatgaacagcatatcatgccagaagccttgctttcaatgcatttgcatttgctttatcatcgtctcttctgatatcaagcctgagatttctcactctgaaaataattttatctctcgtcaatcttgttatctcagctacatctcttaatgttgattacacccaaatccatgcttactgaacacagtcagatgttctaagtgagctaacatgtgtaaggcatttaatagttgccctggtacttactaagtgacatgaaatttttggctattactattacatcatcatcatcattatcattactattattatcattattcttatgtttctattaggttgcctcagagcaaatcaaatgcatataaccaaatgttttaatccttatgtgtatgttttttaatgtaaattcatagtttccactctcaaacttgtccttcttccttttatgctctgcattgaaccactgttaatttcttaccaacctctgttacatctcttgtattcattttctcttctccacgtagatcctgttgactttggcttacactcatttcatttcactgggattcttctctagatgctcaactttttcttcaaactataattcatcttatctgtggtaatcagtttattttttaaagcatagttctgtttacaagacttctcacaagcttccaagtctctattgcctgttgaataaagttcaccgtccttcatgtgacactgaaggtgttcagtcttccgctttcagataatgtttctggtgcagtcacctgccattttctttcacacctcctagagtgcaacggatctgcatagtatttaatgctcctcattcaatgactatgtagtgaagtgttcctggaagcctggttctagtttaagtgtcttcacccagtgataagactgacacgatcaccgctctgtgattaacattactttgctcacgctcccaactctgctcccttctccaagatacttttgtgctcattcatccacatctgatttatctggtgtgaaactgatcataggtctccttatttatgaagtattctggtaattccgactgaaagtcctctttttcttcttcattctcgtgttatttatttatatctttttcatcgcacttagccttttcactcttggtcagctttctgttcagtgttcagggaatacatgaagattctctgaacccgcgacaaggaatgctgtagcttggaatagtctttctaagtccagaggctgctttcttcaactgtgtgtgcctttcacaagtttccaacttctattcggagccagccagtgctgtgtctactggtacaaaacatagtgttgtaaggctacacgtggaaatgcgcttaaactagaagcaataacagacataggttagtgtaagttatattttttctgtgagttttgaattttgttttcacttttatatttctgcaaatggaagatggcaaaagggctgtaaagaagtgaagatcagtaactgcctcaaatttcaaggcaagaaaaggcagattgttagaaatatccatctgattgaggaaaagtgacatgtttgcttgaggtatgtgtgtaatagattccactgaccactgcacggaatatgtgcagacacagctgatgctgcaaccttatcttaaaaactcatcctttaaaaaataatttccgcatcacaaatatgctttttctttatttcttctcataccattttaccgcctagttaccaatttgctgaaaacgtagtttcacaagaatcctgatttgcagagcacaggtttccttagctcgaggctgtatatatgttctgaaatggaaataaagtctctttcaatgattggattcagtggagctgggtttactgtaaagggaactttaatagctatttttcaatgaacacagaccatctccttttgattaagtttaactattaatgtaatttgacaaggaggtgagaagctcatgcctcatcttcatctgctgtctaaagtaacttaagcaaaagcaaagaaaagaagcagtaaggtgttgctgctggaaaattctgtctgaaaatgctgttatttgaaattatttatagagaattcactgaagtgaactatttcaataatatttttatgttaacgaaggttatcaatgataagatgagccaattataatagtctattataatttaaaatgaatcactggttatcttttcaacacattttatgtccaggagagcagcatatctgcagtgcttaagtgtgcagtctctgaaggcaggtgggaggtttgaattcagtctctagggtccgtacttctgtgaccttgggtggcacagaaggcttatcctttgtctaagccctgacttcctcaatagtaaaacagggataataattctacttacctcaaagttaatactctataggctggacacggtggctcacgcctgtaatcacagcactttgggaggccgaggtgagcagataacctgaggtcagaagttcaagcccagcctggctgacatggtgaaaccccatctctactaaaaatacaaaaattatccaggcatggtggcacgtgcttgtaatcccagctactcgggaggctgaggcagtagaattgcttgaacccgggaggcggagcttgaagtgagccgagatggcgccactgcactccagcctgggtgacagagcgatatttagtctcaaaaaacatttttttaaaaagttaatactctataaattttagctcttattatttatttattgttaagaaaatactcaacattttgaaggaaatgattatatctttcaacattcttgtgacttttctggatatctgctgatttgatgcatttttaaaaatcaaaatatgtaacatgtttttaccttattaatctagcataccatttaaatatacaacagtgtttcttctcttgactaataagtgaacgataatgataattcaacaactacatgatttattatctgatctgaggtttaactttaaatgccaacatcatttttaaggtattttaaaatagactttatttttaaagcagttttgtgttcatagcaaaattgagcagaaaatagagttccaatatatccccacctccaaacattcatagcctcccaactgatagcattttccttgaaagtttaatgattgagggttgcctgcttttacataatttactacgtattttttaaaaattataggccaggcgtggtggctcacgcctgcaatcccagcactttgggaggctgaggcgggtggatcacctaaggtcaggagttcaagaccagcctgggcaacacagtgaaaccccgtctctactaaaaacacaaaaattagccaggcatggtggcgctgcctgtaatcccagctactcgggggactgaggcaggggaatcgcttgaaccttggaggcggaggttgcagtgagccgagaatgcgccagcctgggtgacagagcaagactccatctcaaaagtaaataaataaataaataaataaataaataataaaataaataaaattatgttaatagatgttactatacatgttctggttaaaaacctgagaaagtattttattacatttgaggaatggatttgagagtatttgtacttcaggcaataagaaatattgatcaaatctaaaaaaaaggatcataaaaaagcatttgatactttgtttatccatatatttgcgaacataaatggagttttttggatcagatgacatagtatctatttccttaatctatgggttagaatataaaatgtgattgattacaaaataacttgtttttcatgaaaaaaattagcagctcttgtaaaatgcatctgaataaggagaaagtgtgctacaaatgagtaaagaaaaacgctgactggctatacaaatacactactcattagcacacaaaaactgtctcacttaaccagggaactccttccattccatcaggcatgccttccagagcacgttcttgccttttaaatcatcaatcattgctgccactttagtgagaccaaaagggttaaaactgaaacccagccattccctttcacttctgcaaatgcagctcagctttcccttctctggtctataacaaatgccacccactctttcctctggggtcttctctgatttgtatggccagtccccaacccgcctcctgaacttccatgcaacaatttcagaccctcagcagtggaaagtcttagcatagatgttctgtgagcttcagggcttaacccctcatgaaacttgacctgaatccgtcagtggatagaaaacggatttcatatttagaatcagcataactatttgttacaattttccagagtgtttttttttttctttggagactgagcctcgctctgtccagcccaggctggaatgcagtggtgtgatctccgctcactgcaacctctgcctccaggattcaagcaattctctgcctgagcctcctgagtatctgggattacaggtgtccgccaccatgcccggctaatttttttgtatttttagtagagatggagtttcaccatgttggccaggctggtctcgaactcctgacctcaggtgatccacccactttggcctcccaaagtgctggaattacaggcatgagccactgtgcccagcctctcaatattcttgatattatatgtacttgtattttctttgtatttgaaattatcattaggatggtaatcagacaacttagatgttacaatatctatactaatcacatcacattactttattgttactagtttctgtgaatgtgtcttatcttttaaattaaatccaaagctctttgagccagaaactttgtcttgtatgaggtttgctatataagtatttggagggaaaattgagtgactcgttctttcgtaaaactgttatatcggaacaccacagcttcatgaaaacacattaactagaagttattacactggagttcgatctccaaataatgcgggttgattaagttccattagctctgtggctttaagcaagttccctacttctcaagaccttattgaattcactttacaatagggtgactgggtcaggtgatgtctccagtattctcccttttaaagttatatcacttttcaaaaagaaagtctattctaagaaagaaaatatgactcgaagtctgaatttgcccaagtaccaaagaaaggctaaagttaaagcaaatcttattcatagagagcactagtaaatctatttctttttgatgcttgaatgttttctatgctggaatgttcttggtacatattaggttataaaatgactcatctttaggacatttcagtgcctgagggtattttctttgtaatccatgtattgaaatttgactcttgatagcacatgccaagcacatagttccataatatgattttttaaaattacagataatgaatatcagatgaacacaacagaagacacttagaaataaatcacattttgaccacttttaacaaatactcttagatcagtgtcagatatgagtccttaaagtttggccacaaagataataaacactttatcaaatctctatcttcataatgtgtgctcttctgaagaattattgtctctaacaatgctctcaaagagctaccagaaaggttattaaaatgaaacctatggtcactgtagtcagaatacaaaacaaacacgcatagtcacagttcatttgcatccatttgcacagtgcatttgtttgattttacaaataactgatagatgagtggaaataatattcaatgtcttgcaatttgcagaaaagagaagtgcgactttaatctcagaagaaaatatttcccagagaatgtgaatatctagtatattgtgctatcaaaactctatccctttattttatgtccttgcttgacatttagttggggtttattcaaggattacttgattggaaaagtgcctgcatatttggatgtttaaatacatttgatttatgtctcaagtgacatttgtggaaaacattttctgttttagaaacagtcagggtcagggaggtctcgccgaggggaggcagggactcaaatgaaggactggccacatggagtatgtgtatctcggagaagaacattgctgacctctgtaggaagaaagactggccacatggagcatgtgtatcttggagaagaacattgctgacctctgtaggaagaaagatgtgcacaggtgggtctggtctatgccacatggatcccagtaacagcaaggaggccaatgtaacaggggtagagaagcaaaggagacatttggagaggctgccatattttaaaggttttgtggccatgtttagatttggttataagagtcataggacaccattggtcttctgttttaaagacacctctcgctgctatagtgggaggaaggagaaatattagcatcaggtacaggtgaaccatgtttgtgtctgaggtagatgcccagcaagatgagatgtgcaaggtccatctacataactgtgaaggacaaagggaacgggggcagaggcagggaggggaagccttcagacagttgtgccagtgggagaccttgaaaggagaggtgagctcggacagcctgagacccagcatagtgctgaggaggtgctggcaaggccaatgggggccgcctgggaaaagctgctctctagaagaatcctgttccaggcatgaatagccttgacctagtcctctctcctaggactgggaagagcctgggagagggtggcctggtagtcaggaaagagtggcagctggggactgtcacctgcctgctccttgcagcaggttcttgtgaagggagagccaatcaggcacctccatgggcaccagaacgtgagcgctttggactagggtggaggtagtggaggtggtgaggttttgccggggttctaatatatttaaaggggagaaccaatgatatttactaaaaaataaaatgtgaaatgtcagaattctttgagttgagattttgggtgaatggttatgacaattcctaatggaaattggaaaatatttggaaggaatgggtgtcaaggtcagataaaggcagataagaaactgtttcaggcatgttaagtctgatttaactattcaccatccacttcgatatgtgacaatggcagctggatatattttactgggcggatggtggcctgtggtattccttcagctgccattgatggatagatggcttgtagagcgtgaagaccatcgaggagcggagtacagctgaggaagagaacggggtacattcacgacaccccagtgctccgcagcatctagaaattgggataagaaaatggatctagcgagagagtagaagtagccaggtagaagaataagtagtttatataaaaagagagtgtctgactcagaaaataagtaatgcagatgaaaaggaggggatcgatttgagaaacatctacttaggattggattatgaagtaaagaaaggactttaagaaggaggcagttgtcacttgcttcaaatcctgacaagaggtggaaaggatgatacctcaaatggatcactggatttagcagtgtggaggtcggtggtaatgctgacaaaagtggtttcagtggaacactgatgaaagcattattggagggaatgtaagacagaataagagagcaagtaaaggcagtgagcatagaaactactcagaggaaatcggctgtaacaagaaacaagatggagaattgctgtcctctcaagagagaggcttatgttttaagagagtgacaacacagcaagcttaaatgtttgtgggaaggctctcttagagaaggcaaaaacgtatgatccaggaggaaaaggggagaagcacatgggaaaattcttagaggaatcaataagaggggatgggatctactccatgtgaaatcagttttgctttagagacagcataagtaggtcacctgttttaccaggaggagaggcaaagcgcacaggtccagtgcagctgaagtggtttcctcgctagtggaaatttgtagacattctcttctgattgctttcaaacttctcagtgaaataaggatcaagtcacagttaggcaaagaggtgcggggcgggcatggtggagagttgagaaggggtggtgtgaaagtcactttggtggagggagagtaaatgaacttaatgactcttgtgacactgttgggcagtcctgagtgcctgcttgagttcattcctgtatatttaacgtgaggccaaccagcaggtttaatgtttttctgtattcatttccaagtccttgggtgtgagcacaaacaggcacaggccatatgtaatcattgtggtggttttactaggcagatgtggcacaggaaaaagggcaaggtaatcgagagtaaatagaagggggtggtgacaatgactgatgtaagattgacgctgggaaatgaaggaactgagagctggaggggtgcaattaatagagtgcgggctttgtgggttcaaaatatttagaatgggggccaaaacgctgaaggagacagcaagaaaagattatggaggagacagagtgagtctggatatgaaaaaaagtccagcgtgttatcacaagagacaaactggaagaggctagatgagcagaatagaggacaaagaaccaagagtcctgggtattggtaaaacctgctgtggtctggatgcttgtgtccctctagattcctatgttgaaaccctcatctccaaggtgatggcattaggaggcggggccttttgggatgcgacgggatcatgagggcagaacccttgtgagtgaagttcatgccttatacaagaaagcctagggccttctttcctctccaccgtgaggatgcagtgtgcagtgaactaggtagcgggctgtcaccagacaccacacctgccggcacctggatctcaaactctccagcctccagaactgtgaggaagacattactgttgttcataaaccacccaatctacagtattttgctacagcagccaaaatggacgaagacagatcatttacacgggtagaaaaatcaccaggaatagcgatggtgagaaaaacagcaagccagacacaagaatcacccgtgatgaaggggatggtaaatgactagggagagtgacagaaggcccagtcccctgacatgagccttgatggaactggagcttttagcaggaaccagggcaaatgggcttgaggcagcccagtagtgtgcagggtgtgaaagggaaaaacagccctcagttgacagtgtagtactttcctaggacttctgtagcaaaacaccatgcacttaatgccttcaatcaacaaacatttattctctcacaattatggaagccagaagtctgcagtcagtatcaatgggccaaaatcagggtgtcagcactgtcaccctcccttggtggctccataaggaaaccggttccttgtctctcagcttctggtgactgccagcattcattggcttgtggccacatcactccaatatttagggtcaacattttttgatctccctctgctctgtcttcatatctctttctcctctgtgtgccctaaaatctccctcctcatctcgtaacagaatatgtgtgatgtgtgattgcattcagggtccatctgaacaatccaggacgatctccccatcttgagaacataatcatatctgcaaaggctttcttttcttgccatatgttatggtcacctgcaaagacatatgggcccctgaggtttgatttgaatgttgaggctgatgatgccacacacaagctaagggggtatgaaaggttcattactcacatacttcaggcttctggggagagcaggtgggcctcacaagcagatccaatgtgacctaagaaagcaagggaagaagactggcccaagatgttatagtggttaggggtggggctggggtggggtcaaagttcccatgtgtgggaagggctcgtatggtttgactcccccaccagtgccaagggagggggctccccatctttcctgttggcttatccagatgcgggcataaaggaataccaaggggtgaggcctagaagctgtcaggagtcaaacatcaagaaatggggccagtctgggcctggtggctcatgcctataatcctagctgggaagctgaggcccagaactttgggaggcccagcacttgaggccaggagtctgagaccagcctggccaacatggtgaaaccctgtctctaccaaaatataaaagttagccaggggtggcggcacatgcctgtagtctgtaatcccagttacttgggaggctgaggcagaagaatcacttgagctcaggaggcagaggttgcagtgagccgagctcacaccactgcactccagcctgggtgacagagtgagacccttcctcaaaaaaaaaaaaaaaaaaaaaaaaaaaaaaaaaaaaaagggagggaggccagactactcattacatcatataaggcaattttcccaggttctaaggttctagagattaggaactggctatcctggggtgggtggtagagtccagcctaccacagggagttatgaaacataagcatggtcctcaagggggaactgagattagggttcgatcagaaataggaggggcgtatgaaagaagtcagtgctatagatttttatgtagttaccaatgagctgaaacccatttccccattttatctgttttgttcattgctgtgttctcagcttctacaacagtacttggaacatagttggcatttgataaatattttctaaataaataaatgaataaaaatggacgacatttctaatgtaaagaagttattggaaaatcacaatggaaagttggatttgaaatttaggcatcttcacaaagttcatatgcattattactttaaaattctgtagcgtggaagggagatggcaggggagtatgtcactttgtgacacaaatgaatgaaccatgctaatttcatggaaaaccctatctaaaattctgaaacagaacaccctgcctcccacctgacatagctgcttctgttagcgttttccagccctgtgtctccatgcagaacaaccccaaccgcctgctctgttgtgggtcaacacgctgcctttccaagcactctgaatacaccacagacgtgtcctacccacaaacgtcttcctggtggcgccccttcaaatctaggatctacaatatggaaagaaaattttatttaagtagctgttcataagacactaactgaaagatgtgcgcgcgtgcacacacacacacacacacacgatgtacagtgtcacagaggctctagctatggttattggacttccgaaggatgcagaaggagaaagagagtgataattaaccattacgttagagcaaaacccaagatggttcctgcacgttgattttctacagtgattaactttttttttcttttgtttttgagacggagtctcgctttgtgtcccaggctggagtgcagtggtgcgatcttggctcactgcaacctctgcctcccaggttcaagcaattctactgcctcagcctccctagaagctgggatcccaggtgcctgccaccacacctggctaagttttgtatttctagtagagaaggggtttcaccatgttggccaggctggtcttgaactcctgacctcaggtgatcctttggcctcccaaagtgctgggattacaggcgtgagccactatgcccagcccctctactgcataacttaattaccacaaaataatgcactagatcttcatatttcctcccacggggcactcattcaccaagggactcatttccaaggtctttcaccctatttcttttcttttgaaaaatattcagggaatgagagtttaatataaattgtcattagccaatattcttagccagtcccacacctttaagatggcccgtcttgacgtcttgttcaatggttgccaagccggcaagtgagcatgcacatcctcttggatttcgtccccaaatacaagaggaaagaaacaacgtctcccactgtgaaggatggtggcatcgttagtgggagggtgtccactatatctgtcttcttctactgccctgtattttctcatatcacagcttgacctctctaaatctgatggaaggagaaagactgaagtcagagaggcttgtatctgatggaaggagaaagactgaagtcagagaggcatgtacggagctttgagttttattgtttgacacgcaagggtctgatacttttgtttctggtctcctgtcagggtgccactgacagggccttacactctgctgaatgtagcccgtagccctttggtgagcaccttggcctgcacagaaggcccctgtgctcagcagagtcttcagggagaaattcacttctgggttttctcggcgcctgagaatcctcttcaaggtctcagtcttccatctctagtcctgctctgccctctctctgagttcactaagattgtggatcttctaggttttcacaatggacttttccttctcattttgccctgctctgtgctttgtacttgtgcagcatgcagttgtctgagccctgtgcagagtctcaactcccagccctcttgtttacctagcattgtgaatgcacactgtgattctgggtggcatttctctggagctgtgcattccaggattccggtcaagagagaaataatgctcacatgcttcctcggaggactaggactgaccccgctgcatgcatctgaagaggtaatggtccctacagtgtggtcctttttgggcaaggcttgttaatatctgctctttcattactgtgtagtagggcaaagtcactgcaaatggccgtttcccggtttctaatgtcctgcttttcctagccccctaaggtactttgaccactggttatgaacaaggctgttggctattctattttcaaacagcagtcgtctgttaggaataactatcaatttaatggcgccaatggccatcaaaacaaagaaaattacacagtaagtctgtctttctttctcgaagggaatcatttgcatctcactgtggtaccaagtgtcgccgtttccctcaacatgctggtaaccatcagtcccacaacagagtgaaccaagaatgcagagggctttttgtgctcaatatctttgctttggccaaggaaacactttccataatatcacgtttacttttttaacttttatagtacagagtgaaacatgtagaaaatagtagctgtctcgaaagagatgggaagactaagcctagtgatgaatgaggcacacatagaaagggacaggtgcaccaggacatgggtggggatggtccctgctccatagaaagggacaggtgcaccaggacacgggtggggatggtccctgctcctcatgtctgtgcgaggctttcatttgcaggcttcacagtgctttagaataatgtgttcatggaataaagagaaaggtagcatgggaggaaaatgttttcatacaaagcgaggaaattaaatatcacttgattcaactgggtattttaaggggaaaattacatgattaaatcacacccatggaagtttggtttagaattccattatctaagatggatgaacatttccaaggccctaaactgtgtattagaaagaaatcctaattgcatcaaaataaatgaaatgttatatttttgttattagtttttgagtgcctttcaacccagaagaaaactaaacttgatttaaaaaaaaaaaagctttataacaagatgttagaggtgataaatttaaagtttgaataggaagagcatggtctgggactagaaacactgtaggacagagatgttcctttccacctatttagttattcatttaataacaggctacaggtatcacctatttttttttttttttttgaaactgagtctcagtctctcgcccaggctggagttcagtggtgcaatctaggctcactgcaacctccacctcctgggttcaagcaattctctgcctcagctgggattacaggcgcccgtcaccacacccagctaatttttttgtatttttagtggagacgggttttcaccatcttggccaagctggtcctgaactcctgacctcgtgatccacccgccgcgtcttcccaaagtgctgggattacaggcatgagccaccgctcacggccctatcatccattcttgattgcacatcctcttttggcttccgtgaaagcatactgctatgttttatttctgcctctcttgttacccgccgttatcaatcctaggctcctttctcccatgctcctgcctctatatggtgttgctgaggtccacctttcctctctcatccatcactaaggttgctagaagatccttgttctcagggtgtcactcacacacatgactctcaaatcaaagtagccagcagaacctccacgctgtgatccaatctagaatttccaagctgtcttctggatatttctttttgaatatttgaaccaacagtactgtactttaactcttcctctgctttcttcccaaggctcctagcttctgtgttatcatttgtgacttttccattaagaaaaaatctgttacgagttatttcacctaaaacacggcacattattattttttaatttgtaataattgtgtctgtagtcttaaaagtacaatgctatctcagaatcatataggtatcttttttttttctttttttttgagatggagtcatgctctgttgcccaggctggagtgcagtggcacaatctcggctcactgcaaccttctactctctggttcaagcgattctcctgcctcagcctgccaagtagctgggattacaggcacacatgccaccacgcccagctaatttctgtatttttaatagagacggggtttcaccatgttggccaggatggtgtcaatctcctgacctagtgattcacctgctgggcctccccaaagtgctgggattacaggcatgagccactgtgcccagctgggatctcgttaaagacacagaccccaattaagattggggaatcagagcctttggagacttgggaactcgtgctgtactcatgacttcacgtggttctcatacacactaaggtgagagaaccataaccctggacagcagagaggatactttttgttaattaaatgccacactttatttcaagatattagattaggtattattgacagctgtttgcaaaacccaggaaggcattttatcaatagctactattcattttcagtttgcttcattccaacttgctgtgtattttagttgctctttcggtttaaagcaaatgaaccaactctgactagatttaaacaaaaagcgaatctaagcgaacctattgggagaacactaggttatctcatggagatgtggtaaagtagagaatagggagggactagatcaactccaggtaccttggcagtgaaacctcgtggatcttctcgccactgaatttccttcagttggactttggctcctgtcacttgcaacctgtacttccacccctgctcccaaatttaattttattttttaaaattgcttttaaatgacatgtaataattgtacatatttcggaatacaaagagatatttccatacatggatgtaatgtataattaccatattgtggtaattagcatatctatcatgtataacacaaagaatttatcatttctttgtgttgggaatattcaaaatcctcttttctagctatttgaaaatacacaataaattattgttaactatcatcacccttacagggctatagaaactagagctgactcctatccagttgtaattttgtatctctccttatccttctctcctcctatagtctccaactgacagtaaccataactctactctctgcttctagagctcaatgttttagctcccatacatgggtgagaacatgcggtatttatctttttgtgtctgacttatttcatttaacataatgtcctccaggctcatccttgttgctgtgagtgacaagacttcattcttttttatgacagaatagtatatcattgtgtgtagttaccacactttatccactcatctgatgatagactcttaggctgactccatatcttggctattgtggatagtgcttcagtagacatgggagtgcagatatctctttgagatactgattttctttcttttggatgaatagcgagtagagggattgctagatcatatggtagttctattcttagtttttcgaggaaactccatacggtttttcataatggccatactaatttacaatcccaccaacagtatgtaggagctcccttttctctgcatcctcaccagcatctgttatttttgtcttgttgatagtagccattttaactgggacaagagaatatctcattgtggttttgatttgcatttccataatgattagtgacgtcattttttaaaatgttctttttgcccatttgtatgtccttttttgagaaatgtctttcagattctttggccactgtaaaatcagatttttttttgcttttttatttttttgctgttgtttgaattccttgtatattctgagcattaatctcttgttggatgaatagttcgcaaatattttctcccatcctaaagtggtctttctattctgttgattacttcctttgctgtgcataaggtttttagtttgatatagtctcatttgtctatttttacgtttgttgcttgtacttgtaaagtcttacctataaaagcttcacccagtctcaagtcctaaagtgtttcccccatgttgtcttctaggaattgtatagttttgggtcttaaacttaagtctttaatccattttgaatttattttcatgtatggtgtgagagagagagagagaggtctagatttattcttctgcatatgcatatccacttttcaacgtttttggtgactttgtcaaaaagtcaggtgactgtaaataagagaatttatttatgggttttctagtctgttccattggtttatgtgtctgcttttataccagtgtcatgctgttttgattactagagctttgtagtatattttgaggacaggtagtataatacttccagctttgttctttgtgcttagaattgcattagctattcagggtattttgtggttccatacaagatttggaatattttttctatttctgtgaggaatatcattggtattttgatagtgaaaccagtccagtagtcccatagatagcttttttttggataaacatagaatttgatccttctgttcttaaagcttgaagcttgcatttgttttatctgtgttccttcctcaggatgacattcagggctctcaaaaaaagtatcaaagaggccgggcgcagtggctcacgcctgtaatcccagcactttgggaggccgaggcgggcggatcacgaggtcaggagatcgagaccatcctggctaacatggtgaaaccccgtctctactaaaaatacaaaaaattagctgggcgaggtggcgggtgcccatagtcccagctactcaggaggctgaggcaggagaatggcgaaaacccggggggggggagcctgcagtgagcagagatcgcaccactgcactccagcctgggtgacagagtgagactccgtctcaaaaaaagtatcaaagaactgaaactcacctgatcaccacatccagacaatgagatgccaaacccctcattcatcatgattactttcttgctcctccctagttcctcccttttcttagacattgtcacatttcttccctgctatataaaccactagttatagccagtcagggaaatggatttgatactaatctcccatctcctttgctgcagcactccgttaaatccttcttccttggcaatactcattgtttcagtgactggctttctgtgtggcaagcagcaggacctagactgaacccctgtgctttggtagcaacaggaattgcactaaatctgtagcttgctttgattaagatggtcattttaacaatattgactgttccaatctgaacatggaatttttcttttttggtgggtgtgtccttttcaatttttctcatcggtgttttgtagttttcattgtagaggtcttttatctccttggttaaatttatttctaggtactttatttttttgtagctattaaaaatgggattgcttttttgatttcttcagctagtttgttattggtatatagacttgctattaattcttatatgttgattttatattctgcaactttaccaaattcactgatcagttccaagaattctgtggtgaagtctttaggtttttctctatataagattatgtcatctgcaaagagggacaatttgattttctcttttccaattttgctgtattgtattgctttctcttgcttaactgccctggctaggaattccagtacagtgttgaataagagtagtgaaaatgggcgttcttgtctggttccagctcctagaggaaaagtttttccccattcagtatgctgtcagctgtgggtttgttacatacggcctttattattttgaggtacactccttccatgcctaatttattgagaattttttgtcatgaagggatgttgagttttatcaggtgctttttctgtatctattgagatgatcctatggcttttgcccttaattccgttgatgtgatgtatcacatttattgatttgggtataccaaaacatccttgcgtttttaggactaatcccatttgaacatgggtgtataatttttttgatgtgctgttagattcagtttgctggtattttgttcaggatttttgcatttaggtgcatcagggatactgatctgtagttttgtcgctattgcttttgtgtcctggtctggtttgggtagcagagtaatgctggtctgctagaagaagtttggaaatgatcccttctcttccatttttttgaagagcttgtgtcaaattggtattagttctttaaatctttgggagaattcagcagtggagccaccaggtcctgggcttttctttgatgggagactttttatgatggcttcaatcatattgcccattattggtttgttgaggttttctttttcttcatggtttcatgttggtaggttgtatgtgtgcagggatttattcatttcttctagtttttcctatttgctggtggatagttgttcataatagtctctaatgattgtttgtatttctgtggtctcagttgttagtcttcttttttgtttctgattttatttatttgggtcttctctctcttctcttagtttagctaacagtttatcaatttttgtttgtcttttcaaaaaggcaagttttcatttcatcgatcttttgtaatttttttttagtctctactatgtttagttctgctctgatctttatttatttattttctagtttaaaattttgggtttagtttgttcttcctttactagttcattgatgtgcattgttagattgtttatttgaaatctttctacttttttaaagcaggcatttatttctataaatttattcctggggatcaacttacctctttctgtgtggtgaggagtgtctcttgggatgagccgatcccagccaggctcttcactttcctctttatgctgccatctccagtctctgtgcatcagaaggtctttatcactttcttgctgaattccagtgttttctcctatacactctatttgatgtgttgttttctaattgttttggtcctttgtggagtaggagagcactgggcatctcttatcagccttcttgatgacatctggataggacaatattgatcaatgatatatctagaagcaattttgaataaataatatagtgttataggttataattaaatatgtaaaccaaaaataaataaaggaaaggaagaaaaacctccctttttttcagaggcagggagtttttatttttggcttctgtaatggtatttcaccaagttttaaaggtattaactttattaacccgcaacattcatcattttaaaggcgtatatagaaactatcaaaatgggtcagaaacaaggtttgcgatactcataattatcttcaacagtggcaatatttaaccttttgagtcaatctcaacagattggcaatataacataatatatattgataagtgtcattcttgataaaaaatcaaattatttttctatttacaatttttagaaaaggtttaatgtaaaaatatttttcttctttatatatttccctgccatgataatgttaaaacatatcaagatgctcctcaaagtttaggagtgaacagcataacattccattttagttgaagcattctttcacatagccaacatattttttcaagacactctaagaactcgtgaggatactacaggaaaaatgttcctcttgcctactgagcttttagtcatattttccctcaaacttttctaaattaaacattgttataactgggtttgtttttttttttgaaatttaattttccacggtgcagtcctcaagttattcttttattcggagccactccttcagtttcaacttgctgagcaggcaagcaactgcttttggtttctatggaaactggattcctgtggctgcctgtaggtattctcgttccaccaaccttttgttgtgttgtggtatccagtgatttaggtggaaaagtacaagttattcttccatgatggatatgatatggtcataacaggctaggatctaatcggacccagagaactgagagactggaaggtacatcaggaaggctgcaatgtgttttatacaaattgtatgctgtcctagtaacttttccatcagaggtcttatggattgggagtgaagaatcttctgctgcctgagataacaagtaggaaccctcctgccagctacttaatttctttagaatgtgttggagaatgttaaatacattggaaatcttgagtgctgaaagcttttcttttaatgcttctgaggtaatttcttccagtagaaaaagctttgaagtaaatgcatcgatatggccaatgtaaaatatctgttggaatgcaatcaacttccagtccacaagcgacaacgttcactttcagtcagagcttcaactccataaccagcttgattctctacttctggtagtacataaactggaaattgttttccgattttcttctgtttcttagaacgtggtcttgtctccatcctccggacactgcagcacatgagtaacaacaggtcttgcaggctaaataacttatgaataaagtttccttcctgaggagctaggtattccgacgtatcttcaacatagtcctgaagttcatatggcaatcgtccttttggcttctgaaatgcagaaggccatccaatttcggccaactagaggcatctgaagggacagaccgttgctcagaaacagagggctgtttagaattttctaaattcattaagggcaatttgggtacttttctggaaattggctttaagagctcatcctgcattttaaaaatttctccaacaggatcaaattttttatatactcatttgataggtttttttaaaaaaaaatacatgacttgccaggcgtggtggctcacgcttgtaatcccaacacttcgggaggctgaggaaggtggatcacctgacgtcaggagttcgagaccagcctgaccaatgtggagaaagcccatctctactaaaaatacaaaaaaaaaaaaaaaaatggctgggtgtggtggcgcatgcctgtaatcccagctacttgagaggctgaggcaggagaattgcttgaacctgggaggcagaggttgcagtgagctgagatcgtgccactgcactccagcctggggcaacaagaaagaaactccgcctcaaaaaaaattaaataaataaaaagtaaaaaaataaaaacacatgactcttctggactacaagcagtattagtctggttttctgcagaagcctgtcctgaggaagaatttgggctagctggtcaagaatttaagttggaacccatgacagctgtctttccgtcactattatttttacactctgtatcaataattaaacactccttatctgtatcactgctgcagagaactgtatcttcagttttagctgcttctgatgtcacagtcttttcctttgagttgtctaggttttccagaacattgggtctttcagcatcaacatgtaccatatctatagtcatatcatatttattagcagtttcaatttcctgagaattttctaactgtaaggcatcagatgttttcaagtcactatcttgcctcgaagacttgtcagtatttgatacctttttgccacatgattcaaatccctggtcatctttatttttgcactctttagggccaccatccataccagtgaccagttgtttctccttttgcgactgttcaatgagaatctgagataaacttctagaattagcagaaatgtctggtgcacttggtgccacaggtgtagttcctgctttgggggctgtaggagcatctgtcacgttagttactgtggaagtacttgctggacttcttggctttgatgctttggtggtggttactccaaaagtttcaagttttgtaacatcaccatcaaaatccagatacaagttttcaagagtctcagtgttttggcactcactacttcacagggcatgtccatttcagatataaactcttcaaggataaacctcttttctatgcctggtgggagagtcaaagatccctgttcttaaggatgtaaatatatacacagataatatagttattgaataacttgggtttgagggaagtaaaaatagttgttttctagcataaaagtaattcctttttcaaagcttcaaattaattttggatcagtgggaggatcatttttaaacttaataaatgagtgaaagtccagttaaaacagaagaataagaacagttcattttaagtagactctcacaagcttggtcaaatcaaatgctctaggaccttctcgtatattttaggatactttacttgtatttgggagatgattccccaggagtatttcatatattcacatgtggtgtaaacagagactctggcagcttttctttcaaatgatcttttcaaggatattgccattgtgaacagctttggaagttaaggtagcttttccctctgtggtagagggcaggttttcttggtgtttaggaaaattaaaataatgactacttttaggacaaagtttgagcaaacttacttgaggtctgatatggtttggctgtgacctcacccaaatctcatcttgaattgtagctcccacaattcccatgtgttgtgggagatacctggtgggagttaattgaatcatgggggtaggcctttcccatgctattctcgtgatagtgaataggtctcatgagatctagcggtttcacaaaggggagtttccctgcacaagttctcttttcttgtctgccgccatgtgagatgtgccttttacttccagccatgattgtgaggcctccccagccatgtggaactgtaagtccattaaaactctttcttttgtatatgcccagtctcaggtgtgtctttatcagcagcatgaaaacagactaatacaaggtccattataaatgactggagtttcctaagctccagcttccatagctatgaagaaaatccactcagtatacaacttttcccttttttagcctaggagtcttgtgtcttttgccaacatccatgaaacaatgataatgtaactcattagattgcaagtagagtaaacctcagaccctttacaattaagtgtttctccacagtttacatgaaattgaaaaatgaaggcaccaagaatttgtttttttctccttacacacacatctgggcttttacaattgtagggaccagccccacagggtcggagggtttttctccccgtgtgcggagatgagacattgtagaaataaagacacaagacaaagagataaaagaaaagacagctgggcctgggggaccactaccaccaagatgcggagaccggtagtggccctgaatgcctggctgcgctgttatttattggatacaaggcaaaaggggcagggtaaggagtgtgagtcatctctaatgattgacaaggtcacatgagtcatgtgtccactggacagggggcccttccctgtttggcagccgaggtggagagacagagagagagagaggacacagcctacgccattatttcttcatatcagaggtttttagtactttcactaattttgctacggctatctagaaggcagagccaggtgtacaggatggaacataaaagtggactaggagtgtgaccactaaagcacagcatcacagggagatggttaggcctccagataactgtgggcaggcctgactgatgtcaggccctccactagaggtggaggagtagagtcttctctaaactccaccagggaaagggagactccctttcccagtctgctaagtagtgggtgtttttccttggcactgacgctaccgctagaccacagtccacttggcaacgggcgtcttcccagacgctggcgttatcactagaccaaggagccctctggtggccctgtctgggcgtgacagaaggctcgcattcttgtcttctggtcacttctcactatgtcctgtctctgtatggcctagtttttcctaggttatgatcatagagcaaggattattataatattggaataaagagtaattgctacaaactaatgattaatgatattcatatataatcatatctatgatctatatctagtataactattcttattttatatattttattatactggaacagcttgttgccttggtctcttgcctcggcacctgggtggcttgccgcccacatgcaatagctttctagctatttcttctgtagcatataagagttcagcaaacatttactgggtcccaatcttgtaacagatactcttatagatcctagaaatcccaagataaataaaacatgattcttgacccaaaatgcttccaatgaatagaagaaacaatgcataaagacgcatgacacagaaacagtatttttccttccttctttccttccttccttccttcctttctttttctttcttagattgggtctcactccgtcacccaggataaagtgcagtggcacagtcttggctcgctgcaacctccgactcctgagttcaagtgattctcctgccttagcctcctgagtagctgggattacagccgtgcaccaccacgcccggccaatttttttgtatttttagtagagacgggttttgccatgttggccagggtggtctccaactcctgacctcaggttatctgcctgccttggcctcccaaaatgctgggattacaggcgtgagccactgtgcctggcataaacagtatttttcatagcatgggatataagtgacgacagcaacagcaactttttttttttttgagatggagtcttgcttgttacccaggctggagagcagtggtgtgatctcggctcactgcaacctccacctcccaggttctagcgattctggttcctcagcttccccagtaactgggtttacaggcgcccgccaccatgtgccagctaatttttgtattttcagtagagatggggtttcaccatattgcccaggctggtctcaaactcctgacctcatgatccacctgccttggcctcccaaagtgctgggattacaggtgtgagccaccgcacccagccaatgacagcaacattcaaggggtgctctgagagcacactgaggtgcacttagcctgtcgtgaaagttcaagagatggttcttgaagttgatggtcactgaatgcggttttgcaggagattgaatttgaaaagctaccttaccttccgaggctgttcccagtgcaaatatccttgaaaagatcattcaaaaacatgtgaaaagagtgtttctgacggaaggacatatacagaaacataaaatagcatgatgtgaatcaaggaactaaacaccaactgctgttactagtttgtggagttccttgtgtggagcagtaggaagttgaagctggagtttgctatgcatgctgcgttaaggaactcagattttagcctttatgccagttgcctccagacttttttttttttttagatggagcctcgctctgttgcccaggctggagtccagtggtacaatctcggctcactggaacatccgcctcccaggttcaagcaattctctgcctctgcctccagagtagctaggactacaggcgcctgccaccatgcccagctaatttttgtatttttagtggaaacggggtttcaccctcttagccaggctgttcttgaactcctgacctcgtgatccacccacctcggcctcccaaagtgctgggattacaggcatgagtagctggccttaggcttttctgattatacatttatttagtaaaactttctcaagcagtcacctctaatatatctatatgtatttataaatttctctacacgttgtatggtctccccatatattaaatgttagtattttattttattttataaaacgaaataaaaatagataaagttggccaggcgaggtggctcacgactgtaatcccagcacttctggaggccgaggcgggtggatcacgaggtcaggagatggagaccatcctggcgaacacggtgaaaccccgtctccactgaaaatacaaacaaaaaaaaagaaaaaaggaaaaaaaaattagccgggcgtggtggcgggcgcctgtggtcccagctactcgggaggctgaggcaggagaatggcgtgaacccaggaggcagagccgcagtgagccgagattgtgcccctgcactacagcttgggcgaaagagcaagactccgtctcaaaaaaaaaaaaaatagataaagtttctcatattttcttctacacctcaactgattgtctttctcactctccttgagggccacatttagtctgcttgcaggtgctaacacggggaatgatgatttggtcagattcatgttttcaatcactcctcacagtggaagataagagttgagggatgcaggattcaaggagggaagtgtaggaaccaagatattatgatggatcaagcaagagaaagtcaggatctgactgagagagcaggcatggagtgaaaaggagggctaaatttgagaaatacctaggtagtagaattggtacgatccgcccattgagtaggggtggggagtggctctgagaggccggagtgaggcctgagtgaagggatgggagaagcaaatccattgagtagggatggggagtggctctgagaggccggagtgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggagtgaggccggactgaagggatgggagaagcaaatccattgagtaggggtggggagtggctctgagaggccagagtgaggcctgagtgaagggatgggagaagcaaatccattgagtaggggtggggagtggctctgagaggccggagtgaggccggactgaagggatgggagaagcaaatccattgagtaggggtggggagtggctctgagaggccggagtgaggcctgagtgaagggatgggagaagcaagtccattgagtaggggtggggagtggctctgagaggccggagtgaggccggactgaagggatgggagaagcaaatccattgagtaggggtggggagtggctctgagaggccggagtgaggcctgagtgaagggatgggagaagcaaatccattgagtaggggtggggagtggctctgagaggccagagtgaggccggactgaagggatgggagaagcaaatccattgagtaggggtggggagtggctctgagaggccggagtgaggccggactgaagggatgggagaagcaaatccattgagtaggggtggggagtggctctgagaggccggagcgaggcctgagtgaagggatgggagaagcaaatccattgagtaggggtggggagtggctctgagaggccggagcgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggaagggatgggagaagcaaatggcgcacattgtgtttcggtgactgagagaatagtggttatgtttaatgagacagaagattcagtggataagcagattttagtggtgggttcaattaagaaattgacctcatctttatacagattcacttccttttaattttctctcaacacactcatccaaaatttggttgtgttgtttttctgctgaacaacctgtattattctcctttcttttccaaatctccacattttggcccaacccgtgttccatggtgaattcagacagtaaaagaagcaactgtttttcaagtgccttctttgttatttataacacaatgctttttattccaattttgtagttgacttcttttctctaatagattattgtttagtcattgcagatcctgttattcttcccagcaaacaacctcaaagtttcactggcttacaataaataaaatttatttcttgcttgtgtaatttaattttatttcatgtacttttatcccaatgtacatttcaatttgggacccagaccaaaatagccattcaagtgcgaggggtttattttgtagatgatccgaaaagaataggaagtgagatagggaagaaaataatgacaaaaaaggctttattttcaagggcgttatcactgtggacaactggagcttaatcctactgcggaaaccgagaagccagggtaaaatgtgtacctgagtaatcccacccgtgggccaaggtaattgtaatatttacacaccaatttccatcagccattggtcgtggctgtacctatgagtgatcactttccagcatttcaggcctagaaaaagtagccaaggaggtttcagagtcagagaaagccctcgtgcagaaaatgtacatgctagcatttacaaatcagtcaggtatgcatcgatgtggttagagtaaaaggacatagagaggaatccactaaatccatccaggaataaacaaataaaataggaaaaaaaaacccactgttgacataagttaatacttttattttaccactatttctttctttagcccttttattcagttacggctacttgtgtacattaggtaggtagtgtgcaaattttacagtatgcattaactcaaattctatatttgtagtaactaaaacacgccttatttttcatctctatgctattccctcccctttccccagtttctctgtgtatgaagctcgactgacttgtcaaaagctccctaaagtgatgtttttacaataaagtctctcctaaacttcagttaggatcaatcactctctactggctgctcctgtagaattttatctgtagttttgttttgtcatcttatcactttataatattatttacaatctgtctgttaatgtattgtgcacagggctgggcgcagtggctcacacctgtaatcccagcactttgggaggctgaggtgggtggatcacgaggtcaggagttcaagaccatcctggttaacacgatgaaaccccgtctctactaaaaatacaaaaaattacccggcgtggtagcgggtgcctgtagtcccagctactcgagaggttgaggcaggagaaaagctcaccaggaggttgcagtaagccgagatcgcgccactgcactccagcctgggtgacagagcgagattttgtcttaaaaaaaaatatatatatatatatatacacacacacacacacacacacacacatatatatatagaacacctttaagatgatttgtgtcttacttctttttacttatcccatgattgtcacaataaaggtttgctcacatcataagcaaatacctaaatagacatgcctgattttcttacaattatggaagtgaatcttactttgaaaaaaaatcataaatgccccacatttttcaatgtgcttttggacatttcttaataactatgtttttataatattatatatgttaaggcacttacaattttaatgtgtagttatatgtaaaatcacattgtatcgagtaagcattatcaaataattctttatgatgaaattaatttatgagtttctaataaatactacagtattgttggccagaaagcactaatgaaaataaattaaaggtattgtttgttactttaaaggctaggaatttctaatataaagaaatgtaaggaatagttcataatttaagaacacagccacttcaaattgtaaaaaagaattatctattgttaaagcgaactaaatatggcctgggaaggactctatacttctatacttgagtccttgtagaggaaccataacctaacttaataggacaacaagattgaaaacctaatttaggagtatgtacgtggaacaatcgccagtccagcagccatacttcagccactcacacactgctgcgtgttcaaactgtgttcgagtaaggcaaacttgtaaccagtccagttgtttgtgtaactcacttccgatttctgtacatctttttcctttttttgtctacaaattttcttccacgatgtggctgtgctggagtctctctgaatctgctgcgattctgggagctgattcacgcatcattcattgctcaagtaaactcctttaaatttaattcagctggccgggtgcggtggctcacgcctgtaatcccagcactttgggagtctgaggagggcagatcacctgaggtcaggagttcgagaccagcctgaccaacatggtgaaactccatctctactaaaaatacaaaaattagccaggcgtggtggtgcgtgcctgtaatcccagctacttgggaggctgaggcaggagaatcgcttgaatccgggaggtggaggttgcagtgagcagatatcgtgccactacactccagcctgggcaacaaaagcaaaacccgtctcaaaaaacccaaaagtttaattctactgaagtttttctgttaacactgtgttattattttatcttttgatgaaaggcaaatgatataaacaagaacttggaatatttgtgaataatgtataaataaatagtttctgtttattctctgtattctgttaaaagtttttgctctgctcaatatatctggccataaaattcttttaaatcctgtataattttaaaagcaaatttgatgcatgtgcaacttattttattttattttttttgaggctgtttgttacaatggaaattgccttaacaagtctcatgtggcacatgtggtgcccagagcattctgaaagttatggttttgaaagcagtcgttgtggcgacattgtcctaattaaagttctcgggcagttttgccgacattcaaaaccatcttccatttttatccttttgtggtaatatttatcatttataaaaaggaattccaacacctcttttctatgtataatctcccaacgttcctggtcaaagcagtttgctcccaaattaccagaagtggtctcgttgcggcagcagagctcccctggtgcacttctactcacgggtttgttgaacgtgtagctttacccaccttgaggcagaactgcatgtgcccgtgttggcgctgacgcatgatgtgtggtgcacggatggagcaaaggtgaatatctccccacagcagacctccgaggttcataaattatttatcacatacttcagtgtgctgccacagtgatcagggccagtttccaatatggagacaagagctctttaatcacgctcttccctgcaaaagaaaaagattggcatttaacagagagctgtaagacaggatagggatgtgactgcagggaaacctccacttggaataggagtcgctggtcagttctagacccaatggcatggacttatgtagtaatagtagtaagagttcctgaagatagtttcaatctattgccagcattctgtaggtctttataacaagcaggaaatggatacacatgtctctgttccataattagaaaagtatcaccattttcctgggacaaaaatatgtaagtttaaacatttttagtgccaggtcagtagtcacgatttaccaacagcattttttattttaaaaatacagttagtgactacaccattggctaacaaactgagacttaaagcattctctagatgcaaatgctacaaataaatcaaattattaggcatattcactaatacttacaaacttaacttcatatataaagcaaggtagatcaccagtgtggccatgcaaacagggtttgaggacttcaatatttaaagcaagttagtccaacccacagcccaagggccacatgcagcccaggatggctttgaatgaggcccaacacaaattagcaaattactaaacttacttaaaatgatgggattttattttttgccattttttggtttgtgtgtttggtttttagctcatcagctttgttagtgttagtgtattttatgtgtggcccaagacaatacttccaatgtggcccagggaagccaaaagattggacactcctgatttaaagggaaaagggagggcagatgaagaaagaggataaaaaaaagagagagaaggtagacaaaacaggaaagtggttagtctttggaggctttgattagcacttactgaatctacattttacatgtgaaaggagtgggtagcgaaacagtgaattatgcatagtgctcagtgcgtctgcatttttgcataagataaagtaaacatagaggaggtgctcaaatatgcattcctctcaggtgagccaagggatgccctctaggcctgtctttgtcaaggtaccggtgaagataagctgttagtttacattgtcaaggtgaaatagaacagcgttctgttttagggtaaagctcttggggcccacgaggaatttccttgtgagcaatttgtgaaggaggccaccgggggagacatgtggccttctgtctttgcagctatctacttaggaacaaaatggaaggcagtttttgcatgatgcagttactgagcttcacttttccctttggcatagtgagtttggggtcctgagatttttatattcctttcacagcctcactatacttgaattaaaatacaatctacatgttaaaactgaccacatcattctttcctgtgtgtcttcaaaggatttaaggcccatccagataatccaagatgatctcatttcaaagccttaattatatctttgatgactctttttccaaataaggtctcaattagaggttcctggaataagacacggactcatctccctgggggccaccattcagcctgatccggaaggaaggccatgatttcagctctctgggatttgagacaaagaggccccttttctttcattttatcttttcatgtctcttcttgccatgtacccacatgattgagtgtgggctgagggtgaatccaagaagggctttgttttgtggtcagtacaggctttggtccacagagacaacaatactttcaatactcttttgttctgccccagaggagctcaacacagaattgcctagaacaagaaactgggtaagtgtgcttggaacatacgcttgtcttctcttctttggactcttgattgcaacactcatctctgcctggatattcacatggacttatactctctgtcttttcttctgtgtgtcttctcttctgtatgtcactgaatgttgggcccacctggataacccaagatgatctcatcttgaggtacttaattatatctgcaaataacattttcctaaataaggtcacaggcatagttttgggggactgggacatggatatatctttttggagaccatgatttaactcactataggctaaattctcagccctaaaaggggtcctacacaaagtgagggcactcaatggaaagaagggctctgagatgtgagataggaacatgtgaacagaaccttcaacccacagattcccctggactatcaggtccaggagaagagactccttcctctctcaggttgagactcccacggcctggagattaggcaaagcctctgttcgatctttgcatgaaattaagtagtcttagtggtctattgcaggggtctctatctgtgattgacctttacttatttcttgcttaatgtactatcattctctttttttcttgaataaggtagtttacatattaaattcttcgctaaagatacagctcttaaattaaaaaatactactactactaccattttgctttagtcagtaagttctgccttaattttctgtctattttatatattttgtctatattttgttgatatattaaagttttttcttgtttttattaatatgatgatttaaggctctagaatttcttctgagtgcagatctacctgggtcatacagatgttgtcatatgtggtcagttcttttacaaatattcttcaacgtttttctctttggcccttaatgatataagaaaacttccaaaaactgtatgttttttagtgttttggagttttattgtttatttaatttcactgcatcttaatcaaataattaaaaatgctttttagaaattactgaagttttgtggtctgaaatatagtcttttttatgatctgtggaatcaaaaaaaaaagcattctatatttttaaggtgccaagtttgttatctgtcaattagagaaaactatgtgatttacatttttacatcatgacttactattgctctcttcagcagtcacagcctgatagaggtgatgtaattttccctgctgtgctcctgtgtctgtgtctttccttatgcatgctctacttttttttttttttttttttttttttttgagacggaatcttgctgtgtcgcgcaggctggagtgcagtggcgcgatcctggctcactgcgagctctgcctcccaggttcatgccatttcctgcctcagcctccggagtagctgggactacaggcgcccgccaccatgcctggctaattttttttatttttagtagagacgggctttcaccatgttagccagcatggtcttgatctcctgatctcgtgatccgcccacctcggcctcccaaagttctgggattacaggcgtgagccaccgcgcccggcctactttttgttttaagaacattgatgctctgttatttaatctctagaattcataactggcatatcttcattgtgaatcacacgcttattttttcttttctgctactttttcttacttctatgctttttctgccctgtgttttaaagagaagaaaatcagtgatgccacacaaaacactccgtggtagtcagatcacagcgatggttttaacatttgtagtgctgacattctgttcccgttcttgtctctttcactgagttctcctaccatcaggcaggttccatgctcgtcaccaggccctggctgcaacttttcataccctatcaacatttggttcactgatgattgttgtttgctagattttccaagcagttccatataaacaatgttcccatatctttgaacattcaaaaatcagtttgtattgcgtttatacttgattgaaataatagttggtataaaatttccgggttgcactttcttggtgcaaaatttcacaggtctcagctctttcagtattgaatactgctacacactgcccttgtgattacagattcaagctggccatcagacttgcaagacacagacagctttaatctgatgctacatttactgggctttaaaggaggatacaggccgggagacacagctggtgtcctggggcacccacagctccctttgccctttcacctatccagggcctatgtggctgccacaaacaagagtcagggtgcttgcgggccacatggataatcagaagccaccgccttgatttcccaacaattttttatgctatttctagacacaaagctacaagccacatattgattcacagcccccctgttccaagggcaatggaacataggtgatgagggagacattccacatctatttcaaatctgtaatttccaagtgtgtctgttagcttctgttgattaggaaattatccccaaatttagtcacttcaaacagcaacagtttgttaacctaaggatctgctgaagagttcccatggtctgggctggctctggctaatctcgcccaggcttgctcacatgactgcagtgccttagcaggatggcagagggcgactagcccgtcatagcctgcctgtggtctggtggttggccatttgcctctggctcagcgtggcgattgtttcattattttgcattcttttgttgttgttgttttttgttgtttttttttgtttgttttttgtttttcgtgttttttttgagacagggtctctctctgtcacccagactggagtgcagtgacgtgatctcagcttacagcaacctctgcctctgaggctcaagcaactctcccgcctctgcctcccaggtagctgggattacaggcgagcgccaccaccgcccagctaatttttgtatttttagtagagatgggttttcaccatgttggcccgggtggtctcgaactcctgacctcaaatgatccagccgcctcgccctcccaaagtgctgggattacaggcgtgagccactgcgcctgcctgttgttaatagtggtaaaatatttggtgcagcttctcagtggccacattttacagtttcggatgcactttctggatcgggcatgcattttctgcttgtgtaactctgcttattttgcattattttaaggcatttataattaattctgattcctcattttggactatgttttgtttctcctgaaccgtctctttcctgtaggtagagggaagcatttcatggagggccaggtccctggctaggacaaggtagagcctcacagtcatatttggtatccagcggccattgctctgccccagcctgtcatctggctgtggtgggtttggtggcccacgtctaactctacctctgtttctagactgtgacccgggaccgggggaaattagtagcagcccgtgcctccagtgccactgtggcgagccctctaggacgggcctctcacattgggctttatggtgtccgcggcctcagtgtcagtactctgctcctccccacaagcagccctgctcagtttgccctgggctggcaggctttttctctgtgttgaggtttggcatttcacctcactcctgttttcattaaaagtagacttttcctttctatttcaagttctgtggatgattttgggagaatgttttctttatatcatctgcaaatacgcttcctcatttcccacctcgactttccatcttccactttcaatcttttctttttttggaaggagggtggggtattgtcagagttgtattttccaagagccctttcaatttctccatttttgccctttatcactgtgtgtgtgtgtgagagaaagagacatacagcatacatatagaaagatgtgcaaaatgtaaatgtatatttaacaagtggttataaagccatataatatgcaacaaccacacaggtaaagaaataaagtcttaccaaaacctagcagtctcccaggtgtccctctccagtcaccacactcttcctcatgcccctaccccagtacccccaggagtcaaacacttttctgcctttagtgtcatcatgtcttagctgtgtttataattttaccacctatatatgcattacgaaagagctgcttctccttgctatctttttcttgctgtaggtcttgtatcttcaaagatacttagaaatagggttccgaatataactttttctgtttctgcactctctctcttcttttgtgtttcctttaatctgtcagactgattttgttccactcacatgaaaactctgtccccagtgcctcctgatccttgcctctgcattcatgactaagtgtgatgcactgggagatgactgggagtccgtagggagtgggcgtattggccagtggtccttgcctctgcattcatgactaagtgtgatgcactgggagatgactgggagtccgtagggagtgggcgtattggccagtggtccttgtctctgcattcatgactaagtgtgatgcactgggagatgactgggagtccgtagggagtgggtgtattggccagtggtccttggctctgcattcatgactaagtgtgatgcactgggagatgactgggagtccgtagggagtgggtgtattggccagtggtccttggctctgcattcatgactaagtgtgatgcactgggagatgattgggagtccgtatgggatggcgtattggccagtggtccccttaacagagcggacctttgttgttgggcatcacctgaccccagtgtctaaaggagaatttcctccttggagataacgtctgaccgcagccttctgggagccacgggaacggtcttgtgtgcctgcaattagaacacacgtaatcactttatttctgaatttaagcctcacccagtcccccatggttgcttatttgctgactcctagctaggaaactttctgagattctctgagtgaatcacatttgttttcttcgtaggttgtggctttctttattgtactaaatcaatgcctactagtctgttaaatgtcaaagaaatattaaactttttatattctaatactactcccattcttttgtcctagtgggcttaaggatgttttaatttattttgctgtcctcgtagttgattttctttcttctttcttttttttttgagacagagtcttgctctgtcccccaggctggagtgcaatggtgcgatctcagctcactgcaacctccacctcctgggttcaagtgattctcccgcctcagcctcctgagcagctgggactacaggcacccgccaccatgcctggctaatttttgtatttttagtagagacggggtttcaccatcttggccgggctggtctcgaactcctgacctcaggtgatctgtccgcctcggcctcccaaagtgttgggattacaggcgtgagccaccacgcccggccttagttgattttcttaaggcagagcagataacatttgtgcttacactaccacatttaaccaacatttcaatcagggatagtttaaataaaactttatataagagtttcccatttcctccattctctttctagaagttttttttcttttttttttttagtattgttattacttgtaactgtctgtgtgagtgcagagatataatattaaaatttatcaaatttcagggtagtgatattaatcatttattttagtagcaaaattaaatgttaacattcaactgtaagattggaagatttaactgtcttttcccccattgaattaatacagaacaaaaatttatatttctgatacagacaggagacagggaaatactgggtagaagatgatggtgccctgacaaaggctctgccttcaagcctggaagcccatggctctaagtggcaacaggcattcctgttttcctgcccaaaagttgccttttcacctgccatgccccactatcctgtacccatataaaccccaatccccaggctccagaagcaggcaaggaagtaacaaacagaagagtagaagaatagcagaatggtgtggcagagagaagagaaggaacatctgaacatcgagaggagttcagctagggatggttggagaggagattggctgctggatggccaaactccaggggaagatcatcttcccactccatccaccttccagctccccatccatcccactgaaagccacctccaccactcaataaaacccccgcattcatccttcaagtctgtgtgaaatctgattcttcctggattctggacaaggacctgggtactgagagggcactgagctggttaacacttaagccatctgcaaacagcaaagctaaaagagtgcactgtaacacacgtccacttgggctttgggagttgcaggcacccacccttagatgctaccatggggccagagcccaaaacacactcagcctggctcctgcacctgcctgtgtgcccccctcccataaggggtttgagtgtgcagtggcagaacatacgagccacacccctgtcgcatgtcctgtgaggggggtcagggaactctaccgtttcatttccactggttgatatgagattttgcaaatgatacactgtagatcagatactctcaaagaaaaaaaaaggctacaaagttgtagtgttcaattaccttattcatgaatacttttttcctaacctaattaactcaatatcttggcatcactaggactttgagctttacccaatacgggtttctttcttcccgaagcgtttgttttactgccccattttattgctttcaattaatgaaatctgattctaaaaccaagagttcctgaggtgttagccaccaccactatcctccctgctgtcaccttcattctatctgttccacctatcttttgaggacatctagagttgaggttattaaccttatatcatgttcccttctccccccatttgtactcattttgtttagtgtgggtaattcaaatgtaaattgttttggtcacaaaccccaactgcttgctcacagaatagcctgcaatctgccttttgcaatgatcactccttcctggagggtacgttggcatcattgagtctgatggcacctgcttctgccatgttagaacactgcctgcagccctaggatctggacttcagtcagaccagcaacatattcgcttttttctcttctttgtttgcctatttctctgtcttctaattgttttaaaggtgaaggagagtagtagtacagaaataataataacacaaaattaaaattaaattaaaatgtaaaaaataagtacagaattaatttttctctggcttgattttaaaatgttagttccaagtgctttaggttggagatgtttccgacccgagcatgtcttcccccacgtaagcatcccttcacacattctttgaaatcagctgctctgatcctaaatgtaggcctcacgtctcaccagctgtataatcttgggaaagtaggaaactcactttacttctttatttctgggacagggatcctatctccaagagttgttgaaaggattaaatgatacagtgcacttaatgttcctggtagataagaagtgctctataagtagtgaccatttttatcatctgtgtagatgttaaagtttgccaggatattctaggattatatactctgcaattccgtgctgctttcatacgtttgctctgataaaacttccctaggacactgagaaaagatttttcagggctgactaagccctgcttaaatattttccagctgttctggttcttaagaaagaaaaaaaaaatagattcttaaaagagaattaactcatttattcttactctttattctctgtgtctgaggggagaccctaccaacctcccatctatgactcccagtaatcacaggatacatcattgtctgggaagagagggagagggccacaggcttggcaaagtccgaacttccggtcttcctgctttccaatatccccaggcttctggccttgtacacggttaacgtgtttcagctagtgctgagtgttgcattctgccccttcaaccagatcacttccgctgaaagtttgcatctcccagtatcagtgttggggaagccaaatgaaatctatcaatcccagttcagaatgtaaagaaactgaagatcctctttccccatatggattattatatcatcatagcatttggagaagccaagatcaacaaaaaagcagttagcaggtatgcatgtgtgtgtgctatttgaacattacacatagtaatttttcagaaaagattctcatctctgaaaaacttttcctccctcaagacaaaaagaagtatagctcatttcattttaggatataatctgtctttgggcttcagcattttaaaattagacatatctttgatagaatattctttcaattgttaatttctccaagaaagttcagctctctggaatcagattgagattttttgttaaatccttatatttgtcttcagtgcattcatgttttaaaacaatacattgaaaatttggaagtgtttttacttcaaataactacattgtctttttctaaaatgagaagttgcagtgttccatgttctgatttgatatttttcctgatttctgttagtagtcttggatgttttctgtacttgtatttggagtatgcacacttgtctgagacagttctatttctcacagtcttcactgtgccacatatttgcttccctgtcatcttcaaaagagtgggctaaggccaggcgcggtggctcacacctgtaatgctgacactttgggaggccgaggcgggtggatcacgaggtcaggagatggagaccatcctggctaacaaggcgaaatgctgtctttactaaaaatacaaaaaattagccgggcatggtggtgtgcatctgtagtcccagctacccgggaggctgaggcaggagaatcacttgaacccgggaggcgaaaagttgcagtgagccaagatcgcgccactgcactccagcctgggtaacagagcgagagactccatgaaaaaaaaagaatgggctagagcttggctacactgcgagatttattgtctttgaactgccacttattctgagctgctcacttccattaatcagcctgacttaccgactctggaattgtgtgctcatatcagacaggttgtggctaaagtccatccattacatttctaggccctcacttctctgtacaaccccagttcagtcatgctggcaaatatgtggggagcgctcagccctgaggagttccataagggaaagttccacatgggcttggattatatacctaataactcagagcaaatttgtgaaagcttcacatgtcatttacaatttgtaggcactgcagaactgtagattctaaagagagaaggctatgccttctgatgatagtcttaaatcatggaaagctaaaacaataaacacctcaaattcagtgtatctttgccttggaaaaagggttagacttcatggttgcaattcacctcactcgcctgtggttcattgattctgacatctaattaaattgatcatctacagtgatcacaaggcgattgtttgccaaacactactggcaaagaaaacttagctcatacttgtaatttactttaaggtttctatccggaattgggaacaaataagaaattggttttgactaggaaattgtacacaattgtaatcataatttggactggaataataaccactgtgcatttgcttgtttctgactttgttagtcttcataatattcctttcaggaggttggctatatttatagttaactgaattttgccaatgttttctttccacaaagcttgttgtatttaattgtctttaagaaaagaaacgaaaagtatctgtcaactttcaagaaataaaatgtttttgttaaaaatcaatatttattaaagcgaatgtcttttgaaaattcaagcaatatataatttgcaaacatttgattaaaatagtttcagtaatatatttttagcttgaatgggtcaagataataaatcaatattttctctcaaattctgataacgtgtaaaaaagttctttgaaacaataataaaacttaagaaaaagcagtcagtaaagctactgatgattctttatttccttttatgagataatcagtcttttgacttcagcattttaaaattaaaaatacctttgatagaatattcctttcactgttaatttctccaagaaagttctgctctttggaattagattaactaatgatattttttgttaaatccttatatttgtcttcagtacatcctagtagacttgtttagatagcagacccaagagttaaattcaaataattagcaggaatggaaaatagaggattctaatttttcttaagaaaatgctttcttatcattggcaaaagaatgagtttattcacagacatttttattccattattctgtgagtaaagaaaggaagaggaggcatgttgaggttttcttttcctaatgatgttacattaattattgtagccaagatacgcttttgaatacgatacaaaaacatacctacaataatgatcataaaaatattcctttttccatcgctgaaaattgcctttatttgacaggatgatcttctatgcatctcatccgactgtctgtatttcccttctgctttggtggagtggggtgagagagagagagagagagagagagagagagggagggagggagggagggagagggagagagagacaaggcggaagcagagcctttgcgggtagagcagataaagattcccagacaaatttcatgggtgaagtggccaatttacttcttttatagctgaatgtcattttttttgtggatttttccatcaagtagtgaaaactcacatattaataatattcagagtctcctctggccatttaagcaccctctttgtccagagtcaagtcagattcttggcggccctcctggcgccacgtgtgtgaggtggggggaggtttctcacccttggcgatcctctcctccgcacaggggcgtctgtgggggtgtccgccattttgtttggtctcagctgccagttcccagaggaaccctctcttctggccacacgcccgcttgatggtcacaggcctccgtcagcggcttctccatccctctctggcaagctgaagtacgtgacgacttccctggccctctagggttctcaggccgtcaggtacgggtctctgtcaatctggcacctgacagctgagacaaacgaaaaagacgctccgctcgctgattcctgggccgcgcggggtcacggggcgctgcggctttcctggaatctcctcaggattcaggcacaccctgtgctctcaggttcactaaacccgtctggggtttctacacacgacctgaaggcatctccgccctttggcggcagatagaggaatagaaacgactgaggagacatgaagcagggaggaaaagctggatgagaggaagcacagggagtggaaggcaacgtccaggagacacggctcctgatgccctttcgtctcggtgggctctctgtggcgaaccgttgtctgcttgagaggaaaagggaagtcatatttggtgccatcctctggactccagatgtttttgtgcctggccataattatatatatatgcgcatatatatatatatttgcatatatatatatttgcatatatatatatattttgtttgtttgtttgtttttggagacagaatctcactctgtgcccaggctggagtgaagtggcgcgatctgggctcactgcaagccccgccttccggcttcccgccattctcctgcctcagcctcgcgagtagctgggacgacaggcgccgccaccaggcttagctgtcaaattagctatttttaaggtaatcgattctgaaaggcaagtcagaatgtataaagctcaaatgaacttctctatgttacacactgtttctgtaccattcagtcttgactccactcttcctgccgccctcagtctagttgcagtccaggtgccctgttttcagttcctaaaccacaccatgtcatctctagcatcaagcatttttctctacagcatttttccttcctacctacaacccatactttatatagttaacttctattcctcatttttatcttcatttcgagtaacagacttgggaaaatcttccataaattcgtaagtttaagtggagaagcccttatgtgtgtgtccacagtatcccatagcgcttggtactgtgttaccataacacacaccactgccttgtcattgtctatttaccaccagactaagtccaagaggcttcttttttgttttgttttgttttgtgtttgtttgtttgagatggagtcttacactgtcgcctgggctggagtgcaatagcgtgaccttggctcactgcaacctccacctcctgagttcacgcgattctcctacctcagcctcccgagtagctgggattacaggtgcgcattaccacgcccggctaattttttgtatttttagtagagatggggtttcactatgttggccagactggtctcaaactcctgaccttgtgatccgcccacctcagcctcctaaagtgctgggattacaggtgtgagccaccgcgcccagccccaagaggcttcttgtaggtcttgtctgttgttctattctagtgccttgcacagtgcttgaaatatggaagaatctgtaaaaaatcatattgagtacagttggctctctggatccgtgggctccacatccttggattcaaccaactgtagattgaaaatattcaaaaattaaaaaaaaatcgcatctgtactgagcaggtacagacttttttcttgtcattattccttaaacgaaaccgtataacaactattcacatagcatttacattgtattaggtattctaagtaatctagagatgattaaagaaaaagcgaggatgtgtgtagcttatatgaaatagtgtgccttgttatatcagggacttgagcatctgtagattttggtgtctttgggggtcctagagccactcccctgcggatacggagggatgagtgtatggaggtggtaaatgacttgctccaggtcacattagtgagtgaaagagcaagggatgtgctctcggccattcagttctagaatctgtgcatttaaccacgatgcatatagccagacacagagctgttattccaaaacactgagaattagtaacaagggctctttaaactattggatctaaactaatttcaactagattaaatctacttcattactttttacaaatgttgtttcctgggtggggccttttggaatgatgaagttaattatgaaataaaaatggaaaaatgaatttcatccaaaatacattttctgcagatttaaatgtctgtgtatattacatatacacgcatctgtatctatgcatgtctttacatagatatatccataaatgtatatgttatatacagcgtattagggatagttctccagagacagaacacacgcacatatatacacacacacacacccacaccctggcgcacacacacacatccacacacacatatatgtgcacacatacacacacacacacacaccccgccaagcacctcgtaacaatgtttaacagaagaccacatagacaatggtggtaccatgacatgagattctagtggagctggaaaattcctattgcctggtgatgctgtggccagaataaagtcatagtgcagcgcattactcacatgtttgtggtgatgctggtgtaaacaaatcgtgctgccggtcatataaaagtatagcacagcccaggcacggtggttcatgccagtaatcccagccctttgggaggccgaggttagtggatcacctgaggtcaggagtttgagactagcctggccaacataatgaaaccccgtctctactaaaaatacaaaaattcgccgggcatggtggtgcgtgcctatagtcccagctactctggaggctgcagcaggagaattgcttgaacccaggaggcggaggttgcaatgagccaagatcgtgccattgtactccagcttgggcaatagagctagactccatctgaaaaaaaaaaaatatagcacatgtaattatgtacagtacatatttgacaataataataaatgactgttacctgtttatgtgtttactatatcgtatgttttatcattatggtagagtgtatttctacttacaaaaacagtgaactgtaaagcagcctcaggtacctccttaaggagctcttccagaaggcattgctatcacaggagatgacagcttcatgtgtgtttggcccctgaagcccttcccgtgggacaagatggaggtggaagacagtgatattcatgatgctgacccccgtgtaggcctaggctaatgtgtgtttgtgtattagtttaaaaaactaaaaattaataaacatagaggaaaacttatagagatataaagaaaatatttttctgcagctgtacaatatgcctatgtttcaagctaagtgttattacaaaatagtcaaaaggttaaaacagtcaaaaggttaaaattaaaagtttatgaagtgaaaatgttacatcagccaactttaatttattaaggaaggaagagcgtttcttttttaatgatgtagtgtagcctctaagtagttttcatgaagtttgcagttgttacccagaccttcataggcgctcactactcactcagtgacttacccagagtagcttccagtccttcaagctctattcatgtgaagtgaactacacaggtataccagtttttatattttataccataattttaccgtcccttttctatgtttgggtacacaaataccattgtgtttccgttgcctgcagtattcagcacagtaacctcctgtacaagtttgcagcctagaacaataggctctactgtctagtccaggtgtgtaggaggctgtgccaactagatgtgtgtaaatgcactctagaatgttcacacaaaggcaaaattgcctaacaacgcatttctcagaatgtatccccccttgttaagtgacacatgactccatgtatatatacaaagagagacatagagagagagagagcgtgcacacacaagaatgacagggagagagagatttattataggattattatgggaattggctcccataattctaaagactgagaagtcccatgatctgctgaagaactaggaaagccgatggtataattaggtctgagtccaaaggcccacaaattaggaccaccacactagctggctgtggtgtcagtatctgtcatcccaccgatttggggggctgaagtgggaggatcacttgagccaggagtttgagaccagcctgagcaacatagagagaccccagctctaaaacagaaaaaagaaaatcaggagcaccagtgctccagggcaggagaagatggatgtcctaggtcaaacagagagaaaattctccctttctctgtgtttttgctctatttgggccctcagtggattggatgggagtgcccagctgcttagtgaaggtgatttcctttactcggtatactaagtcaaatgctaatcttttctgggaacacattcacagacacacgcaaaaagtatgatttcccagttttctaggcatcctttagcccagttaagtgggcacgtaaagctaaacatcatatacatgtatgtatgaatatatacatgttccttaccctggatttctctttccctgtcactcttataatttgtgtatttatttggggaaagaatagttatcaagaatttctagaggaagccaactgtctacataagcttcagagttacaacgcctaactctatccaatctaagttaaatttaagaatgaatgttgagtacatctggtttgtatatggtgttttggcagagctcaatttaattcatctcaaaaagcatccagtgagcacataccaaataatggcctcatttcaggctttgggctgtataaataacatacatcccaatgtggggaaaccagacaataaacacaataatttacagagaatttaaaggaggatgagtgtcatgagaagaaaatagtaaaaggtaaggaggagaggaactacatcgtttgggattgcaattttaaacagagtcaaaacttgaaataattttagtatgttgcaaatatatctaaaatacgtaggacgtcttgcatggtcacgtaagtctagaattcgaaaaatagctagagaataaactgaaaattcaaaattaatatattagaaaaattttggaacttttatattatagcaaggtaattaaaatattttcataaatgtacctttattttgttatcaggaattaggcaaaggctgttgaaatattcgcaaatacaacccagctctagaaatcaggaagtggtgctctacggatatgcaggagggagtgctgaaagaacagctcatgaggtagtgcaggcagaggcaggttgatggcagcagtgactccaatttgctctcactctgtgtctccattcactttggtagtgcaggcagaggcaggttgatggcagcagtgactccaatttgctctcactctctgccttcattcactttggtagtgtcctcttacacagacgctgggattggaaaccagattgctttgacaaatgggaaattagcaaatatgagatgtgcagcaacttgagaagtgctcatgtgctgaggcatgtttattgatacacttagagacccgagaccactatgcaaatatgcgcccaccagccctctggaggatgagatgattgcctccaacaactgagccaagcatggttttatttttgtttttgtttccgttttggttttcagatggagtctcacttttttgcccaggctggagtgcagtggtgtgatcgcagctcaatgcaacctctgcttcccaggttcaagcaattcttctgtctcagcctcctgagtagctgggactacaggagtgtgccaccatgcccggctaatttttgtatttttagtagagatggggtttcaccatgttagtcaggctggtctcgaactcctgacctcaggtgatccactcacttcgtcctcccaaagtgctgggattacaagcgtgagccactgcgcccaaccctgagccaaccatggtttaaccaccagtgatctgagtggccaggtggtctctgatgatccacaagctgaccaaggttatcacagatgctcacataagtctagcccagaccagaacttccaagcagagtgcagctgaaattgctttcatagaatgagctaataaatggtcgtcatgttaaaccagtaaggttaagtggtttgttacacagcaaaagctaactgacacagtgcatttaactacttcaattctgatagcccatcacagaatattttagctaagaactacatctaatttatagtcctttatatttttttctgttggaagcatttcatagagacaaactagttgctatttaagtaaaataatgcaccattatgcatacgtttttgttacctatgtagacaatgagaaaatagaattgttttaaattcctagggacacttataagttctaggttgacatttatcaaattttcattattatgtctaagcacagtctttccctactacctcccaaataaagagttacctgctaggcgcacatctatcccacgaatttgtcagctcaaaggaacaaggccagcagttatgcttgattatacagaataaatagagtatgaaaattgaaattagacacacttactataaaatgtgatgattatttccattccaggaccaaattgaattaaaaaaaacttattgatctggattgaatttcaatttgctaagatttgagcaagccaacttctgcccagtaatgtttgaatagaaaggcttatgaggccaatagtctgttcatcacaggtgataaagtttttttttaaagtcaataaattactttttactacaggagaaacgtatgctttatatgccaacaaagagttgaaatgccagaagcacttgaggactaaattacggagcacttatttcatcacaacagaacgctaacgcgggtgcttgattacaacaagccatccaattgcatgaatttgggctgcaaggcacccaggcttttatattcattagcaaagttattgattctggaaagttacctctaataaaactacaccattttctcaggcctgttatatgggcgcagacaaattatttgatcaacgatattgagcaaaaggaaaagcattcattgtctctaatctcttttccctcctcccagaattgtacatggcgatcatcagcagtatgaagaggagctgtggggccaggtctgatttggttttatatagctatataaatatttgataattaaatcacattgtttcaataagaatattaaataaaagctaaagttaaaaatgacaaaataggccgggtgtgttggcttacgcctgtaatcccagcactttgggaggccgagatgggtggatcacttgaggtcaggagtttgagaccagcctgaccaatatggtgagaccccatctctactaaaaaatacaaaagttattcgggcatggtggcaggcatctgtaatcctggctacttgggaggctgaggcaggagaatcacttgaacccaggaggttgaggttgtagtgagcctagactgcaccattgcacttcagcctggtcaataaaagcaaaactccatctcaaaaaaaatgacaaaatagtataatattatattcataaaaataattttacatttacacaaaggtgtaattcactgtacattagcttcaacaaaacatccataagttattcaattcccagttatcggctgcttgaacttttatgccctttagctccatctgttaaagaacgcatacctccatagagctcccataaaatagtttttaattaatttaatcaaagaatattgttccaagaatatagttaatacactgaatggaatttttataaataaaattaataaagatggaaatgtgttacttaaaaaataagattctagctattctatcattgtttgtgtttccatttaaatattagaatcaccttgccaaattccacacaaaaatcctgctgatattttgattggaattgcattgaatctattgcattaatttggggaaaattaatatttaaaaatagtgagttttccaatccaatcacaaagtataccttaccatttattagaaatttaattttctcagcaatgttttagttttcagtgtggacattttccacctattttcttaaatttatctctaaatatgacatattctttatgttcttatataaatatttaaagttcacattcataagaaaattcaaaccaccaactgggagacattatttgtaaaatatatgtctgacaaagaacttgtatccaaaaggtataaataatttttgcaattaaataataacaatataaagaaaaattgcaaatatggaaaagattgagatacatttgaaaatagaaaatacatgacccacaagcagattaaaagctgctcaacaccatcagttatcaggaaaatgcaaattaaaatcacagcaatttatccattcacacactaaaatgattacaatttaaaacccaatagtaataagatttggcaaaaatatggggcaacaaaacttctcatatactgctgaacagctttataaaacggtgcgaccacttaggagaattgtttggcagtttcttaggcttagatatttgtgccaaagaattgaaacctggttcacaaaaatacttgcctagaaatggtcacagcagcttgattcatcatagccccagaagagagacaacccaaatgtccatcacatcacagacatgggaaaatgaatcaacaacatagatctcatgttagtctcttctaagtggacaggtttttattttccaatccagtaagacaaattctctagaaaacggcatagtacccacctcacaagttcactgtgagcattaaatgaattggtttatttaacacatgtcaaacattgtctggaaaattcagagcactatatattcagagcactatgtatatgagtcttggttatgagtattactgaaacttctatgtgccttgcttttcctgtatttcttgtcacctcattccccttcctcatggctccttttgaagatagtatttaatttacatctccattactgtttggaagctatgtcctttgttatactattttaatagtcacccttaaaatttgaatgtgtgtataaaacgtaagtcctaaagttaatcagtgtctttactttcttcaccctcagattcaaggacctaagaatgatttatttctcatcattcctttcaaatcacacttgcagttgtatttttaaaatttctgccttgcttttataacccacaaattagacattgtttgatattaacaaaagcaagagtcagatctcctctgtgttccttgtctcccttccttgatacatttcagaccttccttatgggaccttattctttgtttgtttttgaagcccaaccttagaagctgttttatgaggcttatttagaagtaaactctttcaaaatctgctcatttgtctttattttgtcctcattctcgaaagatactttagccgtataaactattctccattgcccattattttctctgaacacattgagggcgtttcactgtgttcttgctttgctcattgtttttgtggctcagctagctgtcagtctgaatgttccttcgtaggatgtgcgcttgtttcttctagatccctttgagcactgtagacgcaggtcctctttatagtacaattttggcttgtgtattgaggttcgcataaacagtatgggcttaggttcccaaccatggcagcccagtgggtaccacattaacaggggtgaagtttttactttttctccatctttatgaaaattgagacaggagttaggtagattgtttttccattctcaggggtctggctttatgcagatggtctcaggtttgaactctaggccacaggacactgggtgtggtcccagggagtctggtggcttcaatgctagctttcctccctgtgctgtgctcctgcctaggtcctgcccacatggacttccttcaccttcatgcaggctcatccatgctttacacgttatgcatgcccatttgtgtgtcccaacttagcattttgatttgttatatgaataaaaatcaagagagatgcaagatccgtagtcagtcatatttgtggaaatcgaaatcccccacacattttttcatccatttgaatttattaagtttgaggaaaatgtcttaacaaataagcaagtttggctagtcctagaaactatatctctaacttctaacttgggagttactgtaccaattatatggtgaaaaaaattatagttcataattatttggtattaaaagagacctaaaaattattttttattcattccttttacatctatgaggcaaaatgacaatgcaaaattatataaatgtgattatctacccgcaaaatttggattaaagactattttcatgtgaaaaatgtgaaaaagataaaacgtcacacagactgtgagaaaaaatgtactgttttcacatgttcttgtaaatatattcttatcctttttatctaacgtgtagctaaatatcaaagggccattgactatatatatatatatagctgatgctgaaaaaggctgttgaattgtttcaattaacaatatagcaaaaatactaaagcctttcacttttttttttttttttttgagacagtctcactctgtcgcccaggctggagtgcagtggcccgatctcagctcagtgcaacctctgcctcccgggttcacgccattctcctgcctcagcctccaaagtagctgggattataggcacacaccaccatgcccagctaatttttgtgttttttgtagagatggggtttcaccatgatggccaggatggtctcaatctcctgacctcatgatccgcctgcctaggcctcccaaagtgctgggattacaggcgtgagccactgtgcccagccctttcacattttatatcttgtaattctctattctgctctacaccatagggatgatccttccaaaagcatcctatctagattctgctgttaaatcacctttgttggcctggccagttatcaaactcaacagccccttcatcatcaaagactcgccctctatccgcatctcattccttgcttccgccaataatctgactagtaaagaagtcactgcatgccacaaattgtcagtgctgacttcctcaacaaggaagttatttatttacttatttaatatatgagtgactcagatgcaaattccatcttgagaataccaactcctgatgccaactgattgtcagtcatggctacaacaggagactggattcactcaaatagttcaaataaacagaacgtaatagagggactacttacagaagtgaagcagggttgaggaaagacacaggggatgttgagctactcagagctgcagtgacagcatgtggaaatagaattactgaagttccataaggctggaattgtgagagtctatccaggagtagctgaatttgcagaggaatgcagctgtccacagaaaaacaatggcaaaggagcaatgcagcagagaagacatagtctaatttctctttactttctactgtatgatatggtagaaggcttgcttttggctgtgctggaaaacatacagaaaggaaaaccaaaagataagctttatgttttaaaatctccactcaagatgcaggtggaaaattagaaagccactgtggtgatgttaaaatatatcttgtatgtctgaagtcagctacacaaaggagaaaacatcaaaactaattgcattgattgtgtagtttcagtacctgttaaatgcataattccatcgattcagtttggcaatggctgagcaactaactgactgtaaaggaaaaggaccctaagatttagtatggcaaaccgagataaagttaagaaattctagcccaccaatctcctgaaagctctttgtagccagaatcacctctgcctaagttgctcttggcttgaagatctgctctgagaagagataccatgtacgtcaatggaactacaaaatcttgaaaacttatgcgagaaggaagctggaaagcataaaaaaaattaattcttataaactttttttttctgccttctcttccctctctagctataattttggatttgtctatttttattttcatttatatcaaatgttgtctcatatattttgaagctgttatgtgatgcttgcatttaggattcttgtgtcctcttgatgcattaacaccattataaaatggctttctgtaccctggcatccctctttttcctgatttaatatgcccacagtagatttcttattattagaacttatgtagtacatttttgttcttcctgttacttttaaagtgaatttcttttagatggaatgttgttgtgtctatgaaaaaacagtctatgttttaaaatttagtatttagactatttacctttaatgtaattatgggcatagtagggtttaaatctaccatcttgctattcattttctatttgttccatatttttcttatttcttttgggtttccacctttttccatgttaattgaatattatttaatgtttgcacactatggccttattagctacagctctttattttattttatagatgttgtttatgggtttacaatctttaactcataacaatatactttcaaataatattttaccactttgcatataagaccgttaaacagtgtactttctgtctcctgtccatttttaatttatcacaatgtaccttcaaatcatattatccattttgaaaataatataagaaacttaaaacagtatgtgtccatttttctcttttttggagaattaccatgcattttatttctgcatatgttataaatttcacattacattttcttcttgttttaaactgttaattttattctaaataatttttttaaatgagaaaaaaaattgaatttacccccaaggtagcattcttgtgttctatcttttttgcatattttaaatccaagtatctatttgatattattttcttttattataaataacttatttctgcatttattgtagtgtaagtctgctgttgacaaattaccccagctttttttttctaaaaagtttatccttatttttgaatgatggttttgctgtttgctgaatttacagttctaggttgacagtttttaaatttttaaagtaaaattctaacaccttgtttttgcttcatttctgataagcttcagtcattctcatttttgttcccctgtgtgtagtatgtattttttctccagttgttttaaagttttttcttcatcactagtttacagtagtttcatttttatatagcttgtggtgcttctctttgtggtttgtcctgattttagtcagctgattggtgagtgtatagctttcattaaaccagtaaaatgtttagctattttaagtattttcctacctccttcctccccatcctgctcttgctttctcttggactctacttgcatgtatgttagattgctggctgtttttctactgttcactgattttgtatcttatttttagtctttttttctcaccttgcttcagtttggatagtttctgttgcaatattttcaagtatgtccatctttcctttcacagttttgagtatgctcttaaatgcagtgaatttttcaatttaaatattgtattctgggccaggtgcggtggctaatgcctgtaatcccagcactttgggaggctgaggagggcggatcacctgaggtcgggagttagagaccagcctgaccaacatggagaaaccctgtctctactaaaaatacaaaatgagtggtggcacatgcctgtaatcccagctactcgggaggctgaggcaggagaatcactagaacccaggaggcagaggttgcagtgagccacaattgagccattgcactccagcctgggcaacaagagcgaaattctgtcccccgccgaagaaaaattgtattctttagtcccaactattgatacatggataaggtgtaccatcgccaccaccattatcaacatcataacaacagtgttttatagcacttttaagactataaatgcttttatatatattaacagattttacactcactgaggcttggttatttccatcttaaagatatgaagtgtgaggctcagaaaataagtcagttttacaaacatactgggaaaaaaattgtatgctagaactgaaatctaaatctatccaagtcaatttttatttgctacttcatgctgcccatatctatagttgatcttttaccataccatgatcttaggagactaggaaacaataaaaccacaagtaagaaaatgattctttctatacgtttcaaaccaaatagctatctaagacaatttatccagataatccaagtcaaataaaagtatgcttcagttctctgaatattataagcaaaagtgtaaaagatagctttgtgcctccagtgaagagcagtcaggcaaccagaaggcatacctagcaatataatatttattatttcttgagcttttattgttcggtgttcaatagtcctgtgagatagttctcattattctttatttatacatgagaaaactgtctcacagaagttgcataacttgctcagagtcccatggataataagtggcccaggcagcacttgagtccaggtcagtcttgctttttccctttcttattcactgtcctaccttgcctctatgtttgtgtcccttcttagtcacttctcttgcactgttgatttgcctttttttaatacatatgtgctttatttactgcaattgacaaataattgtatcatttatggcattcaacacagtgtgtggtttttccttttttttttttttattttgagacagagtcttgctctgtcaatgaggctggagtgcagtggcatgatctccgctcactgcagcctctgcttgctgggcttaagcgattctcctgtctcaaccttccaagtagctggggccatccaggcatgcaccaccgtgcctgaattatttatttatttgtagagccctcttatagaagtctccctatatttcccaggctggtctcaaactcctgggctcagcaatcctcctgccttggcctcccaaaagccctgggattacagatgtgaaccgctgcacctggcctaacatgaggttttgaaatacatatatattgtgaaatggataaatctagctaaacacatacttatttttttatctgtggtgagaccacttaaagcctactctttcagcaattttaaagtatatcaccatggggtacaatagatctcttagacctgtccctactgtctagatggcattttgcatcctttgaccaacatgctgatttatctttaacatattgtattgctaccttgtggtaggcagaactttggtcgtcgtgatctcagccacctagcgttacatcctgttatgttacatggcaaacaggctttgcagatgtaattaatgttactcctcagttgactttaagatagggagattaacctagattatgcaggtgagctggatctaatctcatgagctctttaaacgtcggaagaggagggtagaagagaaaatcagagattataagtgaaaaggttggagatgtcattactggcatttaagataaagggggccaaaagccacagaatatgggtgccttcaaaagctgagccaatagctggcaaaatcatgagaacactcactcctgtagcaacatggagctgaattctgccaacaatctaaatgagcctggaagcaggttctccctcagaggctccaaagaagagcccaggccagctgacagcttgacttgcaccttgtgtgcccctatatagagaacccagtcaagccatgctgtactcagacttccaactcatggaacctatgagataataaataggtgttgtgttaatttattatggcagcaatagcaggctaatacatactttaggaacaattaatttcaaatttttgtgtgtgaactctcctcattcactatcatgacacacaaacacattcacccacacactctcagagatactcaagttgtatacttccagaagaggctttctctgtttttaaagtctgaagttctcagcattctcactgagccatgctatcacttttgtgtcactttggacagccttccctgcttctgtcatcctcaactttttcttgcattgtctgttttcccttttccctgtttgcacctcagttcttttgttttctgttaatattaggacctgattatatacacagctagtccacaaacacatgtatagttttcttcacaaaaaatcaaggaaggacattgcattgtgtgaagtgtttgcatctttatatttttattttatacttactgcaaagtggcatgtggatacttttctactgctggacacaaaggtatctattaagatagaaatattcctcatacacgtgctgtaggattcttggaactgaagaaaatttggcctctaaaaaactgtattatcataatcataagaattatatttgatagagtttctaatattttattaacatcaggagattcgattgaagtcaacatttgcaatttaaatgtggtattaagcactttgtttaaaggcagaataattataatgcatcaatgtgtatgtttctacaaatttgacaactataacacatgccacttaaaaccttatttaccatgcgcagtctcatataaatacaagctgtaagtctaagagccaccctagattccattctcttctttacctccagtgactagtccgtccccaaggtgagcttatttttcttcctgaatgaccctaaggggtaaaagtagatttgatagttggggacgatatgatttgtggttatacagaaaaacttttaactactgacactatacaaagctctaacttgtcctttggaggaaaatatttttcttactaacatttactgattagacatttagtgggaatatcaggcaacgtgctggtttcaaatggttggttgcaggtccctttcaaaaatgggcatttccaattctgcgtcaacatcattgtttacacagctgcagagagcacattcttccaggagcaccttcagggctttccgggaagcttctgggcttcgtttgtttggaatcctaaagcaagcagcctttcctgaaaagaatgtcctcaggaaatactttggaataaattaaatgatatttttaggcatttttatcgatctgttgtttagagacgattttgaatctgttgacttattttgtgataaacagaacttttacagcatctcaatggaatctgatttctagattgacttgccaccttgaaatgataattacattgtttttgagaagtaacatctttgtttccataacataagactttcagtttataacacaatgtacaattggggcttacttttttaaaagcactgatttatttgaaacctgtctaaatttggctaggtttcataattggagcaatcatcaatatagtatgaatgaccttatacaatataattttattaaataaaatatttttattaaaactaaatgaagtcataaaaatttgattttttttctaaagaaaaagtgtattgaaatccatggacctaaaatgtggcttattattaaaaaaatcctatttaaatatacttttgaaatagatacatgtttctagcatattttattcaccctgtacttactctcttatgagaattactccacagaaagtcatcttgttttatgaaaataactaagaaagtcattgtttttcttcctgacaacatttaaatgttggaagccacatctttattaagttacattcagctgattgcatttatgaaattaatctatgaggtcaaaaaagaatgaaattagtattcaaaagatatcactaataaaaatcattgatcaatttaaagaagttattaacatataacaatgttaagtagttcattatactttaaatatttccagtctattattagttaaaaagtaaatctgctagtatttcccccccaaattcattatttcaccgaattcctctcatctgaacatagcttagctgtattaagatgttgcgtaagacggctctcagaagctacttaatttattctaattaacaaatgtctgcattcttaatgtgttaattattagggctccccaatctcttattcgattttttcattcaacaagtatttattgaatgcttattatgtcaaaccctcttctaaatattggaataatagtaataaaacaaatcgaagtttatactctcaataagtttatgttgtaatgaaggatgcaaacagtatatacacactgcaatgtcagctagtgataacttttgagagaatagtgaaataacatacatacagggatagaaagtgatgggaaagccttgtctccaccgtccttctttccctctcagagctccagccaagtactttctccagcagtcgtgttaaacacactcccttctattattaggcatgtcctgacccctctatctgaaacacttgccctttgcctagctaactgctattcttcagtcacagtcaaatactgctccacaggcaagccttccccactcccagccatgctcccagagcatcatgaaacttccatgaaatttgacattgtttgtatgatgatttgttcactctattctcctcactagagcatgggattatatatatgtaatattactatatatatggcatagagtgaatgttcaatagaattagttgaacgcattattttaagtataatatatcaagaagacaggtttcaaagaccacatattttaaccattctgttcatacgggatgtttagaaaaggcaaatctatggaaaaagaaggtagattagtgtttatgttaccgaaacaccaggggttcggtcaaggtcctgctactcgctgcacagaaagccaatgattgagacgacgagtattgccaaggaagaatctttaatcaggtgctgcagctgaggagatggaaactcactctcaaatccacctccctgacctgctaaaaccaggagtttatataacagggaaaaaaaatgcaactgtgtgtaagaaaacaggaactagggagacgcaaggaagccatcacggtgaatgaggggtctggcatctcattgtctggatgtgatgatctggtgagtttcagttgtttgatacttttttttgagagacctgatggtcattttctgagggaggaactcagattaaacaaatataagtttcaagctttaagattagaagggtcaattcctatatttatcagaaaatatctatgagaccactgggtcagtttcatttacccagggctgagagagggaatggggattcactgctgactggcctgagggaacttactggaaagatggaaatgttctaaaactggattatggtgatggttgcagactaagcaagtttactaaaatcactgaatcatactaaaatcattgaattgaaaattagatgaattttatgatatgtaaattatatctcaataaaggtctttttattttttatttttctttttgagacagtgtcttgctctgttgcccaggctggagtgcagtggcatgatctcggcccactgcaacctctgcctccctggttcaagcaattctcctgcctccgcctcccaagtagctggtactacaggtgtgcgttactgcgcttggctaatttttgtatttttagtagagatgggattttaccatgttggccaagctggtcttgatctcctgtcctcaagtgatctgcccgccacagcctcccaaagtgctgagattacaggcgagagccaccacgcccagcctcaataaagttctttttttttaaaaaaaggtagtgactaggggaagtgtaaggatgtgggagtggccagggaaggtctttttaaggagatgctatttgaatagaaaattgacatgaaggcaagagccccaaagatgtctcgggacagagggctcctggcaggggagcagtggggatcttaggtgcattgctatgttggaagaacagtggggagtccaggtggctgtggcgaggtggaatgggggccacaggaggaagcggaggctagggaggagccagttaggtatgtgaggtttggttaattagggtcagggtattgaattttattttaaatgtgatgagatgctattgaaggattttagcaggagagcaacataatttggtttacattttgacagagtcactttggctgctgtacggaaaaacagaagcaggaagcccagataagaaattgagtagccagtcacgaaatggtggtgttatggatcagggtggaacggtggaggcggtgaaaagtatgtatcttatagatagaaatatgtgagaatatcacagcctattctaaaaactgctgaatcattgagtgcatatagttggagaagtgggtggagcagaacagcataagaagagagtaaagaagtgtgcagggtcagattacatgaggccttatagggcgtgggacagagtttcacttcatcttaaatgcagtgagaagtcattggaggatttcaggtgcggaatgatacagtcggactcactcacatgaagattattctgtctgccaggtggagaagagctcataggggaagaagcatagaaacccaagagcaagttaagacactaatggcagaggttaggcaagaggtggtggtggtgtagattgggacggtggcaatgcagatagaaaaataagcgtatacaagggctcctttagaattggaacagatgggataactggatatgaggaagaggaaactaaagagtgaagcatttttggtttgggtaactgagttacgcagtttttttttttgagatggagtctcactctgtcacccaggctggagtgcaacagcacaatctcagctcactgcaacctccacctcccaggttcaagcgattctcctgcctcagcctcccgagtagctgggactacaggcgtgcaccaccacacacagataatttttgtgtttttagtagagaccaggtttcaccatgttggccaggatggtctcgatctcttgacttcgtgatccacccgccctggcctcccaacgtgccaggattatgggcccgagccaccacacccagcccagttacagtagtttactccagaataatactacatgtataaacataggttacacacatacttaaaagaacattagagttcttttttgtttttctttgatgtttggctttgatttaatgggattttactatacacattactcttaagcaagcctttaacactcagcactttaaagtgcttggtacatagtaggcttaagtaatattttatcaaactgagctggagagttcttagatattgttcttatctcaaattcagtcatcccttggtatctgctagggattgcttccaggaaccccatgaatttttttaccaaaatccacagatgctcaagtcccttatacaaaacggtgtcttgtttgcatgtcactgacacacatactccgtgtacttaaaccatctctagactgcctataatacctaacgtgatgtaaatgctatggaaacagttgttttactgtatcgtttggggaataacatcaagtctgtacatttttcagtagagatgcaatgatcataggcctaactgccttttcaatctgcacgtggttgaacccatggatgcagagcccgtgggtgctgattgctaactgtatatcctacttctaatccttcttttgtatggagtgagcttccaaaaaccttctgaaacattaagtcatgctcttctttgaagtctgtgaatcctcagggctgtcggcgtgagaaccaaaggctgcagtggtgcacacaatgtccttcatcccagtaggttgattgttcagcatctgtgtgacccaacctctcctattgtccttgattcaatagctgatctactgaactatgtagctgaattacagctcctcaagcacagtgctgtcttggcttggaatgccctactgcttctgttattattatgatgacacattggtgatttttttcctatgagaatcttctctaatttcccaagtgtaagttagctatcctcctgtgtgtgccctgaaccctgtacatccccatcatcacagtagttcattgccttgtaattgcttgcttgcttttatgtttctcccattggacaatatattccttaaagccagagatttttccctgtgatattatcctcagaacttaatatagtatatgttgtcatactaaaagcttgatcaatacaacatacataagtaaaggaacattattcttctacattagagaatacagttcctagggaaagtatgtatttagaccacacgactgaagcaacaggtctggggaacacccatactcaaggaatggggaggaacaaaaggcattagaaaaaaaagaaatgggatagccgtgaaagcgcaagaacaatgttcagagtgtttatcacggccgtctggaaaaaacagaatttcaagaaatgaatgatcagtcatgtcaaatgcttataaaagtcaggaataatggctgtgaaatgtccaatcaacttggcaattaaaaatacactgatgactttatgaagcagtttcagtatgttggttgagacagaagccagatgatggggtgctgcataataaatggcacatcgcaggctgatgacagcacagccctgctttaatacggcaggaaacacgatgggttctgtggcatcctcctactcactgtcttctgtggattgtgactcctggtgactgacagatgtttaatttcctgagggcaagcaaagtcacggctttaatatgcccgagaataatgatggatgatgcaactttggataagcctgtagaagagacaagagaaaggaagaggtgtagaaaagctctgaaggggtctgggcgcagtggctcatgcatgtaatcctagcactttgggaggtcgaggcgggcagatagtgaggtcaggagttcgagaccagactgaccaacatggtgaaaccccatctctactaaaaatacaaaaattagctgggcgtggtggcgggcacctgcaatcccagctactcgggaggctgaggcaggagaatcacttgaacccgggaggcagaagttgccgtgagctgagatggtgccactgcactccagcctgggtgatagagcgagactctgtcaaaaaaaaaaaaaaaaaaaaaaaaaagaaagaaagaaagaaaaagaaaagaaaagaaaagaaaacagaaaagctctgaagggagaattcttgagtgtgtgatgtttgaaatactagactaaagggcagttcagtgggacagtgggtggaatttgcagtggataccagaacagagtttgggaagagagatttggccaagagactacaccctgcagatctccactgacagaggagttagtgaccaagagcctggccactgagctaaaatccatcgtgcacttgtgctgtaaccacattcccatgggctgctctccagccaatgactgaattggaagcagggatgcctgtcctgggagccatgagctcctctgatgcctgaggttgactcgtggacttccagtagctttgctgaaccttccatagactggaaagcagcctaagatgttttctcgcagacccctctggctccttcaccgttttccttttgcagtagttttcttaataacatccttgcatgtgtaatcctgtgcttatatcagcttctcagagggtccagaccgatataatatctaaagggtagttttatttttgaagggaggtgaattgctgtgttattagtgttgtacccttctatcattcgctatcattcatgtttctttaagatatattcggtaaaatacccatttctcactaatgctggttagagtaggtctttttttttttttttgagacgtaatctccctctgttgtccaggctggagtgcagtggcgccatctcggctcactgcaacttccgcctcctgggttcaagtgattctcctgcctcggcctcctaagtagctgggattacaggtgcccgccgccatgcccggctaatttcttttgtatttttagcagagcggggtttcatcatgttggccaggctggttttgaactcctggcctcaagtaatccgcctgccatggcctcccaaaatgctaggattataggcgtgagccactatgccgggccaggtcttctttcttgaggggagggacaaagtgaaataatgagaactgctctgcaatgtcttcttcagaagagaagctgcccatagaacagagtcccatgtagatgatacagtgatattaaatagaacgttccccacagaagtttaacgcgattagtatcaaggtgacgcttataaatgctaatgcaagaatgccattcaggagtcttgctttatacctaaaaaagcgatgtgttcctgattgtggaatatctttacaggtagaaggcaggtaatagttatatagaaataaaacaaaaataacaatgtataggatacagcctcaaagattcccagaatattagagctacaaggcacgttagagaccatctcctaattttaaatgctcttttgaatattctagtgagagaagctgcagcctgttgagactccacaagactgaagatatgaaaagaggaaatatgcatgaatgcccgcacggagaaccacccccacctgctgctcccgctctaatgatcacgcccattatcaactgggggatggctctgtgccttgtccttgcattacatggaccaagaacacttcacaggactcagagaggtaaatgagagaaacctattcttatagaggatgaaaatgaagcacacagggaggtaaagtgccccaaaatcccatctgaactggctttagaaaccgtatatttactttttcatataatttgtttatctaagggaaaaaaataacagatgtgtttaatggctttagaaacatttaaacaggtggacctcaaaatatgtgaaatgaacatattgccattgtttattataattttccttccttctatttttgcttaaaattcctcaaggcctttggatatgcaaaaaaaaatgagcatttgttttattatgttgcttaatagaaacaattttttaaagtattgatttacgcagtgaccaaaatactgattctaaacaacaaaacatgcagctgttacgaatcctggacgagctctggaaatgtgtggtattgtcttgcaaagaagctgtttttgttctagtcaaatatggaaactagtttagaaacttcattttaatatataattctgatttcagtgttaccagtaaatattaatgtccttttctaacagtcttaatttccttttctcaactcccttgagttatatattttattgaagcattcatttaccatcaagagaaaagaatgacataagcatgtgtgctgaaacgtgcggcttccaggccacagagttaaggaagctacatttgttctcccagccccttacttgtgctatgcatttagaaagaaaactttcgacgtctattgttcttacttttacaatttatgatgtagttaatcctattcaccttgtgtactgaggtaggtcagaatttcttctcacccttttcctcttctaacatgacctgttctttcgcatcatgagtcatagaaatgtaagctaatacataaagtttttgaaaagatgaggaaagagccagagaaataataatgccctgaggttgtgctataaggtatgttccacattggcaagaagtcccttgcttggtagatgtgttcctgtaagccctaaaagaaagggcaggtggctgtcatactccccttatcctccggacacaatcacctgagaccattcactaggccttccaaggggaagcccaggtgaaactgaaggacaacccttctgagatggacagaaaaagaaaaacgtgaaatcttatggtaagggtaaaaggccaaagagacttaggaactgtaaggtagggaggaaagaatgtgggagcccagagagacgggtcctctgtggccgtaacagtagactttcagtggagcgagagagaacatgaggaaactcaggatattctgcaccatggtttggactctaaaaatgtatttgatcatatgatgggtttatagtttttattcttggcctcggtctctgtttttttttcttcttatatgttgtagtgttgggattcactcagatggtggcagaaatattaaagggaaatactagggaaagttatagggaatagtcacaaaccttttggaaggctgaaagtttacatagcttgtaataattgaacaggctgaggcagccggttcttaccttagagcattaggtcttagggtaaatactagggacaacagaggcttccccacttaagtctgtttaccctacctccaataactaacctttgagccagatggcccacttgtggggaggttgactagggatattgtcccctaatggtatttaccttagaccttggtacctgagctttaatcattcctagaactactctcttaaccatgttaattatccacaagtgtgttgactcagagcttctgttgttaattgtataccaaataaatgcctggagtgcgagctgctcagggccagccacagtgacaaaccactcttggtgtgcaggcggtcggacactcagcaggactggcaaagcagaatatctgtgtcagtgtacgttttattcgcctgtcgtttgggtcagggtccatgggcagacccccgcagctaatgccctcaagggtgaggagcaatacctcattatagacttagttgtgaaaagtttttttaaaattaatgagacagtaatcaggtattttaaacaactgaattttacaaaccctcataacattgagtgggaaaaaaatttagatctcagtcaactccttgatcttacacataaagaaactgatgctcaaaatatgaaaagattttcccaagttaatattacacatgatcagtggatatgatactagagccagtctttgatctccaattccagttttcttactataataaggtggatttcttgtgagggaaccaaccggataaagtaaaaaacctacagtttctatgaggatccacatactttcctgacaatggagtaagagaaaatgtggcaagtgaccattgggccctccaggtgtcttagagtggttgacatagttcctgaacaagagtggaaatccagcctggcacggtggctcacgcctgtaatcccagcactttgggaggctgaggcgggcggatcacgaggtcaggagattgagaccatcctggctaacacggtgaaacaccatctctactgaaaatacaaaaaattagccgggcctggtggcgggcacctgtaatcccagttacactcgggaggctgaggcaggagaattgcttgaacccgggaggcagagcttgcaatgagccgagatagtgccactgcactccagcctgggcgacagagtgactctgtctcaaaaaaaaaagagtggaaatctaggtggattcagggatagggaatggtagcaaaaagagagagagaggagagagagggaagagtaaggagcacagaaatagaaagagcatctggtagtgagatgagctggaatctggggagagggacctgtgtccaggcaggcttcttacagagctgtctacttacagagctccacacccacagcgccaggtcagtgatttgtctgtcggtgcgcacccccattctgtgctcttttctgtatcacaggggactggatatctgcaagctacattttccacactgccttctgactggtatttaataagattttgataatgggaggcactggcaagaaatgggaaggtgggagaaagagcaaatccatatttttagtcattgtttttcctggtggtgcccttggcagcagtaaccacagtgacaagtggatgcaagcccgggttccctctaaggtggcacagttccaatggcagcagcagcagcagctgctctgacagctttgtaaccaccagtactcctgggccctggctcttgctgtatcaggagtgtgagctcctggcttcctgtgcagtggcagtggcagtgctcactgcatccggcagtggctaaagaaggactccagcctcctcagcccacagctgcgtggacttggggctacaccattgctctttggggttgtttttggctcatggggtggttgtggcatcctgaagttacgaacagcagttacgaacagcagttcctcaggtaccagtctttggggagcctcatccccttgttgttcctgcctggctttttgtgacgtttaaaaccaatgttcaaatccaatgtgtttggaatgcttagaattggttttgttttcctaactggacacgagagacacaagcactacgcgatccttctacgtcatgctcttaaaaaatatggcaaagttttacattattcatccatttctgctgttcccgtgaaactgacaatatacaaagaccagcgtgtgtggggccctggaatatgtcagtttatatttctattgtgtcagttttcttagggtatatggcgaatataaatatgactattataattaagtggctgtgcattttcatattagaattcattatgttgccttctcagtagaagcactttctatgtagtgcttgagcatataggtaagtcaggtggccacctgcacagtgtgatttgaaggtgtgaaggtatctctctgcctcaaatagcgattaaatttaacaggttcatattctgtagtgaaaaaaatacagttggccctccatatccacgggttctgcatccatggattcaaccaaccaaggataaaaatattttttaaaaattgcatctgcaagttaattataatataatgctcaagaaaattcacaacatgaatgaaatgttacagaagttataaatccattgcatttatcagtagctcatttttgaaaagggtctttggattatagatttccacttcttttacaaagaaacattgaagtgagaattttgtgggtactctttaaacaatagtacatgagtttaatacatattttttaaagccagtaaataacatttttctgtgtccactttaaagtgtgttgggtatataagtgaattggactgtatttctaatatgtgtgtaggtttaattttatatagtttttaaattgttctgtgattaatcggccattgaaaatgacctttttaattgttgagatttactgactagccttatatggaaggatttgtatatcctcaccatatatatatatgtatatatatataaatataaatataaatatatatggtgtatctatatggtgcatatatatagcgtgtgtgtatatatgtatttggtatatctatggtgcatatatttggtatatatatggtgtgtgtatatacacatatacataccatatatacacacacatatatataccatcttttatttgtgtggtgaaaaatactcttttttggtgtaaaaagtttattttctttgctaataatgtcagtttgtaaaaaaaagaattcatccttactgaatatctatagacctttttggtcagtattccctaaacaacgcagtataagaactatttacgtagcattcacattgtattaggtattataagtaatttaaggatgatttaaaatatacaaggggatgtgcataggttatatgcaaatactatgccattttatatcagggtcttgagcatccacggattttgatattagcaggaggtcctggaaccaattccacatggatacagagggacgtctctctctctctttgatattgttatattatatcatattatttatattatatatttatatattggtaatatttatatattagtttaaaggattgttataaaagtggattttaaaccacaacagcaaccaaaatgattatgtgatgttacagaggaatatggttgccatctttttttttttttttttttttgagacagagactcgctctgtcgcccaggctggagtgcggtggcacagtctcggctcactgcaagccccgcctcccaggttcacgccattctcctgcctcagcctcccgagtagctaggactacaggcgcccgccaccacgccggctaattttttatatttttagtagagatggggttttaccgtgttagccaggatggtctcgatctcctgacctcgtgatccgcccaccttggcatcccaaagtgctgggattacaggcgtgagccaccccgcccggcctatggttgctatctttaataaatattatggacataagagagagagagagaatgctgctaggtcacttaaaaatggagatgtgatttatgggaatgttcttgtctacatgtaatgcaacacgtggaatctttataataggtgtcaagaaatttcccattcaggagaattctgtaggtgaaggttcagagggagccatggctagatgctgggcaggggagggttagatgcagcctcactggaggggtcgttttctggaagtgatatctaacatccctccattatctggaagtgatatctaaaatccccaccattatctgaaagtgatatctaacatccacccattatctggaagtgaatatctaactttcccccattatctggaagtgatagctaacatccccccattatctggaagtgaatatctaacttccccccattatctggaagtgatagctaacatccccccattatctggaagtgatatctaacatccccccattatctggaagtgatagctaacatccccccattatccagaagtgaatatctaacatccccccattatctggaagtgttatctaacatcaccccattatctggaagtgatggctaacatctgcccattatctggaagtgatatctaacatccccccattatccggaagtgatatctaacatcccccattatctggaagtgttatctgacatcccccattatccggaagtgaatatctaacatctccccattatctggaagtgttatctaacatcccccccattatctggagtgatatctaacatccccccattatctggaagtgatatctaacatccccccattatctggaagtgatagctaacatccccccattatctggaagtgatagctaacatcccattatctggaagtgaatatctaacatcccccattatctggaagtgttatctaacgtcaccccattatctggaagtgatatctaacatccacccattatctggaagtgatatctaacatcccccccattatctggaagtgatagctaacatccccctattatctggaactgatagctaacatccccccattatctggaagtgatatctaatttccaccattagtgacactcctccatgtttcaaggtatgtatttcaagaaagcccttgttagaataacaggaatttattggggagaatagcacaatgtcttcttttttttgagacagagtttcgctctgtcgcccaggctccggtgcaatggcgtgatcttggctcactgcaacctctgcctcccgggttcaagcgattctcctgcctcagcctcctgagtagctgggactacaggcatgtgtcaccaaccctggctaattttgtatttttagtagagacgggggttctccatgttggtcaggctggtctcgaactcccaatctcaggtgatccgcctgcctcggccacccaaagtgctgggattacaggcgtgagccaccgcgcccggccacaatgtctttatcaatctacacgtaaggaattttctggtaaaatagtgctgggcagattgcaagtgggagcagtgacattgggtttgaacaacaaacttaaaagaaaagaaacaaagaaaagaacacataatctgtaggctgggtttctgtctgtctggttttgggatgcaaagagaagaaaaaatgaggtagtaggcatttagttattttctagcctaagattaaagtgctttttgctcctgcctaactttaggaaagtgaggaaacaacattcacagacaaaggacaattgagcatgagctccaggggaccatcagcaaaacattttcagaagatgtgaagagtaggatgcgtaagtcatggagcagatcagaggcctgtggataaggtaccaaggacaaggaagactctgtcggttgatgatcttgagcagtgctgctaggtcacttcaaaatggagacgtgatttatgggcatgttattgtctacatgtaatcaacacatggaatctttataatacgtatctatatttctatgaattaaagttttcctatggcctatagttaagtgttcttgcgaggtgtgtgagcaggtgcacctatgctgtacatgggggaggatgctagataaagaatattatctactctgtcttacagatcattcccagacggggtggtagaaacataccatacgaatgtaaggaggttcctaaaaatgttcacttgggccataagcaccatacaattgagcaaggttgcacatttatgaagctctacaaagcacaggttggtttagcattatctgctgagccattgggcaataccccgtgaggggcacagagagatgggacaaggcgcacagagggcatctggggagtcaggaaacagcatgaggacagggggcccctgggaatagaaggagacttgttcaagggaagaaactgaaaaacaaaacacaagggagatgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagtatggggagacgatagggaaaatcagggtctctgtgtagttatctgtgtgactcagcatggggagacgatagggaaaatcagggtctctgtgtagttaatctgtgtgactcagcatggggagaccatagggaaaatcagggtctctgtgtagttaatctctgtgactcagcatggggagatgatagggaaaatcagggtctctgtgtagttatctgtgtgactcaccatggggagacgatagggaaaatcagggtctctgtgtagttatctgtgtgactcaacatggggagatgatagggaaaatcggggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgcagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctgtgtgactcagcatggggagatgatagggaaaatcagggtctctgtgtagttaatctgtgtgactcagcatggggagacgatagggaaaatcagggtctctgtgtagttaatctgtgtgactcagcatggggagacgatagggaaaatcagggtctctgtgtagttatctgtgtgactcagcatggggagacgatagggaaaatcagggtctctgtgtagttatctgtgtgactcagcatggggagatgatagggaaaatcagggtctctgtgtagttaatctctgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagatgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggtgagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacaatagggaaaatcagggtctctgtgtagttaatctgtgtgactcagcatggggagacgatagggaaaatcagggtctctgtgtagttaatctgtgtgactcagcatggggagacgatagggaaaatcagtctctgtgtagttatctgtgtgactcagcatggggagacgatagggaaaatcagggtctctgtgcagttatctgtgtgactcagcatacatgggtaccgcatggatagaaaagcatgataaagtttgaaaaagtatttttaagtgttgatgatgatgatgattttgaatgcaaacatactttgattgtgatgatctcttcaattatgatgttgtacaaaaccaaaaaaataaaaaacaaactgatgttcatcttcaatttgaggttaagaaaactcattatattcccagcataccttcttgttgattgaatgattgaagagtaatcagcaaacaacctaatttctaaatccttgacagccataatgataatgtgaatctcacttggagaaattctcatcccaaattgtgttccattgcttcataggaatgtactgaatccgtttcaaagatcaatgaaaataatggcatgctcatatattggatttaaacatcttatatgattgtggttattgtgttttttttttttttaatttctgaaaacaaacaaaaggtcctaggagaaaagtaaacctccgtctcctgtcaagtcccttctcccatacctgcgtctctcattgaaagggtagtacagaattcaggttgggaccaacccgtgtaaccagcagtgataactagtcgctttattcctgaaaactccaggctgtgattacataagcacaggtgaatggggaaaagcaaaagccatggaggaaatccacctgcgctttcttccccctgccagcccagctttcacccaggactgttcttcatgggctgcacgcctcttgccactggtattcttaagcaagtgctgggaagactcgaaagaaaagtgtgagaggagcagcaggcagcgggtttggggaggaatgaaaagcagagatggacaatcctatggttttgccccgaaagaggacagagacttcactttactgagtctgtacaaacatctggaatcaaagccaagagaatgactgcgatctaagcctttctctaggccccaagtttacagcagtttatgctcctagaaagagaataatcactgcatttacccaactaaatatttctgtctatttctcatgaaaagtgaggttaaaggttaatgtaagaccattgcagcccataaatttaggatgactgtataatccttccagctttgaaattgtcataccttttttacttatccaaaatatttctaaaaacaacagaaaggtcttgacaaccttgatgactttatggaatgtgagataaagggcgatatatatacacatcacatatacacacacacatatacgtatatatacacatatatatgtatatatgtgtgcatatatctatacatatatggtgtgtgtacatacatacacaccatatatacacacaggatgtgtatgtgtgtgcgtatatatatattacatctatttacatatatatataacatttcctttgattcaatttgcaggcctcaatcttattctcagaactgatgtcacaacatcgtacaaagccctcataagcatatttgccttccaaggtaactcacagaatacatcttccatttgttattcatatagtcagctctagctgcaattgccatttaccaattcccatctgttagaggtttttcttgtacccgatggcagttgaagcagattgtgaatataaaagaaaatagtttcttggcacagaaaagggatatttgttttaattgacaaggtgtaacatttatgagataaaaatgaattttagacatctcatttatttttatgtcggtctcttcaagacaattattggctcttaggcatacatacagaaacctcaggaaattagggaaaagacagaaaaacaactcttgggaaagtcaattcaagctgatcttaaggctcccagggaaatggcaggtttggagggtggagagaattcaggtgacagtgccaattcttagtgtcttctgtgctaccatgattattttagaaaataaaggagtgctgattttttaaaaagcaatttcctctgctcagcaatgataaataaatcattttgctataaatgagtctagagtcaatgcttcaaatgagaaaaaaagcaatccactatttctccttaagaatgattatatatttgatgagtatctttcttctgataatgatttgtaaaatcttatttcttggtactcccatgagtagtagaatatattgaacagtaaaatgttaaacagtttttgagatgaaggcactgtttctattcaacttatcacaattactgagggtatcaggtatgtactggattgtcatagcttaaagagataccaggacgatgacaaaggaaagttgaagttagctattctgatcagtagaaggacacgcttttccccgcaaaggaaataaaagtgttagtgtcgttctgttgagataattttatcaaatagaaaaaaggaataaaaggaaagtcatctgtgcatttgtaacccagcgattctcattaaatcattataccatgctaacaagagaaaaaagcgtctacaggtggtactccattttcaactgggaaaagagcaggtctaatttgaaataacccaaggctaagggtgctataggatggaaggggaatttttaatcaacactatgggcacacatcaggtgtccccgagggccacgctatgaggaagaacctatgatatgttctatcttcttgtaacagtgctaccctctgggagactacttgcccagggctgggaatttatctttggagttagtttaggactcagggtgaaaaggaggagcagtaggaagtgaggctattggaaagcttctgtaaaaagtggccccttcattattattccatattctgactaagcagagaaatgaacctgtagtttcatccatattttcaaaagcaaaacttcttctactaaaataacttgctacaaaaggtatgtactagtttgggattttgtttttttctgtcagtttgataaatgctgtttggactctcataatccccctaataattgactggggtcagagtatctctagggcgatgctgcacattttaaaaccgcttcacggggtgctggtattcagagaatgctcttgaagatctgtttcccattgacttttcaaatcctgttaattgcttatacagtaagcgttaaaagtcaggcctggcaaaatcaaggaagctgcagggagcagatgaagttttcatgcgcaggagcacagctaggatgaaacgagaagtaactgccgtgtccagtgtggcccaggtggagagctgggggtgtgccatgagactgttaggtccagaggaagtacgctcgattcgcttgatctcgggggtaactgaagagatagcagctctctctagaagtccttttctgaaactattgagacctctgacacttcaaatccttaaacgcaggaaaaactaccaattgattagaatgcccttgagaagattgaagtatgagatggtgttggactagtggtcatttgtttcaatctcaagattctgtatttcctattctgaaatttctatttattataaatcttataatctttaaaattctatttttctaagtctgagatgtggttgaatttcagtttataagaagaaataaggcatatgtgaattcccttaacaaatcacacagttcaattcctgatagttgttacctaacgtttataatgtttctttttatcaaatgatcttcaatattccctgccatgaaatggaagattagtgaattttttactaaattattttggccttaaagtctgttctgccaaattgaaatacttggacagaactaacttttgctgtacaaagtggacagttagccatggagtgagctattgagaagaaagaatattttctgagcagaaaactcattcttctttttctaatagctgtattaggagattgaattggggccactatgctctttctcttgggcaggaaacatgtactttttttgcagtcagtaatgttttcatagctgttatctgacccttacactgagcagaagagtttctgggacagtttctttaagtttacaaataatcagccatgtataggcttaaaaaataaataaagatttctcatccatatgaatgagtggagcaaataaattagatgagggaagctggatcacaatcttgagaggaaacaagaggaaaattcagaaaacatttcacctatacctggttctgttaataccttgccactaccatattatggatgcaggctgaatacatgttttcagaggttagcactgcagccaagcaagcaagcatactgttaatctgatatatataaggacacacataacttacaatatagtaaagcaaataggcttgaatggcattgcagttcacacacactgccatggtgttgctattcaacttctgaaacataattttagttttgtcctcttgcctcccttgccttgctatagtgatttagctttaaaaatgcaagcctgcacctgtcatttccctgctaagcatctctattggcccccatgtcctcaaggatgcagaccaagtccattccagaacagcttccatgctccagtcctacccacctcagtagccctatcactcttcttactttctgctccaaccacaatacaattctagtggttgatcaaaatgtttctttttctttttttttttttgagagggagttttgctcttgttgcccaggctggagtgcaatggcgccatctcggctcactgcaacctctgcctcctaggtacaagggattctcctgtctcagcctcccaagtagctcagattacaggcatgcaccaccacgcccagctaatttttttgtatttagtggagatggggtttcaccatgttagtcaggctggttacgaactcctgaccttaggtgatccacccgcctcagcctcccaaagtgctgggattataggcatgtgccaccttgcccggcctcaaaatgtgtcttgatacaaagatttcccctacactgtaatgttcctctaatcctccctctcataacagctacttatccctcgggtttcatcttaaactttacatttagggagaaccttcccccacagagcagacatatcaggtcccctgtgtattctctaatggcagtcttgtatttctttgtaacaaaaattgaatttatttaacatatgactttcctaccattaagtcttttacttgaacgagggcaggtattcagtaaatgtttcttgaataaataaatgcatggtagttctttatcatttattatcattggtctagtcacagactcagaagcagttggagatactagtatgattgaatttctctatttttagtttctttcaaatacttgcacacacacagacacacacacacacacacacagacacacacacacacacacacacacacagcttccttgcagtttcccagaaatacaattccagagccacaggtccctcatctcacaacttgtccccatgttctcatttgtccctctgatcttacttgtcagcccttcccagcacctggggatcgtgcattgtgaagcagcacactcaggggttccctgctccgtgtttccctccctaatgccaaagggccaggagccattgtgtcgcagagtaggctgcttcacttgtgcctgagggaggacagacaatatgctcatcaggattcagggaggagagtgtggacgctcagacagaggagtgctgtctttgtttctcgctgctatatcagaatgccacagactgggtaatttataataaacagaaatttgcttcctcacagttctgaaggctgagaaggtcaggatttaggggccagcatctggtgaggggcttctcactgcattcttccacggtgccaggtggcagtgcaagaaagcacataagacacacagcaagaggaggctgaactcacttttataacaaacccactcaccccataatgaatttactcctgtgttcaacacataaacttttggagacacattcaaaccataacatgtactattgaaatggagctctgacaggagacaccttgggtgcctcaagctggagattctgctttgcatccccagttaataattagtagataaaagaaagagactctttgggcactgggacctggggtctatgaatgttgaaaaggaagagcaaaccatgacatcaggacttgagtttctcacacccctttctcccacccccacccaggcaaaaatagatacaaaagaagaaggaattacagaagaagtcacataacattattgcctacaactgactgtttaccttgaatacttgaagaccagaatgaagattcttggggtgaagaattacagccttagcatggagcaggcctcggtgcatcggctttcagctaggcatgcctgccaatgttcaacgtcctcctgggatacggaaggcaccgtgatagacatctgggcaagtcaacaggaaggtggatatccaaatctctctcttcgcaatgagtttccagttagatggaggagagagtaataaaacacagtaagtgtggaaaagattaaaatgcatgttgtgatataccacaggaaatcagaggagagaggttcattctaaggggaatggtggaaacgtcagtgagaacataccacctgggtggttcttgtaagatgatgtggaagagaaaaggtaaagattgagcaaaacagtgcatgagcgaaggatgcaatgtgagatggtctgaacagtttaaaagaataacctgggccaggcacggtggctcactcctgtaatcccagcactttgggaagccaaggcgggtggatcccgaggtcaggagttcgagaccatcctggctaacacggtgaaaccccgtctctactaaaaatacaaaaaattagccgggcgtggtggcgtgtgcttgtagtcccagctacttgggaggctgaggcaggagaatcgcttgaacctgggaggtggaggttgcagtgagccgagatcgcgccactgcactccagcctgggcgacagagactgactccctctcaaaagaaaaaaaaaaaaaaagcataagccgagggaatgaaagtactttctgtggctggagcacaggatgtctagacagaagaatttggaaagaaacagaggatactagatttggaacagatcattcaggtcctcaagaccttgaaaataaggctacagtttttaatattattatactgcaggccattgaagataatgcacttgttttgtattgtttttgtttttcagaagacagagtattaacttttttttcaggttgtagaattcatcaattccataaccatttttgaatgagtattacaggtcaaggacttttctaaaaagatggatatggtctcttctgtcatgggtcttacattctgtgggaggagacaagcaataactacatacaatgagcacaataattgaagtgattatgtgggaattaaaggggtgggctattgacaacttcagacaccatggtaattaatggccttcgatttgtaacaggagctgagattcctgacttcacagatccctgaggagatgtttactaaagggaatcttctggtcactgttaccttcctccgtacttacctgcctcatggagtaagcatgacaaaattcttgattacatagggaaaatcacatcttcgattaatactttcctgtttttattcttcattactacttgcatgatattcacataatcttttctcttctcctgcttcctccgtgcaataagctgctcaggcagcctttgctcttaagagcttgtttgtatctgagaacgagttaaggctttacactggtagtaagtttaagtcatgccaaaaaggggtagaatacctgattctcctagtttcaagacaagccaggttttttttgtttgtttgttttttaaaaaagcagaaactttcattgctctctctcatctgaaactagatgaggctatctactctgagtggccaggtcttctgtaatttgtaactgaaatgcaggttacttgctcactgcacgtacagttcagttaacgagggaaatctgatccaaaataagtgaatttattccgaagttagcttgggggaaggggcacaaagcatcccgcctttgaatgtgccgcttctcctctgttgcaaaaagtgggcattttcatagggtaagggaggacatgagcaagggcaggggtcccactgcttctggtcagttacctaccaggcagttgagttggcaccttcctgtgcagagttcagttgtaaaagtagccaagtggtcatgctttcgatgtgctgtcctggtgcgtatgagttcctaggtcacccctggaggatggcagttccgaggcacgcccctggaggtgagagttccatggggacatgctttggtctgtaaatccaccgtcagctctggaggagagacctgtcttggagcacgaagttagaggaacttgctgtgtaggcaatgtcctgtgagggagaggtgagagattatatttgcatttcagcagagctaagcagaaagcagagagccagggaaaggagaaaacagagtgagagggaaaaatataattaaaccacccgtagaaaaatagggagaactgggggccggggcggtggctcacgcctgtaatcccagcacttcgggaggccaaggccgacggatcatgaggtcaggagttcgagagcaggctggccaacatggtgaaaccctgtctctactaaaaatacaaaaattagctgggtgtggcagcaggcgcctgtaatcccaactactcgggaggctgaggcaggagaatcgcttgaacccgggaggtggaggttgcagtgagctgagatcgtgccactgtgctccagcctgggcaacaagagcaaaactccatcttaaaaaacaaaagaaaaaagaaaaagaaaaatggggtacttggttacattttaagaacctaaaaatctagaatttcatgcaaaactcataattttcaagttggtaattaattttcaaatgtaaacatattgtggctcgcaaagaacaataagatcaatcaaccaataaaggcaaaaatagagagtaaggaagaatccacactaagaagcgtgaagacttgattagagacataagccaaagaaaggagatgtgttcagtgtttactgccatgtgccaagcaggggcgggtgaagacaatggcaatgtgaacagctaggaggaaggcaatatctggtaaattagagccgatgacatatgagtccaaaggagaaaagaggacgctgaacccaagcttgatgattgggagaatggtggtcccgtgacttgtcccaccgaagccaaagaaagaacagatctaagggatggtgatctttgagcaagctcgtttccctcacacgttccagcgctgtttcacgccaggctctgggattgaatgatatccctggatcaggttcactggcgtcccctgctggcacagagcagcacaaagacttcgaaactggatacgctgataaatttatgaaatctccacaaactagagaacacgggctaggtgcggtggctcacacctgtaatcccagcactttgggaagccgaggcgggtggatcacgaggtcatgagatcgagaccagcctggccaacatagtgaaaccccatctctactaaaaatacaaaaaattagctgggcatggtggcgggcgcctgtagtcccagctacttgggaggctgaggcaggagaatcgcttgaagcccggaggcggagcttgcagtgaccagagatcactccactgcactccatcctaggcgacacggtgagactctgtctcaaaaaaaaacaaacacaaaaacactagagaacatgttattaaataatagaaagaaagaatgcccatctgataaaggtacaaaactgaccttaaaatgacttagcactggaaagaaaaaaaaaagaggctacaaatttttggttactgaagagccttttaaataagattatattaaaacagtgggtagatctctccaaagcagaataagaaaacccctaatcttcctcctaactaaatgattatatgatttgatgagtgaggattaagttctgcttttaaatataattgctgggtaatatgaatataaaccaaatatgtaaaatttaagatacaaagatcaatattcccaattctataaaatttgtgtcaactaattgtagataataaaatattttatgtattttttagaagaagataataggcataacaactattgtgaaattatccaaatttgtactcttagttgccaattttcagttctttagaaagtgcaattattcttagcagtgagaaacatgagtctcacagaatacatttaagtcttcactttgatttacaacctccagtgttaattaaacaaatgccaactatgctaatagtctggaaatcctttgacaaatactgaaagaaatgacaggtctggcacatacacatatagatggaggcttgcctgatttttaagaggcgttttacagatttggccttataatacttattctataactattcattttatcctggaaaatgttgtctataaagttttggagagaaattgctctgtagaacaaattgacatttcacaggaataagtccactattgctaagaaaaatggtactggggatggagccccaaaatggcagaggcaaacacagccctatcaacctctcccatccccctgtgtacacattagtatagacttagtctgtctttaggaacaacatttttactgacctgctttctaagttgttggtccctcctcttccctgggatctacatatcagggtagtttcataattctctgttgtctcagttacgtgttaaaagtaagcatgttcactgagtgatgattttactttttaaacaacctcatcttttaccgtaccatcagttatattaaatatgacatttaaggttttaaaagtggagttagaaagctacatactgagaggtgaagccaggcgggcttctgactcatgtggggacttggagaacttttctgtctagctggaggattataaacgcaccaatcagcactctgtgtctagctaaaggtttgtaaatgcaccaatcagcactctgtaaaaacggaccaatcagcactctgtaaaatggaccaatcagtgctctgtaaaatggaccaatcaccgctctgtaaaatgggccaatcagcaggacgtgggtggggccaaataagggaataaaagctggccaccagagccaacagtagcaaccggtttgggtacctttccctatgaaagctttctttcacttttcacaataagtcgtgggtgcttctcactctttgggtctgcactacctttatgagctgtaacgttcgtggcgagagtcggtggcttcattcttgaagtcagccagaccaagaacccaccagaaggaataaattccagacacaatacaatatgttgggtgagcagatcatggcacttatgtcaggaaagcttgtgtttaatcctgggtgtgccatttactaagtgtgtgattagttgtattatatatacatacacacacacgtattttttgagacagagtctcgctctggcacccaggctggaatgctgtggtgcaatctcggctcactgcaacctccgcctcccaggttcaagcgattctcctgcctcagcttcccgagtagctggggctgcaggcatgagccaccatatccagcttttttttttttttttttttttttggatttttagtagtgacagggttttgccacattggccaggctggtctcgaactcctgacctcagacgatctgcccacctcagcctcccaaagtgctgggattatagccataggccactgcacccagccgtatcttttaattttaatacccaaatgtattatcaagctaataaatttgaataaaaacaaaatagtaaagctaatataaatattaaactttttacacaaagaattggttctttaaaaaggttagcaaaattgagaaatctttgctagaatgatttaggaagaaagaagactcaactgaaaatcagaagtgaaagaagagacattactaccaattttgcagaaataaaaaggattgtaaaagagtactgtgaacaattgtataccaacaaactgaacatcttaggtgagatggacaaattcctagaaacacacaaatggccaagattgaatcacgaagaatcagaatatctcaagagacttacagtaaggagattaactctgtaataaccccccagcaaagaaaagctaagggctagatgacttcactggataattgtagcaaacatttaaagaacaattaaaacaaatctttctcaaactcttaataaaaagcaaagtggagggagtactgccaaactcaatctacgagaccagatttaccctgataccaaaatcagacaagtatactatgagaaaagaaagtacagaccaatatccctgattaatactgatgcagaaatcctcaagaaaatactagcaatcagaactcacaagacattaaaagaattttacatcatggcaaagtgggctttagtcctagaatgcaagaatggtaaatatatgaaaatcaaagtaatgccctacattcacagaatgaaggacaaaaaccatgtgatgatctcaactgatgcagaaagaaaaaatttgacaagatgctctattacaaaacactcaacaactagtaatagaaggaaacttcgtcaacacagtaaaggccaaatataaacacccagaactaacatcgtactcaatggttaaagactgaatggtctccctctaagatcaagaggagcaagacaaggatgctctctttcaccgtttctgttctacttagtgttagaagtcctacctggagtaattaggtaagaaaaagcaataaaagtcatccacatgagaaaggaagaagtaaatttatatctgttcacagatcacataatcttatgtgtagaaaaccataactattacataaaaatgaattcagcaaagttgcagaattcaaaatcaacacacaaaaatcaattgcatttctgtgtattaatgatgagcaacccaaaggaaattaagaaaacaattcaatttacaatagcattaaaaagaataaaacacttaagaacaaacttaaccactgaggcaaaagacttgtactctgaaaactataaaagaaatatatacataagtggaaagacatcgatattcatgaattagaagacttatattgttaagatagtagtgttccccaaaatgatctacagattcaatgcaatccctatcaaaatctcgaccttttttgcagacatggaaaaattcattgttaaattcaaatggaaattaaaggaatctatgatagccaaaataatcttgaaatagaaaaacaaggttagaggtctcgtacttcatgatttaaaaactcactgcaaagctacagtaatcaaaacagtggttattgtcataaagacaagagtatagaccaacaaaatggaatagagagcctagaaataaaccttcacatacatggtcaaatgatttcaacaagggtgccaagaatattcaatagggaaagggcagtcttttcaaccagtggtcctgagaaaacaagataaccacatgcaaaagagttaagttgaaccattaccatagactatatacaaaaagttaactaaaaatggatcaaagacctaacccataagagttaaaactataaaactcttaaacaaaaatataaggggaaagcttcatgtcactggatttggcattgattatttggatatgacaataaaagcatagataacgaagaaaaataagtaaattggactacaccaaagttaaaaacttctgtgcaaaacaggctataatcaacagagtgaaaaggcaacccataaaatgggaaacatttgcaaataatataactgattagagttattcagaatatataaagaactcttacaactcacacacacacacacacacacacgaaacccaattaaaccattgacaaaagccttgaatagacatctctacaaaaaagatacacacatagctaataagcacatgaagagatgcttgataccactaattgttagagaaatggaagtcaaaaccctgactggcaaaacactgtgacaccacttgatacccattaggattgctactattaaaaaaaaatcagaaaataacaagcattggcaaggatgtggataaactggaaaacttttgcatttttggtgggagataaaatggtgcagccactatggaaaacagtatggtggttactcaaaaaattaaaaatagaattaccatatggtgcagtgatttcacttctgggtatatatcaaaaataattaaaatgaagcacttgtacagatatttttgcacttatgttcataagcagcattactaacaatagtcaaaaggtggaagtaagccaagtgttcattgctggcggaataaacaaactatgacatttacttacaataaaatatttttcagccttaaaatggaaggaaattctgacacatgctacaactgtaggtcattatgttgagtgaaataagccagtcataaaaggataaatactgtatgattctgaaacagaccgaatagtcccattttttaaaaaaaattttgatgaacatagaaattgacccctttggtattaaagtttgaaacttatatttgttttttctgagttccttcttcaggaaatgaccttcaggcctctcaaaaaaaagtattaaagaactgaaactcacccagttaccacatccagacaatgagatgccagacccctcattcatcatgatggcttccttgcccctcactagttcctgtttccttacacattgttacattccttccctgctatataaactcctagttgtagttggtcagagagatggatttgagactgagttcctgtctcctcggctgcagcacccgattaaagccttcttccttggcaatactcattgtctcagttcttggctttctgtgcagccagtagaagaacctagactgaactcctggtgtttcactaatcatcccacttacacagtgtacttagagtagtcacattcatagagacagaaaatagaatgggggttgtcagcagctggtggaaaggcaatggtgagttcttgtttaatggttagagtttcagttttacaagattgaaagggttctggatatggatattgatgacggttgcacaacaatgtaatgatgttcactgaagtgtacttttagaaatgttaggatgataatttatataacttttttttttttttgagatggagtctctgtcacccaggctggagtgaagtggtgccatcttggctcactgcaacccccacctcctgggtcaagagattctcctgcctcagcttcccaagtagctaggattacaggctaccacctgtgtgattacgggccaccatgcctggctaatttttgtatttttagttcgagatggggtttcaccatgttggccaggctgatcttgaactcctgacatcatgatccacccgccttggcctccaaagtgctgggattacaggcatgaggcactgcgcctggcttataacattttttttttttttttgagacagagtctcactctgtcgcctagactggagtgcagtggtgcgatctcagctcactgcaacctctgcatcccgggtgcaagtgattctcctgcctcagcctcccaagtagctgggactacaggcacctgccaccacatctggctaatttttgtatttttagtaaaggcgaggtttcatcattttgcccaggctgttctcaaactcctgacctcagataacttatgtaacttttatataggtatattttatcacacttaaaaatattaacacatcttaagaaattcagccaacccaaattgctgagatggcatggaggtatggaaagagcttttcaagctagaaagacctaagtttgaaatgagacctaagttctactacgttctaatgctatgacctcagagatgtcatagagtcacgttgacactcagcttcctcatattatgcgatgaccacttatagaggcatgatgaagagtaattgagattatgttatttacagtctctggcacagcctgtggctctccacaggtacactgcaatgaatcttcctttgcattttcctcaggtaatagtaaggtgtaattgactacaaataggtctctatgctttaaatgtaaatattaatttcacttagatgatctaattcagtttttacagcatgctatggtttacacaatcctttatatagtattttattttcctaacttttgaggtaagcattacgaattatattttaacaatggatgatctgaatataaaagagattacaggatttgattaagatcatatattgctgtgattcaacaccatattttcttaattcaatttcatcgttatttatatggtacaattaggaaaggaaaaagtaatccaagccctatattaaaccatacctgttgctgagtgtcttcaaaatcattttattttccttcctaagataaaaaaaaaatgatagaatcctacgtgcttgtctgatgattcgtaacttgaagtcagggattagatctcctctgtttcttagttttattctatagcccatgaatatattaagcattcaatagacatttgttgaattaaaatggtataaactattgatctgaaatactgcatttgaagcttggtacttcatgcattttgttcatatcatttatgtactaaattcaactttttttttattttgcatcctgattgtgttttcataaacatttattctaatgctaaaatttaatatcaataaattatatcttggagaaataatttaacaaactcatatttgcttggtgtgattatcaagactgcagaaactttggcaatataacataatggggaaaaaattggacaggaatcagaactaaccttcattatgggttcctggaatagctccaatctattcaagtaccctggagccaaacatttaaatgctccctgcctggatttctgcatttccccaatggagatgataatatttatctggcctacgttgtaagcttcctttttctacaccatgatactcagtatgacatagaggttcaaatcacttactattttcataaccataggcaaacctcttcacacttccatctgtaaagctgcctaataatagtatctgtgttctagtttatcatgaggattaaacgagtgaatatttatgaagcgtgtaaaacagtatttggcacatatgcaaatgttggttaaattttatgtgcataagtgtgtgtgcgcactttgaaaagtataaaaatatatttataatatcaggtcaattaatattttttctctctaaatgctactctagttatgtatatgcacttcaagtacttgacttttagttttctcatctgaaaaattgcattatcttttatttaacttatatttttgatcattaaatgctcttaagtactccatgctcagtaagacagataaatggagaaatctagcatgaagttagaaattaagaaggcatattgtttctataaaaaagaacaattttaacgaggaaagacagaaaacaagaaacataccattgaggccaactggtttataaggtgttgttactcagtcccagattttaaggtgcaattctcacatatgaattttcatagaggcctttgaagaagagaacaaagtctatgaaaatgcagccagtaaaagatcctccccttccttgaactacacccaacctgacttcagatgcaggttgcctttacttggggacgtgtgtggccgagaggcaagaggggtttcccttgagtagaatagaacttaaagagccaacagcagactcctcagatgctagtaacttgccaccagtagcgtacactgtgtccaacacgcagaggcaggtttgagtggaattcccagatagcttgtgatcaaagactggtcgccagtgaagaagacttgggatggatggatggatgggtggatggatgggtggataaatggatgaatttaacattgaggtataatttgcttaacagtaaaatgttcagtttaataagtttaggccaattaatattaattttgattaatctcaaattgtcttgctatcgagtgtttttttaagacagcaccaagtgtaaaggaaaatcttgagatcattatgccaaagacaaattgactccataagattagtccaaattatcaagtatattccatcattttgaatactcataaaacatattttgatttttattattttaagtgaatatttggtgatttcaaataagcaaacccaaattcaagaactttcactgtgcagaaatttccaaagtcaaaaccaaatagcgagtgtgataagttatactcattagacagcaatagagaggccccctgtaatggaatatggggtgactgtgaggatgctgaagaaaaaatggccatgattttttatctaaaggtgtgcttagtaaagtaggaatagaaaataaagacaaatatgcaactccaggagttatgagaatgtattcgggacgtattttgaaaacaaacccaactgctaaaattgagtcgacccagaaaagaattaagctgagatatctcttagtgatactttcacatccagatttacgcttagattcatgatgcattacaactaataaaattgtttaagtatgagaaagagcagaccaaggggccatgaagaaaatataattaaatgcagattaaaggggcagggcttctggtttggcagacacttacacttcaaagactggaacattctctttaataatacctcagttatctaataaaaatgatcatttggaaatcatgctggtcacttctgtctagctcaagtgtcaatgttctggatatactgggtactttattcacactgaattgcttttatacatcgagaaaggtgttaactcttactcttcttaaaatggactgtggtaattaattctgatgcctggaagcaaataagtaaatctttgaaatattcattttatttatacagacttagatatctactttttaggaaaatcacacttaaatacccctttcacttttgtacatatttgacacagtttggtatcaactgttactcggattatatagaaatattttgttgcaatgaatttatccaatttccttaaaggaagaagcaacaatggattatttcaaggagaacattatgtaatagtccatgctaatgaactgttaaaaaaatattattgacacaggcatgttaatagcagtgtgggttttggtaatcagctaacataattagtccagaattatatggactttttaagtaataaaatttactggaaacttaaatgtaattaattaaaagtttggtttagttataaatatgattaaagcatttttctctaattttttttttttttttgagacagagtctcgctctgtcgcccaggctggagtgcagtggccctatctcagctcactgcaagctccgcctcccgggttcacgccatgctcctgcctcagcctcctgagtagctgggactacaggcgcccgccactatgcccggctaatttttggtatttttagtagagacggggtttcaccgtgttagccaagatggtctcgatcttctgacctcgtgatccgcccacctcggcctccaaaagtgctgggattacaggcgcgagctaccgcgcccagcccatttttctctaatttatacttaaatttgcattattatttgcaaaacgtaccaaaatttggacatttaagcatcatttattctgaaaaaagtataagacatagtaaataacataccaatatgggacatgggagataaaaattgatcacccagtagataaagggaaaagctctttcagaaaaaaaaagtaaatttaattggcatataatcagaatatgtatgagcattttggagttcttgttttcttgttaactaaggtagaattttacaggtttgtagaccaaggcttcatctccatgaatgtggccccatgattaagatggcttggggtcagacagactcagtcctgctgtttgttagttgtgtaacatcagacatgctcaaagcctcaacttactcattttggggaaataataataattattaagactggtgagggccagctcggtggctcacgcctgtaatcccagcactttgggaggccgaggcgggtggatcacgaggtcaggagatcgagaccatcctggctaacaccgtgaaaccccgtctctactacaaatacaaaaaattagccgggcgtggtggcgggcgccggtagtcccagctactcgggaggctgaggcgggagaatggcgggaacccgggaggcggagcttgcagtgagccgagatcgcgcccctgcacttcagccccgggggacagagcgagactccatctcagaaaacaaacaaacaaacaaacaaaaaaactggtgagggttataataaatatatgtgaattaaataaaaatgtgttttaaatgtcatcaattgttttatatttcttaataaatttctcttttgtcaatttcattattcagcaaacgcagaaacttaagattttctgctgtttgtagtaatgtagtatatttcatcatatggcaagtgctaccagagagaagtaggattattatttattgtggtttttgcaaaaccagaggcccatgccaggagttttattcagcacggctcctctttgattcctgtcacacctagacacaatgaaggtgatttgcaaaaaagtagaagaaataaaagaaaaacaaaacaaaaactcttcttgccaagatttctaaagtaatgaagaaataacgtcacttgtaaaaggggtttctaaaattacctatctggaacagaagaaagcaagagtccggtacccctatcaaatcaattggtttaacatgttttcccttttaaagtaaaataataatttaaataataaatacacatttttatttatataatgccatttttaatatagtatcatttttctactgggattttatagtttaatagacgttcatcattagtgtgctgtttcaaatcctggccctgctctatattttttggttggtttgtttggatattattaccataaaaacaaaaacaggcttgcaatggctgcagattcacagaagattattagaaataaaagtttattgttaaatattttgtcatagcaaaatatatttttctttaagagaaaaaagtttttatctaaatattatcaaatttattactttcatcacttacgtaagttaaccagttcatatgcatctgtatgtctcagtagagaccaccaacttcaacattaatgtgttttattttctcaaagttggacttcagacaaaaattataaaactggaagatagtaatatttaaggatgccttcctaaaattatcttaagtacatcgaatatttccaaaaaatgtttttcctctgagagtttcctatgctggtaagaaatattttgggaacagaatagacaaggattaagtgaaaaataaatgtccctttttactcttattccagttctcagaggaaacagtttcttgcacggacttccagttattttctatacataggaagtatattatatataacaatataaaatttatcatgaatgaactactctatacacactctgacagttactttttaagttaaacaatatctcgagtgtctcacatatctatactctcacaagtattacatatatattacatacatacttgcctaattagtttttggtgacaatatattgtattattatatgaatgtactataatttttaatagcaagtctctttgcaagtgtagctccagcttctattaggagtgaaatccctggataaaatataacttgtctccaaagctgattctccaaaactgtttcaatttccattcccgcatggtaatatcaatagaataattgcccattgtcccacaacctgtttaacatggtcacacagcgggattctgactttgccaaatggctcacttcaataagcttaatgaatgtttaaatgaatgaatgtcaatttatgaatgaggattaccatcttctcatacacgactactgaatgtatctcactttctgaatgggaatcatcttctcatatactaccacttttttttttttgaaacagggtttcactctgttgcccatgctagagtgcaatggcatgatcatagcccgctgcagccttgaactcctgggctcaagctaccctcccacctcagcctcctgagtagctaggactacaggtgtgaaccaccatgcccagctaatcgtgtgtttgtttgtttgtttgtttgtttgttttagagaacaccaggctggtctcgaactcttgggctcaagtgatcctcctgcctcagcttcccaaagtgctgggaatcaggcatgagccactgtgcccacccttatactaccttttttttttttttttttttttttgagacggagtctcactctgttacccaggctggagtgcagtggtgcaatctcttctgactgcaacctccacctcctgggctcaagcgattctcctgcctagcctcccgagtagcctggattaagggcgtgcaccaccacgcctggctaatttttgtatttttttatagtagagacggggtttcaccatgttggccaggatagttttgaacacctgacctcaaatgatctgcccgcctcggcttcccaaagtgctgggattataggtgtgagccagtgtgcccagcccccttatactacttttatatgtcttgcctggttttttcttctgaccagatttataattaaataactggttttttttcttactgactttcatgaaattttaatttatcaggaaattagttctgttgttaatttatgttgtacatatttactctaatttatctctcttaaaatgttttgttttttggccagacgtggtgggtcatgcctgtaatcccagcaatttgggatcacctgaggtcaggagttcaagaccagcctggccaacatggcaaaaccccatctctgctaaaaacaaaaattagctgggtgtaatggtgcgcacctgtaatcccagctactcgggcggctgaggcagagcaatcgtttgaacccgggaggtggaggttgcagtgagctgagacctcaccactgcactccagcctgggtgacagagcaagaccctgtctcaaaaaaaaaaaaagttttattttttaatatatacatactttagtgggacataagaatgatttagggcacttcaatttgggtctattttttctttcttttattatactttaagttctgggatacatgtgcaagacgtgcaggtttgttacaaaataggtatacatgtgccatggtggtatgctgcactcatcaacccgtcatctacattaggtatttctcctaatgctatccctcccctagtcccccagcttctgacaggccccagtgtgtgatgttcccctccctgtgtccatgtgttctcattgttcagctcccacttatgagtgaatatgtggtgtttggttttctgttcctgtgttagtgtgctgagaatgatggtgtccagcttcatccatgtccctgcagaggacatgaactcatccttttgtatggctgcacagtattccctggtgtatatgtgccacgttttcttgatccagtctgtcagtgatgggcacagccacttgggcctgttttctagggacacgtctctctgcagatggttacagcctccttcggtttgcgcagatcgccctcagacgaaatgtcagcatgtctctcaatgaagctctttaatccacagtcgttttgttttcagctcagttgtttctggtcggtgcaaagctgactgcagtttttcttctcttttcaatgtttgtaacttttcttctctgtgcttgacctctaaattaggatttgtgttgaagtaaagaattgtaataacctgcagagtcacccttaaatctggataccccctctttctctttctctctcagaatggagtactccagagcaatgttctccacttctcccacggcattatcgcacccctaagtctctcttctaactaggatattcttctctgggttctcaggtccctggaggtctcagggacattgatgccatgttcagggtctaaaaggtaaggtttttgtgctttgtacttcttcagtttggcccagatgtccttgtattcgtgagatatttttcacagtgattcctacagtattttaagatcagttctctcacctgtttttactctttttgtctacataggggatatcagagacaggatataaatagtaatattttattctttcaggaagctataaatgtatttagattattacaatttgtacagactctaagcagaaatataatcacatcatttatgatatttatcttcataaatagatatttgaattggcttccaaaatgaccttagagatgtacttacttaatgatggtggccttgatctttttgtgattagataatagcccagcatgtggccacagtagcagaaacacacagtatgtgctggttaattggctctactcgcttcatgcattattacagcttatctgctgcttgtggactggtacatgttgagcttctcaataatcaaagaagaaatcaggtgccaggtcacaatccagacccaagaagtgtctgcttttctgttttccacatgaagtcatcatttagcattcttttcttctttttcaatggtggagaagcctctggtatgtaaaacatgagtaaagttcaaatagggtcaaattccggaaggcagcacagaacttttcctcctagccgtgttactttggccgtacatccttctatcatcccatgcagctgggaatgggggctgccattttcattttgatcaaccattcctcaaaagggcatttagagagtcattagggtctagagtcatgaaatgagtagaataacagaaggtagcatgtcagaagaccatgggcagcccccaggctgtatttgcagtccccgttctgcataatgtgtccagttggtatgtaatgatgcacgcacagaagagaaccaaacactcaaatgttttggctataatcaaaattataccttgagtttcaatgtacttatgtctttgaaaatggtattttaaggaccagaaatgtacacagtgttctgtgttttcaatacacaaaaataaaccttatgcacgtaagtgtaggcctcactgctgggctgtattccttcctaccacggaccctgtaaatactgtagaactatccaaacaacatctaaacttcagatgtaaaattcctaactcctaatattacaaacattcaactattttgatggaaaaaataggaagcatgacaatcatttataagagaaagaaaatatatttctcaatgaacacagattccttgacatggacactttcctgcagcttccgaagacaccagcagtggaaggttatactattcatcgatggccagggctggttgcaggagatattatgatgctttgaaggttgtcctggtcatctttataaaatatatgtcaaccacacctgctgaggctacagagcactgacagagggtaagagactagagaaggaaaagctttgataagatagctgaagataatcagaaaagatggtaactaatcaaataaacatcctcttgcgtgcacaatgtcaggaatgcagctctggaaacaatgcctttgtcagagcactgttagccgtagggtgtgtgccttcctcctcttgtgcttagtgtttggagaatttttgttcgtttgtttgagacagagtctcactctgtcgcccaggctggagtgcaatggcgcaatctcggctcactgcaacctccacctcccgggttcaagcaattctccgcctcagcctcctgaggagctgggactacaggtgcccaccaccatgcctgcctaatttttttgtattgttagtagagttggggtttcgccatcttggccaggctggtcttgaattcctgacctcgtgatccaccctccttgggctcccaaagtggtgggataacaggtgtcagccactgtgcccagcctgagaattttaaaaagaagtagaaaagtgctattcttgattaagcagctgtcatatcagacactggagaatgtggcccaagctcacatggttcatttctgcaacagctcttgcaatctatacattgttgtcaccactctatggggaatcaatgagaatggtggcagaaaagtactctgctgaatggtgaggcagatataaatctggcctaagtgaaacaaaaaactctccatttttaactacactttactggctccaggactggacattttcaggggtagtatagggaaggactaaggatatcgagggttcttggatgaaataatacatagattgttggtcctggctgagtgcagaaacaagggaaaacagcagggcttgaaagcttaggagaaaatggagggaggcaagaggttggaggacttagtggattcatggagaacaaatagaaatacggaagttagaaggagagtgataagaggcaaggcaaagtaggtgatgaaattacccaaagtatgactctgggattgggttgctgaagaagagataataaattctttaaagtaagtaagagtggtgaagtgcttatcccatgtgacttattagagacagaatctgaaatataatttgggtttacattatgaaatttagtgcattatgccataagaatgctgtgtctcctaatccattatgttcgttaaggtggagctttacatgtgtcttgatatctgagtataatcttttgcaataaattacagaagttgtctcatcactaatttggggtgtgctgattttgtttctaagtttataaaatgaaagtcttgatttttgttggttaaatattttgaaaaattgcagttcaagagcaaagttatgttttactcatcagttttttgaatgaaaaattatgtgaacgagataacttttgtatgaatttttaatttttagtaaagttacttaagttatgtttattctccaaaatattatcagtcacatttatttagtgctcaagactaaataagaattttagacagattctcgctctgtcgcccaggctggagtgcagtggcgtgatctcggctcactgcaagctctgcctcctgggttcacgccattctcctgcctcagcctcccaagtagctgcaactacaggcgcccaccaccatgcccggctaattttttcgtattttagtagagacagggtttcaccgtgttagccaggatggtcttgatatcctgacctcgtgatctgcctgcctcggcctcctagagtgctgggattacaggcgtgagccacggtgcctggccaatttttttaaaattatgaaactaggaaacattgttctattaaaaatatttttctctatctattcacagtaacactgaagaatgcagtttacttacatctttttctgtttgacagaagacagttattagtaagtataattattagataaagtatacttattttccatgtttaaaatatgaaaaatatgcaatataggttggtactaagaggggaaatctgcttctgatcaaaattttattttaaatatcatttttatttcttttgtcctaagttatatactttttcttctattacttattgcaaagttactttaaaagaaaacaaaatcaaagaaagcaatcaaccaagattttaaaaataataatagcagaatctctcctcaattctttcctcttctccactccatcttgccttcacagctttttttgtttccaaaggtagtcaaaacattttagatatttatgccaaagggcatggatctgtgataccgtgggtcctgccaagctgaaggttttcctttggccaagataagttactgtggaaggaaagtaactcttccaatccacggttcttagaaaattatacttttatactttttaaattttaaatgaaatgccccacagctttcaatgcatacccagttcagagaatttgaatatcatccaacatgcttccacagtgatcccagtctgagaggactgtgttattatgtaaatgcatagcttgctttctaggtaataaatgataaaactcttcatacaggagaatttggtcttcggtgtatttctatatgtattgaaggtttgctgtgaaatcactctggaatctctcagctggtctgctccacagtatcctactggtcttgggctttgtatattaactttccagaactcatgctcactacagacttgctttagggcctctaaatatttgttgcttttgcatgccaagagttttatccttatttttggagacaggagaggatgtgagtgttgaattgtatttcaggttacccttgggacatcaaaatgaccaaggcagtgtctgctaagtatttgctgagactctgctatgattctttcaagtctaaagacagttatctgaatgatatccccgtgacagtggactcctgcacattcacagtcctggaaggagcctgtccacattggcattctggaagtccataaaagacaaacgcatatgcagtccccgagaaagcattgttgtaaacaaatctgcactagatggaaactctgttatgtggtgccggcatgcatggaagagtaagtccagaactacacctggaagttctttttactaaaagaacacacagttcttttttactttattatattgtattttattttattttgttttattatactttaagttctagggtacatgtgcacacatgcaggtttgttacatatgtatacgtgtgccatgttggtgtgctgcacccatcaactcatcatttacattacgtatatctcctaatgctatccctcccccctccccccatcccacaacaggccccggtgtgtgatgttccccgccctgtgtccaagtgttctcattgttcaattcccaccaatgattgagaacatgcggtgtttggttttctgtccttgtgatagtttgctcagaatgatggcttccagcttcatccatgtccctgcaaaggacatgaactcatcattttttatggctgcatagtattccatggtgtatatgtgccacattttcttaatccagtctatcattgatggacatctgggtttgttccaagtctttgctattgtgaatagtgctagaataaaatacatgtgcatgtgtctttatagtagcgtgatttataatcctttgggtatatacccagtaatgggatggctgggtcaaatggtatttctagttctagatccttgaggaattgccacactgtcttccacaatggttgaactaatttacactcccactaacagtgttaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagcgtctgttcatatcctttgcccactttttaatggggttgtttcatttcttcttgtaaattagtttaagttctttatagattctggatattagccctttgtcagatgggtagattgcaaaaattttctcccattctgtaggttgcctgttcactctgatggtagtttcttttgctgtgcagaagccctttagattaattcgatcccatttgtctattttggcttttgttgccattgcttttggtgttttagtctttgcccatgcctgtgtcctcaatggtattgcctaggttttcttctagggattttttttttttttttttttttgagacggagtctcgctctgtggctcaggctggagtgcagtggcgcgatctcgactcactgcaagctccgcctcctgggttcacgccattctcctgcctcagcctcccgagtagctgggactacaggcgcccgccatcacgcccggctaatttttttgtatttttttagtagagacggggtttctccgtgttagccaggatggtctcgatctcctgacctcgtgatccgcccgcctcggcctcccaaagtgctgggattacaagcgtgagccaccgcgcccggcctcttctagggattttatagttttaggtcttacatttaagtctttaatccatcttgaattaatttttgtataaggtgtaaggaagggatccagtttcagctttctacatatggttacccagttttcccagcaccatttattaaacagggaatcctttccccattccttgtttttgtcaggtttgtcaaagatcagatggttgtagatgtatggtgttatttctgaggcctctgttctgttccattggtctatatatttgttttcgtaccagtaccatgttgttttcgttactgtagccttgtagtatactttgaagttaggtagcatgatagcatcacaattctatacacatttcaggaatgatttttttaaagagacacctcaattcttaatgatttttaaatttttgtaaaataatcaaatgcaaccaatggactgattgaataaatctacttttccctttttgttgatgggccctaaatttccaagtcttctgtgtataaggtgggcttaattttacaaatagtcattttgaagttaaaataacttgttttctgtatacccaattttaaaattcagaatgccatatcagccactttatggataatttctcacatacttctttctctgaatatgagaattttaaaaatttatgcaaaaatgtttcaacttacaatggcatattttaatataacatcttcaatttcaactttttccttttggatatacttttatagaaaggaattcagtatttattaaaccactattttcttcatctattggcagtgtgtttaaggaattcagtttataccttgtgggaatctttttcagataaactgtatatcaagtagttttgtggtgtttgaaggaactttttggcattcagggccatttcttgtgctgtacaaagcagcccttagtgctttctggagagcagactacttaaaattcatatgaacacattcgatgtgatgtgtatgtttagaatcactattgaaatatttctctatttaattggggtggttcatgctaattcacatggcggacattggcagctattttcagtctaccaattttttcttcgggggacatagtaaaatctctgcttccataaatgtttccactttctgaatgcagcagttttcccttcttcttctagctctttcttagtgggcagagagaacaggaaatgctagttgttgcaatgcaagcctggcaggcaagcacacctctcttccccaggaactgagtaagccacgatgctcaactccagtgactgttgaatttcaacagctgcaccctctctttttacccctggtgtcacatagagcatatgctcttggacattcaggaaatcaagtattgcttccattctggccatggtgctagaaatgcagggttttatctctttacctcaaccatttctgtctcctccctcagctcctaggaagctgctgactcacccttttcttgacaagtccttctgggtagtcttcctggatagcatctgagatgaaccccaaactggcacactttctatctctttctgtctgccacatctggaatcacaataaagaggacactactggtaaggacttcaaatgcatgtcaaatggtcagagccatgggctctaggaacaggtgccagcaagtcacaacaaagggttaaatgagaccaatctgcccactccacagtgggcacctctggactctgggtggatctgaggactcttctttggtctgaatatgttggaaacttatttgccagtgaaacagttttgagacatgaaacctttaagaaggcagagccctcataagtggactaacaccattatcgtggaagtgggttcattattaagagagtaggcttgttataaaagcaagttcagcctcctcttgctcttgctcttgacctcttttgccgttccactttctgtcatgacataatgcagcatgaaggcccttgtcagatgtcggcatcatgctcttggacttccagcctccagaaccatgaaccacataaacttctgttcatcataaattacccagtctgtggtactctgttacagcagcataaaacagactaacacagacccatcatctcctgacacagatataaagtgaatccctagcaggcatctttgtccctcagaaaagtcctggaggccaagtagtggaacagcagcataccaatatctttcccacaaaaaacctttctaatttcgtgtccaatatttctaaaagaatggaggcaagtggtcttccgagggtccccaaattattcccagccgcctccttggcaaggtctgctttgatggattcacagattgttctgcaatatgagtagcattgacagttactatctttgggcctcagtcaaaacagagacagagaatacccatttaacaggcactccaacttaggtatccacagaacgtatagttttgttattctctatcatgggcctgctcttgccaatgtttcagcagatagctgcgtagtttagaatttctagttaataatatttcagtttcaactgtctcccttcagtttaatatggggtgtatttaaaataaatacaactccctattagatattaaaggattgttttggaacaactgagtcctttcagataaatcttcaatactctacttttctctcacttctctcactcttttttgtttgtttttttgtttgtttgtttgtttgtttgagacagagtctcactctgtcacccaggctggagtgcaatggtgtgaccttggctcactgcaacctccgcttcttgggtttaagtgattctcatgcctcaatctctggagtagctgggattacaggcatgtgtcaccacacctggctaattttttttggtagtttttgtagagacacagcccaccttggcctcccaaagtgctgaaattacaggtgtaagccactgcgcccagactcactctcctttacttctccaggttggtggctgtgtctatgaggagtaccctttctatgtctgcaggaggagagtgggtccttgcatccacacagcagcctggagtgtcactctggacactctcttgcctcagcctcccgagaagctgggactacaggcatgtgccaccacacccagctaatttttgtatttttagtagagacggggtttcactatgttggccaggatggtcttgatctcttgacctcgtgatctgcctgcctcggcctcccaaagtgctgggattacaggcgtgagccactgtgcctggctgatagtttcttatactgtgaagaagctctttagttcaattagatcccatttgttaatttgtgctttgttgcaattgctttttgtgtttttgttatgaaatctttgccacttcctatgtccagaatggtatttcctaggttattttccagggtttttatagttttgggttttatatttaaggcgttaatccattttgagttgatttttgtgtatgctgtaaagaaggaatccagtttcagtcttctacatgtggctagccagttatcctagcaccatttattgaaataagaagtcttttctccattgcttgtttctgtcatatttgtcaaaggtcagatgatttagatgtctggtcttatttctggattatctatttggttctgttggtctatgtgtctgtttttgtaccagtatcatgctgttttagttactgtagccttgtagtatagtttgaagtccggtaatgtgatgcctccagctttgttatttttgcttaggattgccttggctatttgggctctttttaaattgtgtagttaagtaatgttaagcacattcacctgaataatcttgccaaagtaaaactttataatcattgaacaacaattcccacttttcaactctccccaaccctggtaaccactattctatcttgtgtttcaataaattttgctactttaaataccttgtaaaagtggaatcatacagtatttgcctttttgtaagtgacttatttcatttagcccagagtcttcgaggttcatttatgttatagcatgtgaaataatttcctttgtttttaaggtagaataatatcacactgtgtgcctataccacattttgtttatccactcatctgctgatgaacgtttaggttgcttccaccttttggctgttgtgaatagtacagctatgaacgtaggtgtgaaagacctcaagatgctgtttttaattcttttgggtatatactcagaagtgagattgctagatcatatattcaattttttgaaaaaccactatagcttttgagccaatgtttcaacagatagctgaataagttagaatttacagtgaacaatattacagtttcttccagtttcaactgtctcccttcagtttaaatatggaatctatttaaaatacaccccccattcgattttaaatgattactttggaataactgagtctttttaggtaaatccttaatacttcactttccatagctgttgcaccattttacagtccccacagtgcacaagagtcccgatttctcgacattcttgtcaatagttgtgattttacttatttattttggtagtattcatctgaatgggagtaaggtgatatatcattgcattgcaattggttttgatttgcatttctctgataattagtcactaattattattgagcatcttatacttccgtgatgacgtgggaatttttcttcattgtacaacagatatcattatagtggcgtagttctacactctacacaattttttctaacactacacaaaagcaaacactaaatctaacttccaattgtcaggattactggtctactcctctacccacccataggctgattataaatctttgaaattaattacatctaaaatttttctttcctgtcaagtcactgttgacgaggttcctctgctcacattggcagtctctttctttctcatgattcttcaagtcgtcattttgttagaggccaagctttcactcatggactgaagttatattgtgtgctttttgcctgagtgtttaatcccttaatttacaagcggatgtaggagtgcatacccaggaggtgagggcaaagactcccgttgagtctttggaatctcaaatctgttaccgttttggcttgggacaacaaacatcctgtcagtctcaattgctgtataattgaaaagagaatgataacagttgtcctacatacatcataactctctttgaatcaatgataattaatccatgtgaaaagctttcaaaaacttgtaaaaatccctcataattatatggtgttttacaatttacaaagaactttcacatgcagatttctcacgtgatttttatgttttgagggcagagtgagaaattataaagtatctgtgtatatgccaataatgatgcctaatatcccccactttacatatttaaaagacctttaaaattatggcttttcctagttttcacagcacattaaaaaagccaataccactacacaggtgtgtagtttctggtcttgtgcactgaccatttcctacaccatctttttgtatgctctctagcttccgtagttgttactcgagtagaagagtactgaaaggccacgtagaatatacagcttggtttcatcccactgataaaaatctacttttaacatacatgttaaaataatcaagcctgactaaattatttttgtattttttccattttacctgttatcaactttttaattaagcaatggggccatggtaggcagggtattccctagaacttgtgaatatgttaccctacatgacagaaggactttcagatgtaattaaacttaatgacgttgagttagagagagggtcctgcccagtggaatcacaagggtccttaaaggtataagaaggagtcagaggacagagtcagaaggagacgtgctgatgtgagaatggtcagagagatacaaccttcctgtctttgaagatggaggaaaggggccttgagccaaggattgttgttggcctttagaaactggaaaatgcaagaaaatcaagtctccctaaagcccctagaagggaacacagtccaactaattcatttattttagcccaggagatccctgttgggcttccgacttacagtactggaagataatacattcctggtggtttgtgtcacaaggtctgtagtactttgttccagtatcagtagaaaaccggtagaaggggaattcacgtaaatatcattacacacagaaataattacttattattcttttgttctcaaatcctaccttgtaaacaaaatgaatttttgtttttcggggcttttgtactaattcttatgaatccactgatattttgttttttctgtcgtctccctcaggaacccgaaaggaagaagctatacgactggggacacatgtcttagaagcacactcattagataaagtgtcgcatactctttgataaggtaaggctccctggacgagatgttttacaggtaccatgagctcagtgaattgcttttggaaagacactcagcggagtgggcaccacgaggttaggagaagcagcttctgctcgtcataactttggcaaatgtttacacatcagtaatgaaaaatattctcttggcgatttcaggcttgttactatggatgttgtttgctaacattgactatttttcctaactgcttatagaaactccaggctgtcacccatctgttctctcatcaaagtagttttgggccagcaactatttcagacatttctacagtttcagatgtctcactctgcctatgactgtatgttgtacttgaggactggacgcacagggtaaagtgcaaatagcaagcattcaggtccaactctcctccttctggttaacaatatgaaagaaagaggtagtatcggaattattttagttcaatgtagccattataaaatgtgtatatattttaaaacatcatgtggtacatgataaatatatacaacttttatttttcaataaaaaattataaaaaaagtcatcaaacctgatttctcatactacttttttggtaacactcatcacaccaaagacttattattttaaaatgttatttttcataattaatttcttattaattttataggctagattttaattgttatgtctaaatagtagtgtctggtacgtggtagataatcaatgtgacttgaataaatgaataagtctgttaacgacatacttctcatcactgtaacttatttttggtttaggactgataaaacattttttctctcaccccatattgctaaagatcaaatccttcttctttaagatgctaccataccattgttccattcatcaacgccaaatcattcctcgggcctgagaggagctgccatccttcacttcgtctttgggtcacttccaacctctgttctctgtgtgtctcttctggacttcctgggagaatagcctctctcatgatactcactttcttccacatcttcaatctctgcttcattgatagattatgctactcaatatagaaacaacatcttttttattttttaatgataaacattctccccctcaatcttttaacctactaatgcaggcaatctaatctaaagaatagcctgcaatgcctcctttcatcatttcccatttaatccagctttctggctgagtaattttgcagaaagccctttctcccatgtcacagatggaactttgcagtggcctattctgataaacatgtggcagtttacatgctatttgcatttgaagctgtttatcactccctccttctgagtactttcttcttggtgggcttttatgatagtaattgctatcctactgctgagtttctgaccactgcttgtcagacactttattatgctccctttcctttgcccatacttgcaaagttagatttccacatatgcctttcccgtcttcttattccatgagatttatctaagtgatttcatccattgctatgggttcaactgctgctaatatgttctttactcccaactctctttctacagcttcacatatttaactgccttttagggaatcaccaaaaggcaattccatcttaacatacacaaaactgaacttatgatccttaagtatgaggccagttctttcttatgcattttctaaatcagtgagtgatactatctcttgtcctgttgtcctgggcagaattgcaggaggtgaccgctttctctaccctccctataaaaattaccatctctcgtttaccaacctcccaataccccaatcattagtatctttttaagaaatgattttctgttgtttaacattttttatatgctattacctatatggttttcctcctgaaatgggatattgggtaagagggtaccagatggaggtcacatagacctacagtttattcaaaggggacatctatggagcaaaggcaaaatggagaacccagtgcagccaaacagctactcaaaggtctgagcagagatacagaaatgacacaggagataacagaaagagagagacatatcaagtgggttttgagtgtaggcaaaaccacatttacccgtagctctggagaacccactggcactgttttgagactgttgcagcctgcaagggagggcggacactgagttcagacacacacaccctccgaccagctcccaaatgtctgctgacgtttacaactttgcttcctgctttcctacctggtcttagccttttgatacacaccctcccactgctatcagagtaagatttgagctaagtacataatctggccctgccagattatgacattagttggagaatagataggtcaatgggacctgagatacattttagaaaaatattaatatgtatgccttatgtatagtgtgcagctggcattttaaacacgtggaaaatgatgaaaaatttaataaaccatgagaggaaattggataaatatttccgatacacacacacatcagattcccttttttatgtcacatgcaaaactaaaataatatttgaatggcttaatcagtgaaatatttttctaaattaactaacataccggaaaatatttgacttatctcaaaccaaatatgtatttttattgtatagggttttttcttttttaaaaaatttcagcttgcaatttagatataggaggtacatgggcagatttgttacaatggactattgcatgatgctgtggtttgaagtacgtttcccatcaccctggtagtgagcatagttcctgataggtagtcttttttaacctaacctccctccctccctccctccaccgtctagtagtccacagtgtctattgtgtctcatatttatgtccatacatgctcaatgcttagcttccatttataagtgagaatatgtggtatttggttttctgtttctgcattcatttgcttagatcgccccagctccatctatgttgctgcaaagaatgtgattttattcttttttatggcgtatagtatttcatggtgtttatgtaccacattttctttgtccaatttcctactgatggtcgcctgtgtggattccatgtctttgctattgtgaatagtgatgcagtggacatctgagtgtaaatgtgtttttggcagaatgatttattttcttttgagtgtatacccagtaatgggattgctgagtcaaatggtagctttgttttaagttttgagaaatctccagactgcttcctcagtggattggtctaatttacattcccactaacagcgtataagctttcccttttctctgcaatgttgccagcatctgtttttttgactttttataatagccattctgactggtatgagatggtatctcattgtggttttgatttggatttctctgatgattagcgatgctgagcgttttttcacacatttgatgtatgtcttctttgagaaatgtctgttcatgtctttgcccatcttttaatggggttaattgggttttgtttgttcaactgtttaagttccctatagattctggatattaggcctttgtcaggtgcatactttgcgaatatctcctcccattccctagactgcctgtttactgtgctgatttttactctctgtttattttgctatgtaaaagttctggagtttaattaggtcccacttgtcccgtttttgtttttgttgcaagtgcttttggggacttagctaaaaattatttgccaaggctgatgtccagaagaatgtttcctaggttgccttccagaatttttatagtttgaggtcttacatttaaatctttaatgtattttcagttaatttttgtatgaggtgaaacggaggggtccagtttcattctgctacatatggctagccagttatcccagctgtgtttattgaatagggagttctttcccattgcttgtttttgttggccttgtcaaagatcagatggttgttggtatgtagctttatttgtttgttttctattcttttgcattggtctatgtgtctgtttctgtaacagcaccatgctgttttggttactgtggctttatagtatagtatgaggttggaaagagtgatgcctctggcattgttctttttgcttaggctttctttggctgttcaggctctttttggttcaatacaaattttagagtaattttctaattttagtaaattttctaaagtaaatgttctaatcctgtgaagaatgacgttggtaatttgataggtatagcattgaatctgtaaagtgctttgagcaatacggccatttttacaatagtggttttggtactgaaacaccaggtgctcagtctaggtcctgctgcttgctgcacagaaagccaatgactgagacagcaagtattgccaaggaagaagctttaatccggtgctgcagcagaggaggtgggaactcagtctcaaatccatctctctgacctactaaaaccagggatttatataacaaggaaggaatgtaacattgtgtaagaaaacaggaactagggaggtgtcaggaagcaatcgcgatgaatgaggggtacaacatctcattgtctggatgtgatgatctactgagtttcagttctttgacactttttgtgagaggcctgaaggtcatttcctcaggaaggaactcagataaaacaaatataagtttcaagctttaagaccagaagggtcaatttctatgtttattaaaaagaaaaaaactgttagactgggcgtggtggctcatgcctgtaatcccagcactttgggaggctgaggcgggcagatcacgaggtcaagagattgagaccatcctggccaacatggtgaagcatcatgtctactaaaaatacaaaaattagccaggcatggtggcacatgcctgtaatcccagctacttgggaggctgaggcaggagaattgcttgaacctgggaggcggagggtgcagtgaactgagattgcaccactgcactccagcctggtgacagagcgatactccatctcaaaaacaaaaaccaaaaaccaaaaaaacaaaaaaaaaaccaaacaccagaataaaactgtctatgggacaattgggtcagctttagtttttccaatccttgagcatgggatatttttccatttatttgtgtcgtctcatctcttatttctttcagcagtgttttgtgcttctcgtagagatcgttcatctccttggttagctgtatgcctataggtattttattttctttgtggctgttgtaagtgggactgtgttcttgatttcaccctcagcctggatgctgttggtgaaatatgtatttttaaaaaagaaaagcaaaaaaaaaaaatagatagacttgactaaacaaacattattataaacaagaatgagtgtcaatattcttttccataaggtactcttacaaatcagtgtaaagaattataatttctctatttaaaaaaggagatagcattgccagttcacaaattgtatataagtggcctatgaatgcaaaaacctcaattgcataagtaataaaaaagtctaaataaagtgatattacaaattgtataaaagtggcctataaatgcaaaaaccttaattgcataagtaataaaaaaagtctaaataaagtgatattattttctactgatacaattgatggggagaaaaaccaaaataaagtgaacagaagaaaatggggaaaaagggagccttttagactgctagtgggagggtaactttgtataaactattagaatacaatttgtcaatccgtgttacaatcaaattgttcattcactttgtaacaacagttctatttctaggaaataattatagatggcaactatttctatataaagcttttcattacaatgttaaatatgataaaattggggatactcaagtggtcactaataggagcatgactaaataaactttggtagtgacagtgaatagaataccatgcatctattagaaatgccttttagaaaataaagtcaatggcatggggatacagacataatttgtaaagcagtataactcaaatttgtagaaagaaattacaggacaaagactggtactgattcaaaatggtgcctggctacgacgggcctttgtccccagaattaagcctggagaattgtcctcgaagtaaagcaggtgctctacgtgtagaaagctcctggtgcggatgctggactctgagagaaggctgagcacagccttgggtaatgcagaacttcctcaaaaggcaaggaggcaaaaataaaacaagtgaagagcaactctcttagaagaggaaatgcactcaagcccttgggccacagagaaaagtgctcctgaaactggaaactctatggtctcccagcctccagcctgcctgctcttcagtcagtcaccctacaggtgacaccccctgcattccccactctcattttcagagagctgctgccgggaccctcattctgggaatggactatgaggaaggagacctacatagttgtcaaggaaacctatgccagttacatatgccatacattttaatcgcttagttatcaatgtgacaggtagggagaaaacaccaaatgcttgaggaaaaccaggggtatgaaagagaagcattaagattactttttaatggaaatgtatatattcacctaggctattcttccttacccaagttgaaactgaatagtatgacctaaacgtacatttcgtgtgctgggaagaaaaagcaactgataaccccctttcccgtaggtttcctgtcattaatttgctcaccagtgcaaccccattcaggcccccaagctagtgccatcttgtgtgcacaaggctggggcaattggattcataagaagttttgtccatgaggaattttcagtctaatgccaagtaattgacaatgaaaatgtttcctggtttccatccaaatatttattaatacagcaaaaatgtaggatttgtaggatttatgtatcttccaactatctccactactgcaggacacagacaccatctataaatctcacattgtaaccactaacacttatctttgttattgtcacctggaatcttttatgccaaaataagagtcttaaaagaatgaagccctgcaatttcactgtccaacaacagaggttttacctgataaatcgtcttctcgtctgacagagtgggccacagaaacatctctgacagctgttgcatgatggagtgggagcaaggtcacttcctgcaaatgttagggttcttcagaatccttcaggcgttggaggaataattgaactcaacaggcaatcagtcacgtctgaaacatgtgaaatatacctaaggacccgaggtcagggttgagtgtccaaattcaaccagttattcacacggtctgaaaatgaaaatgtttcatttcagagaagtttatatggagtccttgacagaatgttgaatatgaaatagattttttttctgtcttcctttgaaaatctttgtggataaagcttaacatggtgcattagaatcttaggagtaaaatatccctcacaaaatttgatatcttatctgattagttaatacagacatattacatttttcaactaattttttttcttaagaagaattctttcagaaacggagaagcatgtagtaacatactgattttaaggaacctatgctaacaattttaagtagtaaaacttaaaactaaacttaagaagtaataaaaaggtgataataggataattactatttggcatcctactaagatatttagttggcaatttaattttaaattacctggttttctctgatattcacatattattaaatgcaatttcatttaagctgctctactaagtgttagggaaatatgaaaattgaaagtgtgaccttgttgtccagtaaagtaattttatcgaatttggtagactcttaattgtccctaagtattcattttccctttctttttttttttttattgtagcttttcttttgaaatatgcgttgcctcccagacattgcaaaatggtatagtgagttctggtgtattcttttttttttttttttttttttttttttggagagacggacttgttctgtctctcaggctggagggcagtggtgtgatcatggctcactgttgcctcgacctcccaggaacaagcgatcctcttgcctcaacctcctgagtagctagaactacaatcacccctcaccatgcccagctaatttttaaattttttgtagagatgaggtccgctatgttgcccaggctgatttagaactcctggcctcaagggatcctcctgctttggtttcccaaagcgctgggattcaggcatgagccactgtgcccagacttaattctggcgtattcttaagccagtgtcccctaatgaaaatatcttccaggacctcagtgcatggtccaaatgaggaagctgttaagaggtacaatactattaacacatgtacatacagatttcaacagcatttaagttcagttttttctttctgtcttttgttttgtgtttatagttctttttctgtcttcctttgaaaatctttctggataaagatgtttccacagatttctgtagatgtgttcagccatcaccacccagtcccagttagaatcagggtacagaactgcttcatcagtctcatgagaaggtgtgactgaaaggagcagtgcaaagatgctcctttgtcctttcagtcacgctttctccctgactctgacctttggcaccagctgttaggtcttcacactctaattttacactttaagaaaggtatgtaagggcagggtgcagtggctcacacctgtaatcccagcactttgggaggccaaggtgggcggatcacgaggtcaggagatcgagaccatcctggctaacacggtgaaaccccgtctctactaaaaaaagtacaaaaaattagccaggcatggtggtgggcgcctgtagtcccagctactcgggaggctgaggcaggagaatggcttgaacccaggaggtggagcttgcagtgagctgagatcgcaccactgcactccagcctgggtgacagagtgacactctgtctcaaaaacaaaaaaaaaaaagaatggtacgtaagtagaataatgtaggtagcaccattttgagattgcttttttttcattcatcataaagccctacaaatccacctaagctgttgcctgcattgatagtttgtttctttgttttgtgtcacagtttgtctatttattcacaggttgaaggatgtttgagtggtttcaagtcgtgggctgctacacatgaagcagcaatgaacatctgtgttcacattcctgtgtgactgtgtgtttcacttctgtagcataaatacccaggaggcctggattgcattgcaaatatgtttttaactttgtaggaaacagccataccaccttccacaatggttatgctgttttccatttccatcagcagtgcatgagaaagcctgctgctctgcgtgcttgtcagcacacggtattgtcagtatttttattttagccacttattaggtgtgcattgatgtctcattgtagctttaatttgcatttccctaatggctaatgatggtgaacatctttttatgtgcttatttgctatctctataccttccttgatgaggtgtcaacaaatgttttgcctgttttcttgttgttgaggttgcagcattctttatatggtctggataaaagttctttcttaggtatgtgatttgtaaatatttcttccaggcaatagctaactttttatcctcctaacaagccctacttagaactgaagtttgaaagtttgatgaagtccatattaccaatttttttctttcttagacatgacaactttttgtctaactcttgcacaggaagatttttttcctgtgttttcttctagaaatgttgtagtttcacactttacatttagatctatgatctattttgagttaatttttatagaaagtgtgaagtttaggtctagctttttgtttgtgtgttttcttttttggcctacagtgtttaattttcccaacatcttttgttgcaaattctaatcttcctctatgggattgctttgcattttcattttaaaaaattaagttgactgcacctatgcaggtctatgtccagttcctttatcctgtgccattgatccgttcctctgcccaagccacactgtgaggctgtcttcccaagctcctccctttccaggatctccccggccacagcttctcctttcctcgttttgatcatctagccagaaagctgggcttttagttactcagctctgctgtgcacatcctgcaactgcggctgctccaagcaggagatacagagaaaaagaagccagtcttttcctcaccaccttagaaagagaggtccctgccttgaagctcacgctccccgcacctgctgccttcacagtccttaccctgcagagcgcggcttgagagaggagaggggcgagcttgggatggtggatggccctcccagctctgagctttgggggccagagctaaaagagaggctgctgtctccaagttgccttcaatccaagctggagaattctgcagacaaatagggcgctttcctccactttggtagtacttcaaaatcttgtcttcttcctcaatgcgtcaactaccacccagttttcagagccctccaacctcttttccctgcatttcttcctggcactggatccctaagtactcagtttaatccatacattgcccttatcatttctttttttctttttctttttctttttcttttttttttttttgagacagagtttcactctgtctcttaagctggagtgcaatggtgcaatcttggctcactgcaaactcagcctcccgagttcaagaggttctcctgcctcagcctcccgagtaactgcgattacaggcacctgccaccatgcccagctaacttttttttttttttttgtagttttattagagatggggttttgccacgttggccaggctggtctcgaactcctgaccttaggtgatccatctgcctcggcctcccaaagtgctgggattacaggtgtgagccaccatgcccagcccgcccttgccatttccatcatctgtctttcacactggatcttttttcagttgttccaataaaccaagtggtaaaaatttgaaaagtgaatgtgagtaataggaccaaatttaaaaagttatagaattttagggttggagaggaacgtgaaagagttataatcaccctttcaagccaccaagctgagatgaaatgccttgccctaagtcactcttagccctctgatcttcctacgatgtcatgcgactttcacatagaaactaaaaggacttaccattaatttctcctctttcatttacacatatgaatttttttaaaagtctttctcatatcttgactaagttatactcacaaaacctacccatttttctgctgaatttattcttgaacttgaatacagtctcatgtggaaacagtaataataccaaaattgcaaataatctttatatctgacattgctcttagttaattctgttgctagtttggaaagttttttttttttaaaaaagaatgtttaaacatcattacgtttaaaacattttaaagcctgagtacgagttttaaatcagaatcactgacttccctcccttacacctcattattacaaaccttgatttgaaagccgtatttcctacaaagagtcaaacgagaaaaaacatactcctgtgtgaaaagaaatataccaatgtaccaaatccttatagtttctcttccccaacctgtgaccaatgttcaccctttggtgccagactcatctgttttacacacacacacacacacacgcacacacacacaccccgaaaacttgatgtaaaatgtaaataattcatattagacataataataaggaaaggaaagcaaatagcaaatgtgcctttgttgttaggagtgaagatgcaggttcagaattgtctgtgctgagtaaggataaggtcttaatatctgagaaaaggggtctgaatcctgaggaggatatacagaaagtggccttttgaattagactatttgggcaaatgtgcagaatgatggcgactgactgggcagaactggcgtatggcaccaggttgtagcaatggagatgaaataaaagggcctgatccctaaaagaactttaaaggaagaaacaacaggacccactaacaaatggaaaataagtgatgaaggaagataatcacaataatatgtagtgaatctgagtcttttggccagggaacttgtgacaaatatagaagtaccaaaaaaaaaaaaatagagacattcgaaagatggatatgggatggaaaaaatgaattgttcaggatgtgctgagcttgaaatatcaaggtcatattcaacagaaaaagaaatattgtgaaggggcccagatgtgagggtagggcaaaaaatgatattagtagaaaagtcatttgagtaaagaaagtggatatgttaatagggaaaacagagtgcttggcccagggcagaccctgtaagattcccatgagtaaggatcagcaggtcaaagatttaccagtaagaagacagaggccaatgagacaaagcaagaaagcccagagtccagagagcatgagggagtcctgtttcagaaggggagggtgactagccggaagacttggagaaagtggaagatgaagaaaatcctttgagcgggggagcactgtctggcttggaagatggtcctaggagataggtggggaaatggccagatttggggaggaagaatactggggaatgtgaaaggtctgtgcctagagaacaatgcgtcaggacatggtgatggaatgaagggattggacagcgctgaacattttaggagacagaaggaaaagaagagtgaagtgagacagaaagacatggaggatgtgaaagaaaatgtgaggatttatattcaaaataccaaaaagctttctaattcctagacttgcccccggctagagtgggctatctgggtgaagagtttatacagatatccccatatacactatttattctacttagataacactctagagacactatgtcctgttttcttgaaagactcataccaatggtgacatttcagatcttctaaggaagtttattttagcttcaaaataacacgggtggcacgggggaagtatttttagcctcaaggagcgttttaggccaggcacagtggctcaggcctgtaatcccagcactttgtgaggctgaggtgggaggatcatgaggtcaggagttcgagaccagcctggccaacatagtgaaaccccatctctactaaagatacaaaaattagctgggcttggtcgtgtacacctgtaatcccagctactcaggagactggggcaggagaatcacttgaacccggaaggtggaggttgcagtgatctgagattatgccactgcactccagcctggttgacagagcgagactctgtcaaaaaaaaaaaaaaaaaagagaggactttagtacttctgaaactcctctgtgtagctcttcgttcaagcaatcctaactcagaagtacaagaaggataatattcttgtgtgtgctctgaagctatttagtagcatcagaaaggtggagaataagtagcttataaaacattgacagctcttcaaattggactaacaggaaatctccaggcattttattcataattttggaagaaatgcaataacaaagatttaatgggtcccatattgtgaaacataattgatctagaataagtactattcttattcctatagacaatcatactctgagattttggtcaagtatcagttgattgttaattatctacgtgtttgaaatatatgaaatttaatagagaggccataagtcacatccaagaagtactaagagaaagcaccactgcaaaatcttggtaaattcagaaaataataacaaatctcataatgaaataaatattttattgggattataagacctaccatccaaagaaccattaggaactttacaataactcattaatttatatgggaaatatgacagaaagcaatttctgcttttacttcttttcttctttacttctttcccttagtgtgttttgcatgtgtgtttgtgtttccttgaatcgttgcttaatccaagaagctttcaattgacatcccatgtcagacgggaatgccactgtatcacttattgatttcaacagtggtagtttactcctggaaactaaaaccgttaggtgtttctaaaatgtatgcacacacacacacacacacaaacagagtttaagggttaagtatttatcttcctacctgtatttttcagaagaaagaagaaaaggaggatatgcttctgtactagagactactctttattagaaaagcacaggaacaattctcaacctgaatattttcaataaatgccttggtgaaaattactgaagtggtgctacaaaattgccttgtcttatttttgaggacatgtggaaagcctttctacaacttttagatatatgtaataaagctgaacattcttcacatcatccaaacttattagagagcttaaagtgtaatagtcaaatcgctagcattggttagtttgaatgaatagtccttttaagacttttttttttttttgagatggagtctcgctctgttgcccaggctggagtgcagtggtgcgatcttggctcactgcaagctccacctcccgggttcatgccattctcctgcctcagcctctggagtagctgggaccacaggcacccaccaccatgcctggctaattttttgtatttttagtagagacggggtttcaccgtgttagccaggatggtctcgatctcctgacctcgtgatcctcccgcctccacgtcccaaagtgctgggattacaggcatgagccactgcgcccagccaagactttttaaaatgcttccttcttcatggatctgggctcctgagtgagtgtgctgagtgaatcatgcatggtagcagacacctttcggaatccggcttcagtagacgtgagggtaactccagtgctcagaaaaggtcccttagcagctggacttgctcaaggtgactggatgctcgtcataagatttccaggttgggtctgagttatgtcaagtactagttggaattgatttattgctgtcttgctcacaagccaggagcacacttctgaagttgccaagagtgtgaaaaagcagatatccaaattgtgaagtgagtggtttcctacattaactcgaattgattttgttcttcctaatgctgataaggattattttggagtagaatacagtagccccctcttatccatggggatacattccaagaccctcagtaattgtctgaagtcccggacagtattgaaccctacatatactatgttttttcttatgcatacatgtctttaataaagtttaatttacaaattaggcacagtaggagactcacagtatctaataaattggacgattataaaaaaactgtaataaaattatgtgaatgtggtctccttctctccaagtatactatagtgctgtaatcacctattttcagcccatgctgacttctagtaactgaaacctcaaaaagcaaaactccagataaggggtttcatttactgtaataaaatgaaaattctgtaaacatgtttagttgaaaatatcttacagacatacataattcagtggaagcgatagtgatatgtttcagaaattcagattcaagatttcagaaattcagtttcaaggttcaaggctcctctgacaattgaatgacttagtttttcaaatataatcaagattctgccttgaattatatataatatatattattattatttccatatataatttatggaaaagttataaaattaatataaacatttgaaatactgtcttttggctcactttgaaaagatttccagtttgcttctaaatgaataacaaatttgaaaggccaagtgatttaaggcaggtacatcactacttagcaatacgatttgttcaagcaggtgaaaagtatgcaagaatcaaaatgctctttgcaaaaggagcttcaattttcatcaggaaaacccagtttgtgtcagagggtgaaacttgcttgactagatctgttcactgaagccattgaacaacttccgatgttcttgctctctcccatttacgatgctgaactttacagagacagactgtttgaagccttcctaattattcccattcttagccaagaaggattactaaagctcagcctctattgtaattcttaaacttctcagtgcaaattattaatatatggcaatctaaaatgcctttctctggctttatgacctgattattatttcgagtctctctagcagtgaacttgaggatcatgcaaacatgttctatgggaacatcactgtgtagctgaataatttgttttttagtaagctagctcaaatttatcatcagtcatgaaaatgttttatcaatgctcttccataaagcagacatattattttactagtttcagtttagccctgacagaaacctgatcgggaatactattattaagccacaaatacctgttttaaaatatgttgtcttatgctatttcattgtattgtattaataattcatgtaatatttcctttggttttattgtcttctgtgttataattaaaactgaaataatttgggaaatgtaatgtatatagcacacatctaaagttcagagtgagaataaaactacaactattttatctattgcaatagctcaaatagtagagtttaactataatacttggtatacatatcaaacaaggtatctatacatacattattttaattttactcctccctcattttctctccacgtcccatcacataaatatgcacaaatttaactggccagaggtgacctacattctctacatgcagtgtccatgatgaagatagcaactgtatttgctaaggttttcacagttcataacagtgaaataaaatgtagctatggacattcattgattaatctaatatttattgaaggtgtatttgttagattccgtgatacaatgatgaacaagtcattgtgtaatcatgaagagcttctagccaagtgggtaaaaagataaggaaatcatcccaattagtgagataaactacaagatagggaatcattccgtgtgttaccagcacattctacccacgctgtatttttcagggaaaggtggtgtacattacctgatgtctaaataggaggtaaaagcataaggtgctgggagacaaaggagttgtagattacctgatatccaaataggaggaaatagcataaggtcatggaagagagaggggtgtagattacctgatgtccaaataggaggtaatagcgtaaggtcctgggagacaaaggtgttgtagattacctgatgtccaaataggaggaaatagcataaggtgctggaagagagagggctttagattacccgatgtccagataggaggtagtagcataaggtcctggaagagagagggttgtagattacatgatgtccaaataggaggtaacagcgtaaggtcctggaagacaaaggtgttgtagattacctgatgtccaaataggacgaaatagcataaggtcatggaagagagagcgttgtagattacctgatgtccaaataggagggaataccataaggtcctggaagacaaaggtgttgtagattacctgatgtccagataggaggtaatagcataaggtcctcgaacacaaaggtgttgtagattacctgatgtccaaataggaggtaatagcataaggtcctggaagacaaaggtgttgtaaattacccgatgtccaaataggaggtaatagtataaggtcttggaagacaaaggtgttgtagattgcctgatgtccaaagaggagggaatagcataaagtcctggaagacaaaggtgttattatattacctgatgtccaaataggaggtaatagcataaggtcctagaagacaaaggtattgtagattacctgatgtccaaataggaggtaatagcataaggtcctggaagacaaaggtcttgtagactacctgatgtccaaataggatgtaatcgcataaggttctggaacagagagggttgcatattacctgatgtccaaatagcaggtaagagcataaggtccgggaagagagagggcagtagattacctgatgtccaaataggatttaatagcatacgatcatggaagagagagggctgtagatgacatgatgtccaaataggaggtaatatcataaggtgctggaagagagagggcattacattacctgatgtccaagtaggaggtaatagcataaggtcctggaagagagagggttgtagattacatgatgttcaaataggaggaaatagcataaagtcatggaagagagagggttgtagattacatgatgttctaatagaaggtaacagcataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtattgtagattacctgatgtccaaataggaggcaacagcataaggtcctcaaagacaaacttgttgtagattacctgatgtccaaataggagggaatagcataagctcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatatcataaggtgctggaagagagagggcttaagataacctgatgtccaagtaggaggtaatagcataaggtcctggaagagagagggttgtagattacatgatgttctaatagaaggtaacaggataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtgttgtagattacctgatgtccaaataggaggcaacagcataaggtcctcaaagacaaacttgttgtagattacctgatgtccaaataggagggaatagcataagatcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatagcataaggtccttgtaagagagagggttgtagattacatgatttctaaatagggggtaatagcataatatcctggaagacaaaggtgttgcggattacctgatgtccaaataggaggaaatagcataaggtcctggaagaaagagggtagtacattaccggatgtccaaataggaagtaatagcataaggtcctggaagacaaaggtcttgtagactacctgatgtccaaataggaggtaatcacataaggttctggaacagagagggttgtatactacctgatgtccaaataggaagtaagagcataaggtccgggaagagagagggttgtagattatccggtgtccaagtaggcggtaatcgcataaggtcctggaagacagagggttgcagatgacctgatgtccaaatgggaggtaatagcataaggtcctggaagacaaaggtgttgtagattacctgaagtccaaataggaggtaatagcataaggtcctcgaaaacaaaggtgttggagattacctgatgtccaaatagcaggaaatagcataaggtcctggaagacaaaggtgttgtagattacttgatgtccaaataggaggtaatagcataaggtcctggaagacaaaggtgttgtagattacctgatgtctaaataggaggaaatagcataaggtcctggaggacaaaggtgttgtagattacatgatgtccaaataggacgtaatagcataaggtcctggaagacaaagttgttgtagattacctgatgtccaaataggaggtaatagaataaggtcctggaagagagggctgtaaattacctgatgtccaaataggaggtaatagaatcaggtcctggaggagagggctgtagattacctgatgtccaaataggaggtaatatcataaggtgctggaagagagagggcttaaaataacctgatgtccaagtaggaggtaatagcataaggtcttggaagagagaggtttgtagatatcatgatgttctaatagaaggtaacagcataaggtcctggaaggcaaaggtattgtagattacctgatgtccaaataggaggaaatagcataaagtcatggaagagagagggttgtagattacctgatgtccaaataggaggtaataccgtaaggtcctggaagacacaggtgttgtagattacctgatgtccaaataggaggcaatagcataaggtcctcaaagacaaagttgttgtagattacctgatgtccaaataggagggaatagcataaggtcctggaagatataggttttgttagattacctgatatccaaataggaggtaatagcataaggtcctcgaagacaaaggtgttgtagactacctgatgtccaaataggaggtaatagcataaggtcctggaagacaaaggtgttgtagattacctgatgtccaagtaggaggtaatagcataaggtgctggaagcgagagggctatagattacctgatatccaaataggaggtaataccataaggtcctggaagagagggttgtagattacgtgatgtccaattaggaggtaatagcataaggtccttgaagacaaaggtgttgtagattacgtgatgtccaaataggaggttatagcataaggtccgggaagacaaaggtgttgtagattacctgatgtccaaataggaggtaatagcataaggtgctggaagagagagggctgtagattacctgatatccaaataggaggtaatagcataaggtcctggaagacaaaggtgttgtagattacctgatgtccaaataggaggtaatagcataaggtgctggaagagagagggctgtagattacctgatatccaaataggaggtaatagcataaggtcctggaagagagggttgtagattacttgatgtccaaataggaggtaatagcataaggtcctggaagagagagggttgtagattacccgatgtccaataggaggtaatagcataagatcctgcaagagagagggttgtagatcatctgatgtccaaatattaggtaatagcataaggtcctgggatacaaaggtgttgtagattacctgatatccagataggaggaaatagcataagatcacggaagagagagggcagtagattacctgatgtccaaatagcaggtaatagcataatgtcctggaagagagggctgtagattacctggtgtccaaataggaggtaataggataaggtcattggagagagagggctgtagattacctgatgtccaagtaggaggtaatcacataaggtcctggaagagagagggttttatattacctcatgtccaaataggaggtaagagcataaggcccgggaagagagagggttgtagattatctgatgtgcaagtaggaggtaatcgcataaggtcctggaagagagagggttgtagatgacctgatgtccaaatgggaggtaatagcttaaggtcctggaagacaaaggtgttgtagattacctgaagtccaaacaggtggtaatagcataaggtcctcgaagacaaaggtgttgtagattacctgatttccaaataagaggtcatagcataaggtcctggaagtcaaaggtgttgtagattacctgatgtccaaataggaggtaatagcataaggttctggatgacaaagttgttgtaggttaccggatgtccaaataggaggtaatagaataaggtcctggaagagagggctgtagattacctcatgtccatataggaggtaatatcgtaaggtactggaagagagagggctttagattacccgatgtccaaataggaggtaatagcataaggtcctgaaagagagagggttgtagattacatgatgtccaaagaggaggtaatagcataagatcctggaagacaaaggtgttgtagattacctgatgtccaaataggaggaaatagcataaggccatggaagagagagcgttgtagattacctgatttctaaataggaggtaatactataagctccgggaagatacaggtgttgtagattaccttatgtccaaataggagttaatagcataaggtcctgcaagacaaaggttttgtagattacctgatgtccaaataggaggtaatagtataaggtcctggaagacaaagatgttttagaatacctgatgtccaagtaggaggtaatagcataaggtcctggaagacaaagatgttgtagattacctgatttccaaataggaggtagtagcagaaggtcctggaagacaaaggtgttttagattacctgatgtccaagtaggaggtactagcataaggtcctggaagacaaaggtgttgtagattacctgatttccaaataggaggtaatagcagaaggtcctggaagacaaaggtgttttagattacctgatgtccaagtaggaggtaatagcgtaaggtcctggaagacaaagttgttgtagattacctggtgtccaaataggaggtaatagcataaggtcctggaagacagaagtgttgtagattacctgatgtccaagtaggaggtaatagcataaggtcctggaagacaaaagtgttgtagattacctgatttccaaataggaggtaatagcagaaggtcccggaagacaaaagtgttttagattacctgatgtccaaataggaggtaatagaataaggtcctggaagagagggctgtagtttacctgatgtccaaatgggaggtaatatcataaggtgctggaaaagagagggctgtagattacctgatgtccaataggtggtaatagcataaagtcctggaagagagagggttgtagattacatgatgtccaaataggaggtaatagcataaggtcatggaagacaaaggtgttgtagattacgtgatgtgcaactgggaggtaatagcataaggtcctggaagacagagatgttgtagattacctgatgtccaaataggagctaatagcataaggtcctggaagagagtgtgtgttccagtcagaaggagctattggttcaggatagctgcaacatacatttagtcattatgatggaaaactgataatggagttaggcctgatgttgagatgtataattgaagaagagtgagaggatcacctttcaattcacaaagatcatcatagggccagtataaaagtattttagagacaagtaataatggaattagggaaaccagttcaggtaaaaaatgatgttgttctagattttggaggtgactgaagagaaaaagtacatataattcacttatagctctgcttatcctattacgggtatttctttctaatggagattacagatgttatttttaaaacactttgtgattctgaggaggcatttacttatgggtctagttgtatcattagtaacaatatatattgtgtttatcttaagcacacttctctgcacattatctcaacttcctgggttgcttgatcggataaagcatttatatttgtcttctaaaatatgactaaatactatccccaatcaaagtgacataatattccatagttgtgcaaatgtttagtttttttttttttgtgccgaaagataagtcacaggctggggtatttgatttttcttttaaaaatgataaagcagaaggagagagaaagagaccaagaaaataaaattgtatacagtgaaacacagatgttatctgaaaaatggattttttaagagaaatataggtataaaaggcattcatgagaaatacaagaagagagaaagagaagtgaataaattaaactcttttaattattgcaacagctcaaatagtagattttaactataatatttgatagacatgtgaggtctttatacatatactattttaattctctctctatatatataatgaaatgttattccaaaatgcaatataatcccgtggaaaatttattcagtcggaaaaaggagaaaataaggttctaatactgattttagtgcctcaggcaagacacataactttttgggcatcaatttctatatctgtaaaatgaaaacacacgccctactatgtatatcatatgtaaatgtctaaaatgagataatagtattgaaaatggctttgaaaaaaaatacaagggattgagtcactctaaggaatgactgttttttaggagtcaacaagaggcaaaggaaataaaatttattccaactaaatgaaaaagtgttactgaaatgttagccttttttttttttttttttttttgagacggagtctcgctctgtcgcccaggctggagtgcaggggcgcgatctcggctcactgcaagctctgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaatgttagccttttaagaatacaaaaaaatctaattatatatgaatacaatacctgaacccatgaaacttctgtagaatacatgaatctgtaaagttatgtattctaaacatttgtagccagaataactttcttcatattttccacattcttggtacacttacgtgtcacacatgttccctgtttttcaaacaaggtcaatgttttcattatatacatttacattgttattgtaactattttccaggtctgtcagtaaaatttagtctcacacattgataccacattcttgcaattatattgtaattctcacatagtaattcaagcctttttgaatatacaaatcatctgaatttattatatcactgctatgacacctcatacacatgttgagaccatttatgccagaaaagattagatttagtattcaaagagccaaatgtaaataattctggattgcttatccaaatggggaactcagagaacttctatagtttaaatatgcaaatattcaaaagtaatttttttgtgaccataccctcctgctactgaatgtttccttgagctggtgtcagaagcagggtttacaatgttgtgctctatttcctgtttaacctattgccaagatgttaattcagagtgaaataataagaacttagtgagaactgggggtgataaacaaagtgtcctcacagcggagaaactggaaaatgtatccttgaaagcgtgtgaatcgggtgagcgtacaacgggtaacatcagtattggtgttctcactgctgggtcagcactgaccagcagagtctggtgggagccagcaggaccagaaacatgtcctcagtttgggccaatttaaagaagttgggaagctttctagagcccggccgtgtgtctctgcccttgctacaactcctccctctgtctcacagccagagatgcacccatgatgacattcatgtaggctattaagggcgagcatttctcggaaggtgaagcaagatatggtagtcattccaagaaaccttccttctcagctgcgatttgtcaagaggaaagaagtggagttttcagtggaaagcagatgtgaatttggagcagtggggcacttccagagaatgagcccgggtcaattttcataggcaattggcaacatgaatgcataggcactgggaagaatgtaaatggcaagtccaggaagcaagtagtagctaacaaatgcgtgaaagagtagaggagtaaaataacgatttcatcctctgaatgctgcccagagtcaatcccactgtaccccgtgcagagaaagtgactccaggagtgtgtgcccagtctagaagaaacaacaacactccttccatgtagagccaaaatcgtgtgtgtccctcggcctgaggagctggaagaatcctgaatcttctccatttagggcaggagttttagtggcatgtcaaatgtgcaacatcctccaagcctagaacctagaggtggttctagaacacttttcttccttgcttccacatctgtccaattacccacctcaattaatagttaccagaatattcccagagaatcataccagcacactctttgcaccaggaaggggtacagatatgttacaagaagagaggtggctgtcagagtggaccacatgtctttttatagtttggtgctttgtctttcacaataccagcttgccgtctagcaggggatgtctagcgtctcctacaaacatactgattatctaggaacatcatagcaccaaagaggccttctgccctcttccattcccacattgttaagaaaaaaaaaaactggttacgtaaattacagcatattcatttaatacttggaatataaaaaggggtggaaacattgttaaggcccctgtctgtgtaaggatatagaaagcagccaagatatatctgtaggtaactaaaatgcagatgtgcacaatgctgccatgcctgtagaaaacaaggccgggtgcggtggctcacgcctgtaatcccagtgcctgtagaaaacaaggccgggcgcggtggctcacgcctgtaatcccagtgcctataaaaaacaaggccagacgcggtggctcacgcctgtaatcccagcactttgggaggccgagatgggcagatcacagggtcaggggatggagaacatcttggccaacatggtgaaatcccgtgtctgctaaaaatacagaaattagctgggcgtgcctgtagttctagctacttgggaggctgaggcaggagaacctcttgaacctgggaggcagaggttatagtacgctgagatggcactattgcacactccagcctgggcaacagagcaagactccatctcagggaaaaaaaaaaacacaacaagcaagtacacaaaaacgccaaacacacaaaactatacagaacatatgatttttgccaatattccagggtaaaaacatctcaagagttgatagattccagagtctttgagtgagcacactcggttcctatccttgatcccctgccctccggaaggcctgtttctgtcttctccctcacactcaccacctgctatcaggactctctgctccctactgtcaagactagacgtgcctcagacacagattcctcccttcttcagcaggagttcccagggccgagttatttattctagaaggtgcccctggtgatagtggtggggaaagcttctacaggtcatctgcagttacttctggtcctgtgtgtcactccgaagaccacttgtcatgtggggcggcggcttcacagaagcatctaggttagccagagacacttaaagcctgtttctctttgagaatgatggtaagcagaagacctttctctttatcttgtatttattagtaactattaaatatatatttttatacacacagacatataccaaagatgaacattgatccttatcttacggattctctagactcaaatgcttactgaagtcaggcagataaaacaaaaaaaattcaacaacagcaaaccagcaaacagaaactcactgaggtagtgaagtgtaagcaggaagctgtgtggccaggtgtgaggaactgtgtagaactctgggaggaatgagagtagccccttcagcttcactgcttgctggtatgtgggagggagggccagggttccaaaacttccagttcttaaatagaagcctgcagtcctcattggaattgcttgtatgttgactcaaaaggttaaatattgtgcagatcaaacaaataatttctgtgaggaggatttagtcaatgggtaaggagtttgtgaccttttgtctaaacacatgaaaaggaaggggaccatttgcctgactgctctctactttgctacgttctttctacacctgagttagtgctggtggaagagtgtttcttctccttcatccagctgctttcagtcatgtacccccccgtgaccccctcactctggttcaaacgcaaacacaaactgagaataggaaaataatccactgctgaggcatgaacatagcaccaaaggatgcagtactctagttgcaaagaactctggctgaaatttcccccacctcacctgctttctccttttatcttactcaaggctcatctctcttccagttcctctctggggaaacaggagggagattcttcttgtcacataaatgtgtcctgaaaggattctctcctccttatatctactcctttaatctgagttcaagtcatcaacacctctcacctggcccacttgccaacttccataccgtctgtctccatcctctaaaacaaactttccatgtggacaaagctgtcctttctcatgcctcagacgccactgagggcacaccaaggccattggcggcgtggccgtggacttacacaaactttccatgtggacaaagctgtcctttctcatgcctcagatgccactgtgggcccaccaaggccgtttgcggcgtggccgtggactttccttatggtcaccaacctgcagccttaagctttcactcaccctctttgtctgtccccagacttaaatcttttcttcatgttgacccttgaaatacgtgtattcatgaagacctgttcaatcacactctggattttcaaagttgaaaataacaggaagttactacggcaatgatgatttagtgaaaaatatgaaggaatcagtgactcaacaatttttgggccccattttttttttccttcaccagaggataatgttaatatgaagaggttggttgtcaatattacaactttagaaagaggaatacatgtatgtatgtattcttttatatttatgggagttaccttctgaaacctttgaacatcaccaatattgcggataaccatatgttttgataagctcttgggtttatctcgcattgcgatcaagaattgttttcactgcatatcctccaactacattaaatgccttttcaacattctttacaattttctacgtggcaaaagataccataaacaaaactaaagacaaataacagactggagaaaatattgtttgctttgagtataacgtggtaagttacgaaggaaatgacaggacactaaatatgggaaaatgagtaaatataccaagagcaaattcagaaagacctgtgcaatgagacacaaaattatttttaaaattataaaaataagcttaatctcactaataatctgaggactacatgttaaaatggcaatggaatttctttgatgaccaaatatcgttgtttgatcatgtcaagggcaagtgggcagggagaaatgtgtactcctcaactgcagataaaaagagaattgataaaacctcttaaaaaaatggattagatttagaagaatgaactatgtatacactctatgactcagttccatctgtgaacatgagtgtcagagaaaagtgtggcacatcttccagtggccaggtacacagtgttgtgcatgaccctgtgtgggaggaccacaaatacattttagttaagcacgttatggaagactatgtagtatttagaaagatgggaaggatctatatgtactgacatgaagtcataaaaattataaaaatcaaggtgcaaaatctgatgatttgatgccatgtgtgcaaaacattcttttatatgcatttcacaaaaaacaatattatgtatttctcattatccctaaaacaattctagaggattcatgacatgctgttacttgtctcaggtggacaaggattagaaatggtgaataaaaaaggttattttggcggggcacagtgacttatgcctgtaatcccagcactttgggaggccgaggtgggtggatcactggaggtcaggagttcgagaccagcctgaccaacatggtgaaaccccgtctctactaaaaatacaaaaaactagccaggcatggtggtgcgtgcctgtaatctagcgactcgggaggctgaggcaagagaattgcttgaacccgggaggcggaggttgcagtgttgcagtgagccgagattgcatcattgcattccagcgtgggcaacaagagtgaaactctgtctcaaaaaaaaaaaagaggttacttttgccaggcacagtggctcacacccgtaatcccagcactttcggaggacgaggtgggtagatcacttgaggtcaggagtttgagaccagcctggccaacatggtgaaaccccatctctactaaaagtacaaaaattagccaggtgtggtggcgtgcgcctgtaattccagttacttgggaggctgaggcaggagaattgcttgagccctagaggcggaggttgcagtgagccgagatcaagacactgcactccaggcccagagacagagagagaccccgtctcaaaaaaaaaaaaaagttatttttcacatggtagttcattaaaattttttaagtattaagctttatttatcaactgattaatattttttcctaatgaaacaaaattttactttttttaaaaagtctctttgtactattcaaatactgaatatacaaacattagctagtgaaggaatgaatactgagctgatagccaggcttacttgctagctgggtgactatctcacggaagtctagcaggatttgagatttcaatgagaaatattctgcaaaactttagagttgctgacaaaaggtaaaaaaaaaatgtgcttattaataaaataaggccaagtaatgaaaaatgtatttattaaatgaaggccagggaacactgtgtgaggcttcgtgggtgtgagtacttgctactggactgtcatttctcagttatacagagtgaaccagaggtagatagggaatagttattgtcagcaggatctatagaaatagcaacagtggtgaggagtagaaggatgttggatcaaataagatagtgcagataacaccatagaatgctagagccaaaaggatttaacacatacttttcttgataagaaataggagacaaataaaagttcaatgatttgctggaggtcacactgatatttagtggaagaacaaagacctagggcccttcaagagtagaaaatgttatacaaatgtcaaccgctaagcattgggggtatttattgatctttataatttagaggtaatgggctctgagcatcagaccatctgataactttagttcatcagattctcaaagtgttcatcactagaagaagctaaataactgcgttactctgaaaataaaaaatgaatattgagtctgttatacattctttgattttaggatgtaaaattccttttctacttctcacaggcagcactgagatctatgttgcaaagtaaattgggatagtattaaaaccatttgcctcaagggtttttttaataagtttcttgtgataatgtatgtgaatgccccaagtatatgtgacccatgggctggtctgtaggtgggacccactacatcggtgaatcatgctaagctcttaatgactcattgtaggtctctaaaataatggtatttacaaattcaagacacatctttcatgaatagcaaacgcttaccatacaatagcaaaatgaagataacaccaactgaactctctattttctgtttctgtttaacaccaactcaattgttcatttccccacgtggttgagagaggaacattaaataagtagcaatgttgggctggctggtggttctaaggatcacctagaaaatggaatgccagagattgtttagaaacagatctgagatactagataagatgaaaataacaatataagcacagtagtcttcgtaaccaagtcttatgtgattcagaaatcaataatctaaattacagagatcagtacctattacaggaaacagtcgatatcctctggggcagggttttacctctggtgtagcctcatataagtgaaaaagaaaggctaaacgtctttgacccccaattcccattcccttcacagaaaactagctaaatatctaaattgctaccattaaatcacattaaatattgctcttctgcactttctggtctggtgttgtaaaaagcagttggttgtgcatataagaatgagggaaatggaggctatcattgggacacaacgtatatcataacagtacgtgaagtgggtggagcgctaacctcagtgtttctgcaagggagtctggactgcccagagtgcatccgtgtcatcctgcatttggacatcatcaccaatttctttccaaggacccttgtgcccaaacaaaacttgcacacatcagatacatgctgccaatcctgaaaagtgaacatttaaaaccttaaaactgaatttgaatgtacctgatcaatgtaatcacgtttattctgttctcagctctgtgatgtgttctgtctaccaaaaggaagctctattgcagccattcaatggtaatcctgcttgtactcacagagtactactattctaagagcttggtaatatactgcacatttttctcttctcttttctcttctcttctcttcttctcttctctttctttttcttttgacggagtcttgctctgtcgcccaggctggagtgcagtggcaccatcttggctcattgcaacctccacctgccaggttcaagcaattctcctgcctcagccacctgagtagctgggattataggcacatgccaccatgcccagctaacttttgtatttttttttttttagtagagatggggtttcaccacattggccaggctggtcttgaactcccaaccttgtgatctgcccaccttggcctcccaaagtgctgggattacaagcgtgagccactgtgcctagcctgtactgcagattttctaaaatagtatagcctatgttaaaacttgtcctaatagacattataagattacttagacattgttttactttaaagactgtgtatggctttctcacaaccccagggccattactagtaagataagattttcatggaagacattaaaaatcatgttacactttaatagtgatattgtttcaatctttcatcacattaggtcatttccatttagaaaatttgatattcatatggaacctttttgtatcaaaaattatccacatgtgcttcaattttagaacttaactactttcatgcaagtagtttctcttaagtcagctaaggtaatcatgcatcttccttgattctttaagactcccctgccctgaaatatctcccctaaaagtctgacacaattatagaacaaaggatactatgtcttattaagaagtttaatctcatcgttattaataagtaaatatgtgatatggtttggctctgtgtcccctcccaaatctcatcttgtagctcccataattccacgtgttgtgggcaggacccggtgggagatgattgaatcatggggtgggtctttcctatgctgttcttgtgatagtgaatgggtttctgatggttttaaaatggggagttcccctgcacaagctctctctttgcctgttgccatccatgtaagatgtgacttgctcctccttgccttccactgtgattgtgaggcctccccagccatgtggaactgtaaggccaataagcttctttcttttgaaaattgcccagtctcggttatgtctttatcagcaatgtgaaaacagactaatacaatacgcatttttcttgagtatagaattaacctgttatatttttcctaacatagaggaggtagtctggagagatttgaaagaaacacagaggtacaattaatttattagccaagttcttcaggatctcctaagagagaaacagagagagaggtagtgcagtaaagcttccatctgatgcatagctagtgtgaggacacgtgcctagaggcagaaccagggaactgggaaataggaacatctgtattaattttgctgatgatctaccctgaacacatgctttatgttatgggttggctgtgtccccacccaaatctcttcttgaatgaattcccacgcattgtgggagggacctggtgggaggtgattggatcatgggggcaggtcttacctgtgctgttctcatgatagtgaatgagtctctcgagatctgatggttttaaaagggggagtttccccgcacaagctctctctttgcctgccaccatccatgtaagatgtgacttgctcttccttgccttctgccatgattgtgaggcctccccagccatgtggaactgtgagtccattaaacctctttttcttcccagtctcgggtatgtctttatcagcagtgtgaaaatggactaatacagtaaattggtaccagtagagtagggtgctgctgaaatacccaaaaatgtggaagcgactttggaactgggtaacaggcagaggttggaaaaatttggagggctcagaagaagacaggaaagtgtgggaaagtttggaactccctagagatttgttgaatggctttgccccaaatgctgatagcgatatagacaatgaagtccaggttgaggtggtcccagattaaatgaggaacttgtaggaactggagcaaaggtgactcttgttatgttttagcaaagacactggtgacattttgccccttccctagagatttgttgaactttgaacttgagagagatgatttagggtatctggcagaagaaatttctaagcagcaaagcattcaagaggtgacttaagtactgtcgaggcattcagttttaaaagggaagcagagcataaaagttcagaaaatttgtagcctgacaaaacaatagaaaagaaaaccctggttgggcatggtggctcacgcctgtaatccagcactttggaaggccgaggtggatggatcacgaggtcaggcattcgagaccagccctggccaacataatgaaaccccgtttctactaaaaatgcaaaaaattagccaggcgtggtggcaggtgcctgtaatcccagctactcaggaggctgaggcaggagaattgcttgaacacaggaggcagaggttacagtgagccgagatagcgccactgcactccagcccgggcaatggtgtgagactaggtctcaaaaaaaaaaaaaaaaattcccattttctgaggagaaattcaagctggctgcagaaatttcataagtaacgaggagccaaatgttaatccccaagacaatggggaatatatctccagggcatatcagaggtcttcatggcagaccctctcatcactggccaggaggcctaggaggaaaaagtggttttgtggaccagacccaggatccctgtgttgtgtgcagtctagggacttggtgccctgcttcccagatgctccagctgtgactgaaaggggccaaggtacagcttgggctattgcttcagatggtgaaagccccaagccctggcagcttccatgcggtgttgagccttcgggttcacagaagtcaagcattgaggtttgggaacttctacctagatttcaaagcatgtatggaaatacctggttgtccaggcagaagttggctgcaggggtggggctctcatgaagaacctctgctagggcaatgtgaaagggcaatgtggggtcggagcccccacacagagtccctactggggcactgcctagtggagctgtgaaaagagggccaccgtcctccagacctcagaatggtagatccactgacagcttgcactgtgcacctggaaaaaccacagacattcaacaccagcccatgaaaggagccaggagggaggctgtatcctgaagagccacagagccaggagggaggctgtatcctgaagagccacagggtgaagctgcccaaggccatgggaacctacctcttacgttaccgtgacctggatgtgagccatagactcaaaggaggtcattttggagcttaaagatctgagtgccctgctggattttggacttgcatggggcctgtagcccctttattttggctaatttctcccatttggaaaggctgtatttacccaatgcctgaacccctttgtatctaggaagtaactaacttgcttttgattttacaggctcataggtggaagggacttgccttgtcttgaatgagactttggactgtggacttttgaattaatgctgaaatgagttacaactttgggggactgctgggaaggcatgattggttttgaaatgtgaggacatgagatttgggaggggccagaggcagaatgatatggtttggctgtgtctccacctaaatctcattttgaattcccccatgttgtggcagggatctggtgggaggtgactggatcatggaggcaggtcttacctgtgctgttctcatgatagtgaatgagtctctcaagatctgatggttttaaaagggggagtttccctgcacaagctctctctttgcctgccaccatccatgtaagatgtgacctgctcctccttgccttcaccatgattgtgaggcctccccagccatgtggaactgtgagtccattaaacctctttttcttcccagttttgggtatgtctttatcagcagtgtgaaaacagagtaatacactttattacattttccttctacaaaatttacattttttataacaatagttttcatttgtatttctttttggatgacaaagacattttacagacattttatcattgaactctacaatattaagtgttagagcaagttttagctatttaacaataaggaaatggagcttcagcgacctgttgtagttaacatacataataagctgaataactgggtcatgtattctatgctatgttttcctgagttatgtaggtatcctgtataagaaaaaaaatctgtttcatgattctatgaaagtattttgataacttttgatatataagacttattagtatgggtatgcatcaaattttctttcagtatacaacaaaataaatttagtaaagtaagtataatgtaattcaaattcctataaacaacatttagtaaatatctaaaaggaagtatcagaaatactactaaagttaatacacacacctgcctacactcacacacggcacacattttcaaagatataaaagcacataattgaaaagtatgttttctggggccgggcgcagtgactcacgcctgtaatcccagcactttgggaggccgaggcaggcggatcacaaggtcaggagatcaagaccatcctggctaacacggtgaaactaaaaatacaaaaaattagccgggcgtggtggcgggcgcctgtagtcccagctacttgggaggctgaagcaggagaatggcatgaacctgggaggcggagcttgcagtgagctgagatcgagccatcgcactccaggctgggtgacagagtgagactccgtctcaaaaaaaaagtttgttttccacttgtgtgtggtagccaggtgaacagtccagccaaacagtgacacccctagagaagatattgagcatgatttctttctgttttccttttctttttttaacacaaatgatttcatcctacaggttggtttcagcctttcttttatcacttatctattcacacaaagataagcacatgtgcatgcacacacacttttttcttctctctctttattccacagcagcacagaaagagttaccatcgtctttttaatggccataaaaatatatcataattgatttgaccggttgaacatttaaagtatttgcaagtgaatcttgctgtgcagacatcatttagagtgtgtgtagtatgtccataggataaattcctagaagcaaaattattaggcaaaagaaatcatgcatttttaattttaagaaatattcctaaattgcttcagtggatagtatataaatctatatttccactagtaatgcatgactgcatgttttcctcacagtgccacccacacactgtgtcatcaacatttgtgaactgtattaacctgagagataaaatatgttatgtaattaagttttaatttgtaacttttcctttataagtgagattgaggtttcccccactttcatatggtcttcccgtttgttcaccagactattagtcttttcccagatgattcatgaaaactggacatgttaagaatatgaaccccttagctattaaaatggttgtaattttttccaagttttttttgtattgtttatggaattattttatatatagattttaatttttatgcaattaaacatgtttattttatatattggagcattttgtcatattacaaaatccttctccaattccaaactttaaaattcttttttcccaatttattttagccttatatcctgtatttaacatctgtaatttattttagggtaaagtgtgaggtatgtatctcactttatttcttttccagatggtaatttatttattacaatctatcttataaaataaatcacctcctctactgatttgaaatgccacttttattgtataataaatttctgcacattagcaatattttactgtttatcaaaactacatcataattcctatttgtatattgctctattgttctttctagttattgtcagtctaatattttgaactgttctctaaacatacccattacagaaatatagtcctgtttatttacatatgcatgtttgcacttatttatgatgtatgtactacataagagttggggatcaatatataccaaaataaattacattgttcctgtccacatcacaaagtttaagataaattaaaaagttaaagtatatatgaaactatatatgccttttgagtaaaaacaaggaaattctttttcaaaaagcaaataaacaagtttattattttagattcatttattgtagttaataccttatttcactccaagttttctaataacgaatgtaaagacgaaacatgttgacatctactgtgataaagaaagttcatttcctagcagttaattctaagtaggatgctgggcctatgcaagtggtgatgaatagcataaataagttagcttttccaaaaaattaaatgtttagaagtatcttcaggccaggcatggtggctcacacctgtaatcccagcactttgggaggtcgaggaggatggatcacgaggtgaggagatcaaggccatcctgactaacacagtgaaagcccatctctattaaaaacacaaaaaattagccaggcgtggtggcgggcgcctgtagtcccagctactcaggaggctgaggcaggagaatggcgtgaacccgggaggcagagcttgcagtgagctgagatcgtgccactgcattccagcctgggcgagagagtgagactctgtctcaaaaacaaacaaacagacaaacaaacaaacaaacgtatcttcaaatggacatttcaaatgtttcttctttttataagttgagaaagtaacacagaagcatcagtaaaatgtcttcaggcaacaacgtagcatcatgttggtatgtcacttactggaaagaagattatatatcttttagactcttcccaaaattaaaaaaaatgcacctgtcaaatatgaaatactggtaaagttcaaagaatccgtaatgtttgtggatgattaaaaatgtgaaaactgtgacagattctttctcagtcagagtaatttgatttctgcagagcgggctatagaccggtcttcgggtactttctcaaagattaactgaattttcttaaacaaatatttaatttgattaccagaatatgaaagaaaaaaattttgtctaacaactctttctgaagtttgccaatagctttcttttactgccaatacgacttttctgaagcatttcattatcagttgatctttgtcttcttaagtcagttaatgatacgacacgaacaaaatatattatcatgcaggtaaataaaaactgtcctgttggaaaacttagtgtttcctatttaaatttcagaaaaattcagctttttttgtggttgatattcaatgcacaggcattagaaaaagggtctattgtgtctgaggttttttctggttttaagtgataaagccatctttggcatgaaggatacttggttctcattttcagtagaaagtggcatgcatcccagttacccaatagttatcctaaagcactgaactaaacttaagacataaaaaatgtaagtacattcttttgaacgtgattgagaattggaattttatttgtcaaaatattttacatatgcttattctggctgccatattatgatgcttactgtgtaaaagcttttgtggtattgtatcttactgagatagtatagttttttgatagatgatttctattcgtggactcaaagcctcataattatattatatatgttaggaaggattttccttattttcctggtgacatgaaaaatctatgtaagtgatttataaggagatatctgcacagagatctgtatgttcctttataaattattaatatagagatttaatttaaacattattatgacagttagccaatagtgatattttgagggaatattctatagactcatgagtttgttattctgtgacaataggttttcaccttttaaaataaaaaactatactcacattcccctctgagagaactctataggccgggtgcggtggctcatgcctgtaatcccagcactttggcagcccgaggtgggcggatcataaggtcaagagatcgagaccatgctggccaacatggtgaaacactgcttctactaaaaatacaaaaatgagctgggcatggtggcaggcgcctgtagtcccagctactcgggaggcggaggcaggagaatcacttgaacctgggaggtggacggtgcagtcagccaagattgtgccactgcacttcagcctggctacagggtgagactttgaaaaaaaacaaacaaaaaaaaaaccaaaagaaagaaagaaagtgagagagagagagagaaagaaagaaaggaaagggaaagaaaagaaaggaaagaaaagagaaagaaagaactctatctgtgcagttaaatgagagaaagaacacatagtttagaggacttttatagagaaagaacacatagtttagaggacttttatagagaaagaacacatagtttagaggacttttatagagaaagaacacatagtttagaggacttttatagagaaagaacacataggttagaggacttttatagagaaagaacacatagtttagaggacttttataggacagacccccaaatattcttgcagtgctaggcctcttgggagatattggtaaaatgaaataattatttaaaatctatgaaataaatgtaaatctttaggataagttgaagcatgtaaataagtcttgacatagagtaaaagagaggagtgagatttgtatgtgaatataagattcagatttttaaaattttaatttagtcatctaaatggtctcctgtactgattatactcagctacttaaaatgagtaattctacccgcaaaggtagctagtctctataattgacttaaatgatgtacttttaatcaatatttcaatttcatttgatgcccttgaaatgatgtggaaaataaaaggaaaactagaacattaagtccacatggagcaatataggaaaaaccaaataaaagatttcgaatgcccttttatgtaattaattgctttcaaagaagcaaattccaaatgtcagagatatataaatggatattcaagataatgtttatttttgttcctatttttatgtattacaaatagaggtaatatttaaaacaacaaaaggggtaaaatttaaaaatttagaaaaatatagactactgaagagtaactgccaatggcatgtcttattaatgagaattcttccctagggcttttaatttgaggtggagagagcagaagcagcgggcacggggcagcttctctctaaggtcacatgctgtggtgcaacactgatttaaagttgtctgcctcagatccacatcaagatggttagctactagtacagaggaactttactaggtaggattttctttctttctttctttctttttttttttttagaaaaagtttccttcttgttgcccaggctagagtgcaatggtgcaatctcggctcactgcaacctcagcctcccaggttcaagcaattctcctgcctcaccctccctagtagctgggattaccagtgtgcaccaccatgcccatgtaatttttgtatttttagtagacagggtttcggcatgttggccaggctggtctcaaactcctgaccttgtgacccacccgccttggcctcccaaagtgctgggattagaggtgtaagccacggcaccaggcctactaggtaggattttcttagccatgatatgaagcatctttcccctgcttcctggtcacatgcttctgtaagcacaaggcctctgacctttctccaaaggtgcagctagtagcccccgcttgctgccaagcgagtccacaggctctatttgacgtccagttagatctgatctttgaaataaaataagtaagctattggaaatcagtaaaaatatcaactagagtctgggcgcagtggctcatgcctgtaatcccagcactttgggaggccgaggcaggcggatcacgaggtcaggagatcgagaccatcctggctaacatggtgaaacctgtctctactaaaaatacaaaaaaaatagccaggcatggtggtgggcgcctgtagtcccagctactcgggaggctgaggcaggagaatggcgtgaacccgggaggtggagcttgcagtgagccaagattgcaccactgcactccggcctgggagacagagtgagactccgtcagaaaaaaaaaaaaaaaaaagaaaagaaagaaaacataaaagtagtaaatatccctaaaactttaattatactttgaatatgaatatttgggcatagttttttaaaaactgcaaatctgtccaagtaaaagattgtttttctgggtgatttagggataattaccttttttaaaatcatggtctgttttatgtgtttccaagagcatgcactttggtaattaaatgtggtagtagggatgtttgaatggaaaccagaaagatattttcataattaataattagtttataaaaatcactagcattcctgtacaccaccgacaaccaaactgagagccacatcagaaagataatttgccaccacacagaaaaaataaaataaaataaaataaaataaaataaaataaaataaaaaagacctgggaatgcagctaaccaaggaggggaaagatgtctacaatgagaattatgaaacactgctcaaagaagttagagaagacacaaacaaatggagaaacattccatgctcgtggataggaagattcaatataaataaaatagctatgctggacaaagcaatttacagattcaatgctattcctatcaaactatcagcgacatacttcacagaactagaaaaaattatttaaagatttatatggaaccaaaaaagagcccaaagagccaaggcaattctaagcaaaaagaataaagctggagaaatcatgttacctgacttcaaactatactacaaggctgcagtggccaaagcagaatggtactggtacaaaaacaggcacatagaccaatggaaccgaatagaaaccccagaaatacagccacacacctatgaccatctgacctttgacaaagctgacaaaaataagcaatagggaaaagactcccttttcaataaatggtgctgggataacttactagccatatgcagaaaattgaagctggactctttctttacaaaaatcagctcaagatggattaaagatctaaaactataaaaaccctgggaaacaacctaggtaataccatcctggacataggaacgggcaaagatttcataacaaagacaccaaaagcaatcacaacaaaagtaaaaattgactaacgggatctaattaaacgtaagagtttctgcacagcaaaataaatgatcaacagtgtaaacagacaacttacagaatgggagaaaatatttgtaaattatgcatctgacaaaggtctgatatccaccatctataagtaacttaaacacatttacaggagaaaaatcaaacaacctgattcaacagagggcaaaggacaggaacagacatacatgcagccaacaagcatgtgaaaaaaagctcagtatcactgaccattaaagaaatgcaaaacaaaaccccaatgagtaccatctcgcaccagtctgaatggctgttattagaaagtcaaaaaataacagctggtgaggttgtgaaggaaagggaacacttaaacactgttggtggaagtgtaaattagttcggccattgtagaagacagtgtggcgattcctcaaagacccgaagtcagaaataccattagacccagcaatcccattactgggtgtgtacccagaggagtgtaaagcattctacctaaaattcacatgcacgtgaatgctcattgcagcactattcacaatagcaaagacaaggaatcaacctcaatgcccaccagtgacagactggatcgagaaaatgtggtacatatagactatggaatactatgcagccagaaaaagaatgaggccatttcttttgtgagaacgttatggagctggaggctatcatccttagcaaactaatacatgaatagaaaatgaagtccaggtgcggtggctcacgcttgtaatcccagaactttgggaggacgaggcgggcagatcacttgaggtcaggagtttgagaccagcctggccaacatggtgaaaccccatctctactaaaaataaaaaaaaaaaaaaattagccaggcgtggtggtgcatgcctgtagtcccagctactcgggaggctgaggcaggagaattgcttgaatccaggaggcagaggttgtagtgagctgagattgcaccactgcactccagcaggggtgacagagcgagattccgtctcagaaaaaaaaaaattagaaaaccaaataccacatgttctcacttataagtgggagctacgtgataagaacttatgaacacgaaggaaacaacagatactggggactgcttgaggggggagggtgagaggagggagaggagcagaaaagatcactgttgggtattgagcttaatacctgggtgatgtaataatatgtacaacaaacccccatgtcacatgtttatctatgtaacaaaccttcatatgtacccccaaacctaaaataaaaactatgaaaagaaaaaataaaaaaataaaatctggggaatttgagttggcaaagcctctgaagttttagctattgtgctctagtctgtttcactacaccccacaaataaaaatttaatttgcaatactggaaaaagtcttttatgtaaaggatagatatgttagattttttaaatatgctaaattaagttctcctcttattccagttcaccttgctattgtaaatctatgtttaaataaaagtcatcttcaaacaatattaaccaagttgcctgaagtccaccccttaataatctgagctaattaatcattcttcttggtcacttcctgaaatctctatttcaagacatgtacattctagatgaaatgtattaaaaagacacacggaagtgaaatgctttgaaagcaggtacattttgcttccccagcctgtaagatgtcagagattatgtgttatttctatgtatactttgtcctgatgaaaataaaattttatttgtacctagtattttataatttgaataaaggattataatcaatattcttctcttctttgcttctcttagctgatggccctttttttcagcagttaattaaagtttgaatagctgtcacttgtgactaacttctgtggcgtttcctttgcctgcacctcagacatcatctccttccattcatttcttctcaaattgcgtacacaagtgctctacaaaatcatctacagtcaaatcccagagaagtagtaataagagccattgtagacaggaggaagtgtgttaggaaacaagaaggtagatctggagccagtatagactgcagccaggaccgcatgttccttagggcaatggaaagaagaggagataaatgctgtaagaagatgatatagaaaatttaaaaactgttatacactgttcaaatctcatcaaaggcatcaaagaggatcccattaaaaacactcttgagagcagctgagcgctgacgctttgctgcttagaatgcagggccaagggagatatgaggtcgggagggtttaggtgtgcacctgagcattcagagtaaagagaaatgagcactgggaaaagctaaaaggaggcagcctgagggggccagcaggaggccggccggccggccgggatggcaggccaccttcagcaggtcagccttcaccctggcaggcagatctaacgcggatttgggaaaaagagacactctcagtccctccagattctgggatggtttggtctctggctctgaggttcccaggtgaaactgatgctgctgcaccttgccgtgatgcagtgttactcatggccaagagcagaacttcagatgggagagggctgactctggcttctgctattcacagccatagtgtatgggaaagtcaaagaggcttcatcattcagtaacaaaaacaaatttcagtcacgtgaggaaaactaaactgagctttatgaactttcctttcccctgtcttactttgatgtcattttgtcttgtaatgcaaatatagatatgtttaatccatatttacctttctaattaataaacagctagttttatatagataaaagctttcaaattttattcaaaggaggttttctcagagtgctgattttcattgttcatcaggcaggtacatcatttagtggaaaccaagtaaaattgtatccatgagtccaagcacagtcctccagtattttgtaggattcatctaaagacttaagtttaacattcatgtaattccctctaggatgtacagttcctcagtctcacagaattagcccagtacctgctcttctgggtgctaggatgccatagacaccctgtagttcctttatccaaatcccattacacttcaggtttgggattctaattcattaaggaactgaggccttttcatgtagtatttgtataaatgctgagctctcaatatggaagaagaaacaggaaaggaagaaagaggggtggggaggaaaaggaataggaggaggagaagaaggaataggaggaggatgagaattaggaggaataggaacggggggcggggcgaggaataggaggaggattaggaagaggaggaaatttgcatatggctttaagtcccttaagcttctggttaagtggctcatctacacaaaccccatctcatgatcccgtgacataggagctatttcctctcatcactactgattgtcctccatgttccctttgacttatctttcatggccacatgaccccatccccaccctctaaatccaatccagtggacctccacactctgctgcccagccctcttggtgatttctgagctcttttgctgtaaacacaagtggacagtcatctgaggcagcgttctttactatctgcactctccagagcacagttgagcctgagttccaccccagcacatctcaacctcagttgatttcagaacctttcaatcatttctgtgacatttctgaatttcctgacttcaccaatgccaggaggataaccctccgaatcaaatcgaagatcatttcattgtaaagttcctcctatattgacatttctggggaactatgacaaactcaaggcctcggagggccctagactccatttcattaaatacaatttttgaatgggtatcagggaccttgacctcaggaaataacttgggcaccatttatgtcaacataggggtcatcaacgttgctatgatgtttcctttgggttcatttaaccctatttaaccacatatttcaacaacagaaagatttaaactcagagcaaggtggtcaacagcacacatctattatgtaccatttacagactcctgaagacctgttgttctctctctaccatttggtctcttgccatatttcttcaggtttattagtgatttatctctttttgttaggtattttcctggtccaacattattttataattcaaatattagggcacagaaacaaaaatagaatgtgggtttgaatacacatgaaatacctacatctatgtcatacatatacacatacactaaaatagtttgcaatgggtatagaaattagaagggggataatataaagtaaacttaaacagcttcagaattttgccagaaaccagccctgaacttaacgataaccccatctcagtagaaagaagagaggctgagtaaaggcatgtttactcggaaatgagttccccagcgtgaaactcaagagtgaggagagagaacttttagaatttgccacacacctgctttctgttgcatattaaccacacggtgcactttccactggctgcttgaacaggcacgtcatgtgtgaatgaagtgggtcaaggtcagaaaaatagcgattgttggtgtatgtgataaattgatgtgtacttgccctgggtcagtcactactcacctgcagaagattcctgccttataggaagtaaaatctgtattgctgaatctcacacatttccagaaaaagccaggaagtgtggctactacaggaaatttcctaatttttaaatatgaaatgattcaaacatactgtagaaaaaaactatacaatgtacagtaaccacgcaatagaaatacatctgatgaatggatttggctcatgggccgccagcttgtgacttctgatcaatgttttgaaattatccctgggagacatggggaagaaagattcaatctgtaaggagccacatgcagttttgtgagacaatttgcagacttcaaagtgactgagtcagagtatgtacataaaacgtggcccaagggagaacagaaatctaaaatgaaacacattaaggttaatactggccgggcgcagtggctcatgcctgtaatcccagcactttggggaccgagtcaggaggattacttgaagacaggagatcgagaccaacctgggcaacatcatgagacccatttctacaaaacaaatggaaaaatagttactacccataggaatgaaaagtcactcatttgctatcacacagacatacacatgtatgatagccaactaccggattaaatcaggcagtcagaaagagaaaacaaaaagaaaaggaggcaaaaatacaacagaaaaacatgaaatttaatctttcaatttcgaactttttatcagacaaggactagaaacccaatgaagatgacaaaaaaaaaaaagacaaaattgctttcctatgtatcaagctcaggtgtaattatagttccacactaaactgcaggcttcatacaaggacttgccacaactcttagttttagtaccggctgtaatttatgttgtgtttagataaattcctgagctctctgtacctaattttttttaattagtgaaaaaacacagaaatagcttacatgcttgctttaagaaatagataaatagaatattatatttttaaacctcattatgcctaagtatttaatatctactggtgattttattcttggcgagcatagcaggggccatatgagaaatgtaaatatggttattgacctgttgtgctggtgacaagatgagtcttttctctaggagactggattagcttggctgaaaatattcgttgcataccaaattagactatacattgtatttctgtcactgaatgttttccttagttgttttgtgagtaaaataaattggatgtatgttcaatgtatataattcaggcaccttatttcaaaagtaattaatgtcttactcacttgagaccagataattacagttaatgtcatcttaaaggagcccccaggactgttagccattggtaaacgcataagaattggaataaattgactttcatgatcactgaagcttcgttgggagaactaggagcagagaaaagaatgataaatcaaaaattcgtctcctaagactgatgaagataacatatatattttttcatttactcttagacaacccttacaagatttttgcccagcgaaagtggcacgtggaacatggaatgacatttcataaagataaatccagagattagtgctgaagactacacccctgtgtagtcccacacaggctaccccagaccagcctggcgggctctgcactaggcctcccatcaggcgagagccaacgctcctcagcccggctccacctcattcagaagaaagtgtgtctcccggcctcacattgcgctgaatgcaaggataccgagataaaccaggctttccttcgctcagagtacagttgcagacttggtaatgactgagccaagccagactgactgtgataagataataaattaactaccagtcaggagctaagtcagcagatgtgcgaacattttagaggtaacatcataaactagaacagaggagctcttgggaagaaaaagggcttggaaattatacctggaaagataccgctaataatgatcaagaagaaaaaacaaatccagtttggaagtgagcaatcatttatgatgtaaaatatttcttagaaatggaatctagataatgcttggaatatgctttaaactacctatatttaatttgtttttcttgtgatttttgtattgtttggtgtaaaataatcttaatctttccaggtggtgtctaattaaggcacatttactgatatgagtcattttctaaatatactttatctaagaaaatttaaaatttttggatcaactaaaaactctctcaattattttagagttaactcttccaaattctaaaatgtattcataaattatatacaactattttaatggtcactgtgggcccaacttctgtatataaatttaccttcttattttacaggtgctaatgtttaaagatacttaaatatgccaatttctttcctctatgtagaagtttgaaatacattctatgccctgagagaaccctttgaaatttgaacacatagagtattgttatgtgctttcaaaactttgtgttgtataggaccctcttttagctgaatatttttcaagcagtaagcctgtcctgcatcgcacatgtactgggacacccatggacaaaatcataagactctgtcttcctgacagatttccctcctctcctggggaattctctaatgatgtcactctttttttgtgccctgtatggtttttttttttcagtttcttctgtgtgatgcacgtgatgctgttacactgcagggtagcgtttttaaaaaatctgatttacagtttgtcctactattatatattttgcttataaaaaccttgtgttttttcaaaaattcctaacagacttatttaggtctaactgacctaaaataaaccacacatggtacagtgtacagtttgatgggcttcgacataagcacatataatgggttgaattatgtccctcacgagatatgttaaagtcctaaaccctgtttctcatttgcgaatagggcctttatttggaaatagggtcattgcaggtataattagctaagatgaggttgtagtggagtggagtgggcccttaatccccttaatcctaaatgaggggtgtcatcataagaaagacactggcaaacagatacagacacagagggaagaacgccacatgacaaggaggcagggggtggagtgatgctgccacacgtcaagaagaacctgcggccaccagagttagaagaggcaagaaaggattctctcgtggaggcctcggactggcatcgccttgccaacaacgctgatggtgggcttccagcctccagaattgtaaggcaataaattcatgttgttttaagccaaccagtttgtggtgaaatagccccaggaaacggatccaatctacaatcatgaaaccatctgaaaataaaaatagcaaacatatccctcacctcaacaagtttcctgaaggccctcccatcacacagtcccaagtcccacctccttcctcaggaaaccactgaactcttttgtcactatagaccgtattttgtagaattaatataaattttacataaatttatataaatccccaaattatagaaaatatatttactgtatacatgcggtatatactggctgctttcagcataattatttggaggtttattcatcattcttttgaacattcatttttttgctcctttgtttagctaagtagtactcccttgatatatcacaatttgtttatccattcacctgtttatggacattttagttgtttccaacttttggctatcacgaatgcatctgctgtatgtgcacatatacatgtacaactatttgaacagagatacacttttgtttctcttggtagacacctaattgtggaacagctgagtcctgtaacaggcatatgtttaacttttaaagaaactgccaaaccactttctaaagtaaacatactatgtacaatctcactagcagaatataggagttccagttcctccacatcttcatcaacagttcgtatgattacgctttgaaattttttcctttctaataggtatgtagtagtgtctcattgtggttttttatttacatttccctaatgactaataatactaaatgtctttcataggcttatttgtcatggcatgcctctggcataccatctgttcagatcttttgtctattgtctaatttttatgggtttgatcttatcaatttttgaagattattctggatacaatgaatttgttagatatatgattcctatttttcatggtctgtggtttatcttttctttctcttaacgatattcttgaagagcaggtgttcttatttttacgaaatttcttttatcactattttcttctatggattgtgtttttctatgaagcaacctttctaacccaaagtaataaagtttctgttatacagcttattctagaagtttgatagttttaggctttaccttggttctatagtcctttctgaattaactttcacatgttatgttaggtataaagtctttttggtttgtttgcttttgcttttgtatattggtatccagttgttctagtactagttaaaaatactatttttctttattaagctgcctttgtacatttataaaagatgaattgatcatatatgtgtaggtctgtttctaaactttctcttctattttattgatgtatttgttggtcttgaggcaaatatcacattgtcttgattattgtacctttataatgattattgattgctatacgtgcaagatcctcaactttgttgttttgcaaagttgttttgactaccttgggaactttgcatttttctagtaaccctgttttgatatagattattttgaatagggaatgttttgacttaaaaataatatcaaacttttataattaagatataagtagtgtgaaaggagagaaacatcttcattctatcattcagcccctttcaggaacctcatccaacctcaccactctaggctatcagagttagcacattacatctctatacagacatgcattcgttaatgatgaggatatgttctgagaaatgcattattaggcaattttgttggtgaacatcacagagtgtacttacacagacctagctggtgtagcccatcagttaccttggcaatatggtatagacgattgttcctgggctgcaaacatgtacagcaggttactgcactgaataccgcaggcaattgtaatacaatgataagtatttgtgtatttaaacgtagaaaaggtacagtacaaatttgatataaaagattaaaaaacagaagacctgcttaagcccattctgttacaatcttatgggaccagcattgtatatgcagagtccatcgtggaccgaaatgtcactgtgtggagcacaactgtatctccatccatactgacacacacacgccttctgaaacccatgcctacaaccatattggtatctgtatattggtgctttatagtataaaatataccctcttgaggctgagcctcagtaaatactcatgcttagccactgtcagcctgcttcttcctctaatctccaaaatgaagtaagttcattgacagcactggagatgcctgcattgctggatttacactctattttattattaaagaaagggtttttttctccctaaagatatccctatttctattaatcttttctggctcattatttttctttgataggcatagagggcagtatggtggaagtattctgcctgtctgtgagtattttaaaaaatggaaaatgttggaaatcaatttcttgtgcatttactttttcttaaatactattactgtttcctttccaatcttagactgctgaattctgaataaatctctcacctttgtggttttcttgaagtagaccttaatttgaattttttttttttttttttgacagagtctcacactgttgcccaggcgggagtgcagtggcacaatctcggctcactgaaacctccacctcccaggttcaagcgattctcctgcctcagcctcttgagtaactgggattacaggtgcccgccaccatgcccggctaattttttgtatttttagtagagatggggtttcactatgttggccaggctggtctcgaacacctgacctcatgatccatctgcctcagctcccaaagtgctgggattacaggtgtgagccactgcacccagccgaaatattttcttttctttttctttctttccttctttttaaaaaaattctgtagctgatccctgatggcttttaatttgaataaaactttatttaaagaaagtgtttattcattgatacgaatcacacagagtataatttcaagcccattaccatgaagatattttcctatgttttactccagaatttttaattattttatctttcaaatttagatctatattccagctagaattgtgtgtgtgtgtgtgtgtgtgtgtgatgtgaaggtcaaagtttatttttctttttttacatataaatatgtaattgatccagcaccacttaatgaaaagactactcttttcagccactctcaggtggtacctacgtcgtgacccaagtgactgagtatcgagtcggtctggttttcaactttctattcagttcggttgctctgtagttccccccttgatggtttacattgtctgtgaatattgacagttatagttcttactttaccattcttttaaggaatcatttgaaaaattcacatattggtgaagccatacaggcttagagttttctttgtggcaagtttcctaatgacagatttaatttctttaatagatacaatatattccaaatagatttttttcaatgagttttggtaagctatatttttctaggaatttgacaatttcttctaaattttgaaatatattggtatataggtcaaaaaattgtatgtctttatctttttaatatatgtaatgtctgttgggatgtacctttttaaaaatttcttatattattcatttctcttttctggcctgatcctagcaattgttatagggagtttataaaaattattcgtctttttagggaaataaatttttgctttttaatttttctactatatgtttgttacttcatcaaatttaaattaaatttttttggattaacctacatttccttcttcccatttttattaggattagtttgttcttatttttccaactactttagaacattctttagcttttcctctttgctaatatgtagatatacatttgtttctttcttcctttcttttttttgagacggagtctggctctgtcacccaggctggagtgcagtggtgggatctcagctcactgcaagctccgcctcccaggttcacgccattctcctgcctcagcctcctgagtagcttggactacaggcgcccaccaccacgcctggataatattttttgtatttttagtagagacaggggtttcaccctgttagccaggatggtcttgatcccctgaccttgtgatccacccaccttggcctcccgaagtgctgggattacaggcgtgagccaccgtgcccgggcccccatatagatatacatttctctaagcagttttacctgcctctctaaaattttgagatgtatttttattaaattcagtttaaaagattttctgatttttcattgagttgtctttctttactagtgcgttatttttaaatacattgcttaattttcaaacatattgacatattccaatcactttttcattattgctttccagtgtaactacaccatggtcaggagaacagattccaaattattgtagtatttcaaacttgttgagacttgctttatagctaagtttaaaatacattttggaaaatgctccgtgtaaatttcaatagaatctgagtgtgcttctatgctgtactatagtacttcccaggcatccttcaggtcaggtttctcctcaacctaatggatcttctgtatacttactggtctatatgattgcagaattttttctatttggtctactaattatgaaaaatgtgttttaaaatctattattatacatacattcatttctccttttacttttgtcattctgttttgtatatacagtcatgctccaaataacatttctttcaacaacagactgcatattcaacggtggcctcctaaggttacagtggagctgaacaactcctatagcctattgctgtctgagccttcataatgtcagagtgcggtgcattttaccttttctatgtttagctatgatcagatacacaaatacttactgttgcattacagttgcctagagcaggggtgtacaatcttttggcttccctgggacacattggaagaagaattgtcttgggccacacataagatacgccagcactaacaacagctgatgagctaaaaaaaaaattgcaaaaaattctaataacattataagaaagtttatgaatttgtgttgggctgcattcaaagtcatcttaggctgggtcacgggttggacaagcttggcctagggtagtcagtggagtagcatgctttctaggtgttgcctaggaatagtaggctgtaccatttagcccaggtgtgtagtaggttatgccatctaggtttgtgtcagtgcactctgtgatgtttgcacaacaatacatgtgcctgatgatgcatctcacaggatatgttcccactgttaagccaaacaccactgtatttgaaagttttgttgttaggtgtatacaagtttagaatttttctttctgaagaattgactctttcagtaggaaatgtctctttctagctctgatgattcttcttgccttaaaatctgtcttgtttggtcttgtcataatgcacaaaaattcttttggatagtacttaaacaaaatttttctcatctttaatttttagcactttaatggttttctatgtttatgtctgggattattttgcttctacttaaaggactccctcctttagtatttattttaatgcagatctagtggtggtgaatactctttattttaatttttttaggagtatctttatttaacctttgaaagggtttcactgaacacagaattttctatgggtaattatgttgtttaaagaagtcattgccatttcttccatttctgtggagaattcaactatcagtcttactgtaagtcttttggattgcagctgagaaaacctgttgttatttatatgatcactcacttgactaccaagatataacaaaactactgaaaggaaggaaaagtttgaagtgagaagaaaataaaagatgaataaaattacattacaataagcttagctacaattatggagagaaaaactagaatacagctgataaaacaagtaagtggcaccctattttgggtaaagttagtagtccaactgaaatctgattattagctgacaaaacaggtaatactccactgtcacttaatttgccataatattttagaaaatgccctttagtagaaagttatcatttcatgtttgcattagttgccacagatatataaacatgatattaggtaagactgcctaaaatcttctcccctgtatttttatggtaattatataatatagagcatgtgatgctctctgaccatatattgtgaatggtttttgctcttatagcagaatttaaagccagcacaaggacatatttggtgtaagaaatgtaataagacttgtggtcaaagttatgaatatttaaatgacattatatatacaaagaaaattatgctgttatttggtttcagtaaaatccagcataaaaattaattttgactcacacccaaatcctaaaatgtaaggggaactatttttaataatatgtatatttgggaaaataattgatttattaattggccaaatatttattgtgacaagccattttctttcattatagtttatttggtaagatgttttcttaaagagcctatgatgaatatttataatataactcaataaaaatgaacattagtttgtcttgcagggaagctatgacacgtatggatattacacaaaaatacaagccttaaggaaataggggatttggtccaccttgttctctgtggtatctctagcattcagattaaggcttatctcatagttaatgttcagacatacatgttaagtaaatgaattattatttttttaaatttgattttgtaacatctgaagtatgaagattataataatcagcattaaaatctggtttggagagacctgtattagaggtgtgtaaacattggtctcctttatttgctattaacatgtatatagtcagtgttgaatttaaaatgatgtaaatcttgagtgttcgctgaggttgactaccagtattttcaggagatcaccatgtggtatgatctgagatgtcttcagacctactttgctctaaaaagttatttacactttgcaatgtttgttaaactaccaagatctgtatattttcactatgtttgtgaagatgacagtttgaaaataagaagatgaaaaacaatatattacatatgtatgtttgggagacaaagataaccccaagtttagaaatgtgaggcaggcctatatttctctccaatagtattttatgattgtctccaattcctgcttggtttgaagtcccttaacgcagaataatttggtcagcagaatgatttagttagacagtaatgacactcttactccagacatatttaataaatgccatgtcttctactgtcttggcacaatatgagaatgtctgagtggtataaggtgcataaagtagtctgtttttatggggatcacaattttgttttctgcaaggaaaaatgaaagatatccacacttggttaaaaatgtattagaaatctgactctgaaaccacacagcaggattatgtgcttcggatccatatcttgacctactttcctaaaaatgtccaagttggtaaaactagatagttctgttatcttgtgaggctttcctgacgcactagttttgggttaagataatgatattactgttggaaaagagaagagtgattttttttttcctcttagaaattgtttttcattttatgtgttagctttctctctctattgggtgaaatgtccttgaggacagtgataaaggtttactctgtttataaaaccagtagtcaggcagctatgactgtgcgaaactctggacaggttattcaccagcttcagaagtggacttgtcctcccacctgatgattgatattggttaatctgtatccatctgtctgttggtctctctatccattcatccattccaggcattctataccataatatagatagataccatataccatgtaccataataccataccaaaatatagatagaaatgtaccataatataccataatatagatagaaatgtacttcaacatttctggatttattgttaaatttggtatgttattccttgaatactctgaacaaaataatagtaggttttatataaatagtagagactcattattatagctcattagataaataaaccttttaggttctattataaaataaatgtttcagtttctattcacaatgattaattcattcaaataaattataaagaaaaagatgagtttcttttacaaacacagttagaatcaaaattcaagtgctaagctgataacattctcattaatagcaataaagcctacagcacttattcaacccgaaaaataattgacttatcccagaaaggcttttatttgtagagtttaaatgtctcttctcataaccagcaacttgtacctcatataattactcagataaagaggctttcgattttcttgtataaaagaaaacactacagactatttaaaacaaacaagtggccgggcacagtggctcactcctgtaatcccagtcctttaggaggctgaggcaggttgatcacaaggtcaggagtttgagaccagcctggccaatatggtgaaaccccatctctactaaaaatacaaaaattagccaggcatggtggcacacacctgtagtcccagctacttgggaggctgaggcaggagaattgcttgaacccaggagtcagaggtcacagtgagctgaaatcacaccactgactccagcctgggcgacagagcaagactctgtctcaaaaaacaaaacaaaacaaagcaaacaagtaccaccaatataatactttatagtgaggatttcaaggcagcctatgttcctaatgatatagagttccagggagggaaataaatccaaggtctttacatataaccatggaatgaggatgtgcaagagaacacctgaaagaaaatcagatttcctataactgaaaacaacaacgacaagaacaacaatacccagcttctcaaatggttaattcacgtatggtaaagagcagagaatggaaaggtgctgatcacaaaacagttactaacactcccctcaccctccaaaaaaggtggtaatttatatttatcaggcagttatggaagtttcttaaaaagcaaggttatttttccttgcattatttacactgcaatatattttttaaatttatggaatgatgaatctgtttacaaaaaatgttttttatcacacgtaggatatttatagtgaaatgaaaatgaataaatcttgatagaattgagacactaaagatattttaaaaatcaataaatttctaagagataattatgtggtttgtatgataacataacctttaattattctcattttttctttttttttcagaccactcaatctctggctactccttaaacatgtgtctgtatctacagttttgctgatatagtactgtcagcctgcattttccaccatgtagtttattctaatacatacaagtgcccagtggctttcattacttctgttccatgtactctcaaattcaacatgtttaaaattgagctcactctgcctctggctatgcttccccagaggtggatggcaacagattccatccattcatccaaacttggaacctgagatttacctttgatctcaaattatacctgtttccccttatccaaacactaacccagtgtacacagatttttacctccttagtttttcttaacttttctttctttccatcattactgctgctttgctaatacaggccctcactaaatctagcattctgcctctagtcttattttctccaaatccattttccaaagaagtcttatgtatcaattcagtctcatgatatgactctgaagtgttttttttcaatggctctagattttcttcaaaattaacttccaatcttccttacctcgtgtgtgagagaagaaactggcacacccctttccttatctgcaagcaaaggtggggacgggaagaagttttaactttaaatcaaacaggaaattttgattatgttatatcatttgaataattaactgaaagaactgactgggaaaatcaggaggtctatctgagtttcagttatccccagaggaagaactaggcccaccaggtaaatgtgaggactcatgagcagtgaagaggctgtgtgatactttcatcccaagtgtggctggttcaatatgccagttacgtttgtgattttctatactcaatactgtttctgtacttcaggttcacagggtcctgtttgtgttgtttattctaatgctctctccttaatttcgaatgtgtcatctcattctcctgccttaattggataatcactcttcatcctttaacacagaaatagtcacctcactagttcagatcttggtttgtattctgcgtctttgtttgtctcatgtcttttgactgatgcttgccatcttacttacaatactgggttttagtcatgtttttcagtctgactgtcccatggtccatgaatgccttaaactcagggaatgtgtctcattcatctttgttattttcagagctgagaactgggtctgaaatgttagataatctgtaaacaaaatgaatgaaatgatgttgcagaggagagacatgtgggatagtcatcaacagtaacagagaggtggtcatgattattttccagatggctggggagctccaccttggaaggtccatctctaatggcaaaagactttttaacagggcttcctgaggacataaagagcccaattgttgttgaaatcgcatggaaagttcagcaagtgtagtatcgttgggatgctttgaattgcactctttgtctgttagaagctgaactgggcatccaggagttacaaagaacaaaaatatggcacctgtgctttggaacaactttgtagccacctgtcacttttggggaataatcgtcttctgagaagatatgttttattcctgagatacagagaacacagggaattctctcaattgcttaataataaaactaaaacaaaagtcttcttactctcaaccagactcatttggtctaagggaaagaaaatgactctcccgtgcttcatatgtgataaaatagcactgagttaactgttgtattgattcaatacacaaatagaaaatagaatgatttggctacagacaattcaagtatgaagattgcagttcctcttataaaggaagatgtcttgatactggttttaagtatttcttttaagaaaactctataaaaaccctgttttttggccaatattaaaaaaaggaaaaatactataaaattagtagcatatgtttcttttttcttttgaaaagctaccccagactagaagatgacttttagtaacactgtggctgtatatttatgtgtgtgtgtgtatgcacacatttttctatcaagaactatctctttacttttctattttcttatgctaccctttatttagttacttattttgaactttataagactacctgaagttttaagaatttcttttgttgaaaaaactcgggtttatcaccctagttattccaataaaaatgaagaagaaagcaaggcatcttagaaacagactataataaccattatataaccactagaagggaaatggagtaagaaactattttatagaattaacagtgcttaactactgtttcatgttatactaaaagcactcaacgtaaaataaaattaaatgacccaaccagcataaacatgccaccaaggttgagtaacaaggtgtaagggtcagactggttagggctgccttgagtcttaagagttcatctccaaagccgttgtctcgcccacctcagctttgcggtgacatcccagtgtgcagtgctcactcacggcaccgtcatctctctgagtgatttatgggctcagaagtcatcagcaaggaaactgcaggaagcccctgctgagaaccacgagcactgaaggaaaacagctgcacacatccgagcagattatttctttaacactcgtgtgaaacaaggcatcacgctggacataccgagtcttcctctttttcttttttttaaatggaaatatccttatctgggtgggtgaaggatggatatgacttcttaagtgaaaaacaaccgtttttgtggagctgctgaaaagattaaaacacactcatatacacactcagtttctcttcctcatcaaaaaatgagcaacaaaatagcttactgaatgtgcatgttcacacatgtacatatatttgcatatttaacttatttcgttgaaatcttttctctttctaaaagcaaagctgcactggaaaggaagactacattttatgagcaaagataaaacactctttgaatagtaaattgtttttaacaaaagaagaattcaggctaaaatgagaagaataatcagtttttgggaattttgccttttgtttaagttttttagtttatttaaatctttactgaactagaaaacaaggtaaattattctccaggttttctgcttagcatgccaggaagttctgggacattatttgaggatgttttgacaaacaaaatcatcccgatatggaataaagtcaacattcagtaacgcataattgaattttattttcgtggatgttagaataatgatatctatgtgttaaaccacaagcttcttgagggctttataatgtgtggttaggggactttccagctgccacagatcctgccagatgcttcagcattttggtttgttccacagttgaggaatgaagaaacttattccacagaagtgctgtcgccatgttctgacggctttccacagctgtgtcctcacatgcggtgtgtccataggagctctgtcaatcatgcacttgggcttgggttttaaaatactgatcacaacaacagactagaatagctacttttagttacatgaattagtaccatttggttgtgttttgagatttttttgatatggctatttatataaaattgtctcacacagctatcaaatgcacaggattaaaaatataagaccaaaataatatttaagtaagatgtaaaacatagcaaaaccacaaagttgtaaactcgtttccaaaagtcacgatagaatactgatctcattaacttcaaatggtgctagttatataaagatatgtatgcatgatcaaagcttaggcccgggtgcggtggctcatgcctgtaatcccagcactttgggaggccaaggcgggcagatcatgaggtcaacagatggagaccatcctggccaacatggtgaaaccccatctctactaaaaatacatatcagctggacgtggtagcacgtgtctgtaatcccagctactcgggaggctggggcaggagaattgcttgaaccatggagtcggagcttgcagtgagccgagaatgcgccactgcactccagcctggcaacagaacaagactccatctcaataaaaaaaaatatagcttagatatctctgccatgaacatatgtaatccaaataatcttttcggcaaatgtgtgcacagggaatatttaaaaactcataatgctcgtcaagaggaaattaatttccacttgaactaagccaacgtaaaagtcaaaaatgccctttggaaatttaaacacaaaacaaaagattgtgcgtaaggagtgaatctgtatatataagaataatcttcaacatggtctaaacgttctcttaatacagcccggtttagtgaataacttagctgcgtgaccttgggtaagtcatttagtttcaatgttttcacataaataactgaattgtgagggtatattgaggcatgcatttcgtagtactttaaaaaataatgcaaatttatgatacattattttaaacgttattataaatgcttacattatatacatatgcgttatatatgtatatagatataacagctgcatatctaatgatgattatactcttctatttctacattaaatatatttttatgtgttcttttgaaaagttcgattactagaactaacaatatttcttcattttatgagatggttctcacattaaaggaagaaaaatgccacgacgtctttctcttcagtagtaggaacaagtgagagaattaattgttttaaaatgactgttgaagaatgatgagaggctctctgtacaataaacaagccaaactcaaatatatggctagagttctgggttgttaatgcacacactataaacttttatgttgggaaatcaagctagtgatgtccaaaaatcatttcttttttagatttccagaaattcatgaccaagaatggtttagctcatgtgcatattacctttggacacagatcaagcaaacaaatataaaaaaccaagtgaaaaatgtttgtcaggctttgttaaacggtgaaacaggatacagtcttattttaagagcagacgaaaatttgcattttatttcaatttgccaaaccaatttttgtagaacctcatcatagcaacattcttgtggcaagtaaagtcagcatgttgttcctatcagtagagggggaatcagaaacagattctggacatattccaatttcaaggggttcagaaagaaaattaaaattaaacttcaaagctgaagtgctcaagactaaactagactaataatacataaagtggaaaattaagtaattctaaatgtcatgggcatgtgaatatcactgactcatctttaattttatagaataagttagtgttataagtgacgagattaattcaagctgactaacacaggttgatcattttgttatttatgcttttgtttccctcttttatttttgttaacaagcttagtgcttggcaataataaatgggtagctcaaatattatcttctctaaaaaactttgttgatcttttctaaaaatacatacttggtttattcacacttctatgacaacccttttaactctgctttaaagtttggattatatgtctatttctctgtggttttttggagtgcaaagaccatgttccctgttggattttccttttctacacaaagtatggtatttggcatataaacatgttaaaagtggtgaacaagcatttcacaaaagaattaatgagtgaagcagtaagtgggttcatagcaaccctcagttgttgacgggatcaactagattattacaagcaaatcctgttgtttcattcattcattctacaaatattgatcaagttcttggtataaataaaatacctggatccatagctgttcatcagcccttcatttaaggtgtcatccatgggagtgaagatgagagacaagaaagtggtgcctgaaagctcagcagttagggaatttgaggccattctaggttctaaaaacactgtggtgaccttagcgcttaaactttctggttttcagtttcctcatttgtaatacgaagggatggccttaatggtctttacattccctgtaagtttaacattttattatgatgattgatagtagtactgctgaggcacaagctctgcagggtcctcatcacatacagcctgaggcaggggtatagaatcattataaggatatcagcactgagagactataattctaaagtcatgcgggacgcaaaatacagcagaggtggcacagaggcagagaggaggcacgtggaggtggtggggtgtgtgtgtgtttgtgtgagagagagagagagaaagagagagagatggagagaaagtgtgactgttcaggggaagaatttgtaaaacatgacactgaaactcagtttttaaggatgaattctgcaggggcacagccagggggtgggtgattccaaatgtcagaaacagcatgcacaaaagcatcgagtttagaaacagtggggcataaagaaaattggaagcacttaggttttgttggagaatgaatgtgtttgacaggttgacaggttggagactggaactgtaggtaagaggctgacctaaaggctctggattccaggcctgagggtacagactgcagtctatactcagagagagatgacagatgctggtttcaaaagctcgtggcagctgctgtggaaggcggaactcaaggcagtaaaactaggagcagtgggccttttgagagcaaactgaggtgagaggtgagatccaggtgagagagggaggggtaagagacgggtaagctggagcttgggcagtggcatgtaaaagagttcctagtgaaggacatttaggaggaagaaccaatcgatagcatttggtaatagactagcatcaatcatcagggaagaataggaacttttttaggttgtccaagtgaggggagatgattttcttaacagataccagccacatggaagcataaatatacctgtggtagaaagatgatgaatttggttttggatagattgaatttgaagtgcctttggggcattcagaaggactagcccattgcgtttagaataacatccagaagccttactagcctggccctgaaagcccactgctgctgctcagccctcatctcctgccgcgccccttcatcctgcccctggccactccaccgttcctgcaccccccgatcccctaaaactagcccgcccctgagttttgcacttgccgtttgctccactggcaacaatgtctcctcaaacatctacagggctggtttatgtgtgttcagcctgtttatggagtctccgaagatcatcttgacagagtccccttcggagaccatcccaagctgcatggccctgggcatttctgtcgcgccgtgttttattttccgcaaagcttatacaactatttacggtgatcatggttattttcgtattcgcttgctctctacttgagggaaaagctctgtgagaacagagaattggtttcgcttgccgttgcgaccccgcacctagcacagtgcctgatgtgcactaaccgcgctgacggttgagtaactgtgcacctgcccgtggaactgtggagagagccggcggatacgcaggtgcagcagagcaggacggacggaggagcgcatggacttgcttccattgttcaagcgccttcatgtagtcagatattgctacaaaataagatattttaaccacaactggttttttcactctgacttcccctcttccactcatctcatgttagttgatatgaaaaagtgtattggggacacagctaatgagacattgaattagaatacattagatttggttctaataggatgtatttgtacaatttgcgacatacataatcataaatgccaaattacatagagaaatgcatatttatttagaacgagaagagaaataataatactagcttttgaaaaactaacaaatatctaatcttcacaaagtctagaaaatcacgtgtttttatgttgttttgccggatattgttccatagtccttcttttcctatgtttttggctgaatagtatttaatctcctcttccaatggcagcgcttttgtaatgtcactttctataaaaaggaaagataattctatttttctactagtatggttgatttattttaaacagtgtttagaaaagtatttttagcattataacttgttaatgaaacataaaaatttcaaggattgttttcaaatttaggaaaaacttgttttttcttttttttgttgctgttgttgttttcgagacggagtctcgctttgtcacccaggttggagtgcagtggtgcgatcttggctcactgcaacctctgcctctggggttcaagcgattctcctgctgggactataggtgcccccgccactaggtccggctaatttttgtatttttagtagaaactggtttcaccatgttgtccagggtggtcttgaactcctgacttcaggtgatccctcctcctcagcctcccaaagtgctgggattacaggcgtgagcccccatgcccggctgatctcgtttttcacacagggtttgttacttacatgcttgctgtttttggagctgcttcagatttgtgccctacacatgcagtaattctgataaattctattttatgaaattttccaccaaagttaatgtactgatttctgtatatgctttattatatcatatatttttgaaaagagagaatttccattacttgagagaaaattttcaattcatactttattcattcaatttttaattatgtacatttcaaaatgtatttcttttccattccttgcatgcgtccggtgacaggtcccccaggacattctgtcttggccttgcccctttgtcacagtggaatacaattcagctgagaaaaggagaaagtcctgtcagtcacaaaaccatagatgatcctggaggacattattctaagataaataagccaggcatagaaacacaatactgtatgatcccacttaaatgtgggatgtaaacaagtcgaacccatagaagcagaaagtagaatggtatgagaatgtgtcggtcgaagtgtacaaagtttcagttaggagaactatattctggagatctatttggcggatgtagtaacaataatgtactctacccttgaaaattgctgaaagtaggttttaaatgttcccacaacacaaaaataagtatgtgtgatatgttaattagcttgatttaattatttcagaatgtacacatatgtcaaaacatcatgttgtatcccataagcatgtacaataaaaaataatttaaaacaatgacaaaaatccagaacacacaaaatacctataaaatataaataaaaatataatagccaggcatggtggcatgcctgtgatcccagctactctggaggctgaggcaggagttttgcttaagcccaggagttcaaggctgcagtgagctgtgatcatacaactgcattccaggctgggtgacagggcaagactctatctcaaatatatatatatatcatatcattatatatgtgatataaccataaactataaaatatacatttaaaatattatatatgtaaatatacatttatgaattacatttgagttcttgctgcccttttttttaatggcagcatctaaaagactggaatttgtccaagtagaaaatcctacttttgttaaccattacttggctgaatgtcaataaatgcccatggtatgagaacatggttgtttataagaaatcatcaacagataactgtatatttataaacagttaacccttaaacaacatgggtttgaattgcatggtccactcataagcagattttttccctctctgccacccctgagacagcaagaccaagccctcttcttcctcctcttctgctcaatgtgaagaagatgagaattaagacccttgtgatgatccacttccacttaatagtaaatttatttcctctgtctctctctttttttttttttttagttgtggggggtctctctattttgccgaggctggcctcaaactcctgggctcaaatgatcctcctgcctcagcctcccaagtagctgggatgttgaagcaggtcacaggacatcatgcctggcttccttgtgatgtttcaaaataacattttcttttctctagtctcaggttttttgtaaaagtatagtgagtatagtatgtaatacatataacatgcaaaatatgcattagtcaactatgttatcagtaaggctacaggtcaacagtagactattagtagttaagtttttttttttttgtcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactaagaatgatgatttccaatttcatccatgtccctgcaaaggacatgaactcatcctttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgtgtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtcaatttgtttgagttcatcgtagattctggatattagccctttgtcagatgagtaagttgtgaaaattttctcccattttgtaggttgcctgttcactctgatggtagtttcttttgctgtgcagaagctctttagtttaattagatcccttttgtcaattttgtcttttgttgccatttcttttggtgttttagacatgaagtccttgcccatgcctatgtcctgaatggtaatgcctaggttttcttctagggtttttatggttttaggtctaacgtttaagcctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagcttcgttcttttggcgtaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatcttgattcttcctacccatgagcatagaatgttcttccatttgtttgtatcctcttttatttccttgagcagtggtttgtagttctcctcgaagaggtccttcacatcccttgtaagttggattcctaagtattttattctctttgaagcaattgtgaatgggagttcactcacgatttggctgtttgtctgttgttggtgtataagaatgcttgtgatttttgtacattgattttgtatcctgaaactttgctgaagttgcttatcagcttaaggagattttaggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgctgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttggttggtaaactattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctatgggatcggtggtgacatcccctttatcattttttattgtgtctatttgattcttctctctttttttctttattagtcttgctagcggtctatcaattttgttgatcctttcaaaaaaccagctcctggtttcattaattttttgaaggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgcgtctttgttctcgttgatttcaaagaacatctttatttctgccttcatttcgttacgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggagagttagctcttcttgttgaattgatccctttaccattatgtaatggccttctttgtctcttttgatctttgttggtttaaagtctgttttatcagagattaggattgcaaccctttttttgttttccattggcttggtagatcttcctccatccttttattttgagcctatgtgtgtctctgcacgtgagatgggtttcctgaatacaacacactgatgggtcttggctctttatccaatttgccagtctgtgtcttttaattggatcatttagtccatttacatttaaagttaatattgttatgtgtgaatttgatcctgtcattgtgatgttagctggttattttgctctttagttgatgcagtttcttcctagtctcgatggtctttacattttggcatgattttgcagcggctggtaccggtcgttcctttccatgtttagtgcttccttcaggagctcttgtaaggcaggcctggtggtgacaaaatctctcagcatttgcttgtctgtaaagttttttatttctccttcacttatgaagcttagtttggctggatatgaaattctgggttgaaaattcttttctttaagaatgttgaatatcggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgcctttctacattggggaagttctcctggataatatcctgcagagtgttttccaacttggttccattctccccatcactttcaggtacaccaatcagatgtagatttggtctcttcacatagtcccatatttcttggaggctctgctcatttctttttattctttttctctaaacttcccttctcacttcatttcattcatttcatcttccatcactgataccctttcttccagttgatcacattggcttctgaggcttctgcattcttcacgtatttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccattgctggtgacgaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgagatgtcagtgtgcccctgctggggggtgcctcccagttaggctactcaggggtcaggggtcagggacccatttgaggaggctgtctgcccgttctcagatctccagctgcgtgctgggagaaccactgctctcttcaaagctgtcagacagggacatttaagtctgcagcggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggtgggcgcccctcccccagcctcgctgccgccttgcagtttgatctcagactgctgtgctagcaatcagcgagactccgtgggcgtaggaccctccaagccaggtgcaggatataatctcctggtgtgccattttttaagcccgtcggaaaagtgcagtattcgggtgggagtgacctgattttccaggtgccgtcggtcacccctttctttgactcagaaagggaactccctgaccccttgcgcttcccaagtgaggcaatgcctcgccctgcttccgctcgcacacggtgcgcgcacccactgacctgagcccactgtctggcactgcctagtgagatgaacccagtacctcagatggaaatgcagaaatcaccgtcttctgcgtcgctcacgctgggagctgtagaccggagctgttcctattcggccatctttgctcctccccccttagtagttaagtttttgaggagtcaaaaatttcaactctgagtcagtaacccccatgttgttcaaggatcaaatgtatatatttccatatgtgtgtttagatacatgtatgtgtgtgtgtatatattcatgcatgtgagcctatgtgcgtgtagactattctctaaaactcaaaatcagagaaaaataacctttgtgtaaagtaaaatatatcaatgaccataatcagatatgaatcataattctaatatgtagttgacgtatagaaaaaagcataagaatttgtattgatatgtttatttaaattaaattataaaattgcatagagttagaaaaagcaaaattagtttattgcaattattattttctcaacttgatattaataaagttatttttataataatggcacatattaaaaagcaattttactctgtccttcagagcatttgctccacattggagctatttccattgtagatttttttgtaaggctataattctatcacatgggcagattgtgctaaaacaagcagaaagggtcacaaccttctgtctaacctttgctatttagaatgaacgcccagggctttcgagaatgtaaattgtcctggcctgttctctgacaaaataagaacatacagttgaagaattattttttgtaaaacctaaatttgccttttttcctcacactaagctcttctcaagtgttaagtttaaagacagttaattatcagctattctttagagcacgggaaaaacagtttagtactcagtaaagtgagcatgcaatctaccttattcctgtttttttcgatggatgaatgtgaagaatttacacagtcatgcaagagaggcaacgatagtgttctcttaagaagacaaaattataagattggaggttaacacttgctcaacccagtaaaaaggcatttggtagatatttctgatctttccctgactgatgaaaagtgctgatatttctaagaaactggtaggaaactttaaaaaaaaaaaactccccgaagcctaccaccaggcatgccatgaactttcagatgacacatcgtgctactaatttttagtgacctttgctaaatttatcaaaaaatgctctcactaaatccatttctgtagaaataaagaaaatatccgtgatgtgcaaactcacagtacaaatctgtgcggcttctgactgcaaaagatcctgcatatttcatcaaagcctcagggttgtggttattgatgtttcccagaacgtggagtgaaaccccacacaaacagattgccaaaggggagaaaactatgatttgtgaaattcaacattatctcttgaatgcctttgctttttattttgaacatactttattttttagaccagttttaggatcacagcaaaattaagcagaggtatagagatttcctatatatccactgcccccatacaggcatagcctcccccattatcaaaagcccccacaagagtggtaaatgtgttacaactgattaacctccattgacacatcattctcaccccaaatttaccttaggtgttagacattctgtgggcttggagaaatgtataatgatgtgtacacacaattacggcattatacagggtaggtttcttgtcctaaacgttctctgtgctccacctattcagtctccctctctcttaagtctgggcaaccattgattatttttactgtctccatagtttgcctttaaaaaaatgtcatatagtggctcacgcctgtaattccagcactttgggaggccgaggcaggcagatcaacgaggtcaggagttcgagaccatcctggccaacatggtgaaaccctgtctctaacaaaaatacaaaaattagctgggtgtggtgatgcttgcctgtaatcccagctactcagagggctgaggcaggagaatcacttgaaccagggagttgacgttgcagtgagccgagattgcgccactgcactccagcctggcgagagagcgagactctgtctaaaaaaaaaaaaaaaaagtcatatagttggaatcgtgtattatgtagccttttcaatttggcttttttcacttggtaatatgcatttaagtttcttccacatgattttatggcttgaaagcttatttctttttaacgctgagaaaatttccattgtctggatgtacaacggcttattccttcgcctattctaggctatctaaatttcttctaagttttagcaattatgaatagaaatgctctaagtgcaagtttttatgtagacatgttttcatcttctttgggtaaataccaaggagagtgattatagtatcatataataaaagaatgtttagtttggtaagaaacggtcaaactctcttccaaagtgactgccattttgcattcccatcagcaacgaaagagaattcattgttctttaacctcactagcatttggtgttggatctggagcttggccattacaataagtgagtagtaatatctcattgttttaatttgcatttccctgaggacgtatggtatggagcatctttcacgtgcttatttgccatctgtatattttctttggttgggtgtctatttaggtctttggaccattttttaattaagttttttttttttatcgtttagatttaagggattctttctatattttgaatagcagtcccttatcagatatggcctcccacatgagaatgtaattcttctgacagtgcctctcatggagcagaactttttaattgtaatgaagttcagtttatcaattgtttctctcagagattatgcttttggtatatctaaaaagtcattgccaaactcttgctaatctagatttttctcctatgttatcttctaggagttttataattttgtgttttagaatccactttgagttaatttttgtgaagagtataaggtctgtgtctaggtttatttatttttgcatgtggatgttcagttgttatagtactatttgtagaaaagactgtttttgctccatcgtctttgctcctttgtcaaagatcagttggctctatttatgtaggtctacttctgggctcctcattctgtttctttgacatgtttgtctgttgttttaccaataccacactgtcttgattactgtagctttatagtaagtcttgaaatctggtaatatctgtcctccagctttgttattctccttcaatattgtgatggttattgtgagtcttttgcctttccatagaatcagtttgtcaatatacactaaaataacttgctggaattttgattggggttgcatttaatgtatagattcagatgggaagaactgccagtatttagcctctctatccatgaacatgagatgtctctatttatttagttctttgatttttttcatcagagttttgtcattttcctcctataaatcttgtacatattttcttagatttatatcttcggtatttcattttgggtgtgctcatgtaaatggtattatgcttataatttaaaattgtacttgttcattgctggtatataggaaagcaatagggtttcgtatattaactttatgttttgccaccttatgataagttagtttcaggaggttttgttggtgttattaagttattgttgttgattatttttgattttctacataaataatcatgtcaactgcaaacaaagacagcttttttactctattggtgtgttttatttatttattatttatttatttacttatttatttattttctcattgcattagttagggcttccagtgtgctgttgaaaagaagtggtgagaggtaatatccttgccttgtttttcatcttagcacaaaagtttccactttctcaccattaaatgtaatgttagctgtatgtttttgtaaatatcacttgttagtctgaaaatgtctttttattattattattatactttaagttttagggtacatgtgcacaacgtgcaggtttgttacatatgtatacatgtgccatgttggtgtgctgcacccattaactcgtcatttacattaggtatatctcctaatgctatccctccccactccctcccaccccacaacaggccccgctgtgtgatgttccccttcctgtgtccatgtgttctcattgttcagttcccacctatgagtgagaacatgcctgcaggttctgtccatttgtggtagagggacattaaagtgttcaactataatagtgaatttgtttctctttgtggttctatcagtgtttgtctcatagctctaatgtctgctctgaattcacataactactcctgctttctcttgactaatgttagtatggtgtatttttctctatttatttacttttgatctataggtatctttatatttaaattggatttcttgcaaacaatatatagttgagtcttgttttttgatccactctgccaatttctgactttcaattggtgcatttagaccattgatactccaagcgattactgatatagttggattactgtctataatattttttattcttttctatttgttgccctttgcttctatttttgaattctacttctttctgcttttttgtagcttgagtttgttttttattgaacagaatgaacaagaagttgttggctcctcaaaatcaattattatttttatatcaaactggaaaattaaaactaaacttcaagttttatcagcttgttatttgacaagtacttttttttcccaggcactgccctttacatctaagccaatgggttttctatctatctgtttcctactttctagtttaggttttaatagtttttaaatctttgtggttattattgatattctcaatttttactattaaaatgaagcattatggatagtaaagcatattttgaagaatttctacggtgattaaaaatttttctattttgtaatatggtgttatttttacatagaaaaacacctgatacttttgagacctcagttatctctcacataaactctcactgaatttatctgtacccaagtcatggtgttaagaagtcttgctgtgaaatgtagaggtcagtcacatacatgttgaaatacaacagaatgtgtgtgggttgcttccgggctcttctgcttaccagctgtgtgtccttgcacaagttaactaaattcttgcctgtcagcttctcatcagtaaactagggagtataaagacaatccatagtattattgtggatgttagctaaaatattttaatgcaaagtatcaattaaaattttttgaaatataatagatgtcccaaaatgctggcttaccattcattattattttaatctttgcatttcagtcttttgtgatactttctccaacatacaacagtctagaatggaaatatgggctatatttttgaatttctaagcattttacctggctattagtatgaattcaagaagcatttgttgaaagaaaaataagattctcaaattgtaagcattagtgcaaacatttacttggccactaagaaaatttaataattaattaatatactttagaatttgtttcaaaactctaaatgtttatgataaaactaaactttctggtatttggatttattcttaataacttcttttcctacattgcctttgtgaagttttctctctaataagccacctttaaagtttgaaactgcagaatcacaaagtgtacacttgctgcatactgtagagtccttttggttgcaccaaatcctgttgagagttttaccattttaataggcatcagtcagcgtctgcaaaaactttgcacacatgtaaagctgttgctgaaatcttttattatctggagaaggaaaagcactaattttttcatgccataaaattcctaaaaatgatgctctgatggtaacataatgccctatatgtgagtaccatggttatagatttaatctaaaatatgaaatcatcaatactatacagccaatatcaaaaacatgttgatcaatccataaaagatatgttgatcaataatgatcaaagcttaccgataccaccgtgtccagtgttcattctaacagcacagcacaatggttccagacaattacctagtcttgttctccatatcaagtggagttattagccaatgggtgaaaattttctgttaagcaagatgaataaattctagacatcttctgtatagcattccacctataggcaaccatattgcactgtacattgaaaattttgttaagaagatagatcttacgttaagcgttcttaccacaatttaaaatagttttttaaattagctagtaaaccttttttatggtctagatactaatttccaaatataaagatggataatttaattgtctttaaaatttaagcccaggtgaagtgtcaagaatgtcagcatttatttctgtgttgacaaatcagaacataaacataaacaaatcaaaacatcaactacattcaggtctccaactttaatatcaactatctgttaattgattttaggtccacatctttgtccacaatggcacatttctaaacgcatcatctggaattaaaactacttacctactctctatacagttgccacttaacgggaatttcctggttgggtcaggaatgtgtttattcttatgcattctttgcaggctgcattgcccagagttcaatctggtttcatattgtgaagcacaggggagagtgggaagaggtaaatattccctacaccttcccacccatccaccctgaccctatcctcttccccactgtctgagggctttagacagtggctacatttttccatggctccgtccagaaaggtccactgttacttcagttttaaccaaataatccctgcccctgagctctggtaaatgcctcttctctttgctactctggcctcggagaaataattccttactgggattcatgatatctgggttttctctcagtgatttcactggtgtctcagcccttccattacccttgcagccagtccccaactcgaaattattgttgtccagggaactcaaacaactcaacaagaaaaaacacaggtagccccattgaatagtgggcaaatgacatgaacacatatttttccaaagaagacatgcaaatagtcaacaagcatatgaaaaactgctaaatatcactaatcagagaaaaatcaaattaaagccataataagataatatcttacagcattaaaaaatatggtggtgaggatgtggagacaagggaatgctttgtacactgttggtgggagtgcaaattagtgcaacctctatggaaaacagtatggagatttttcaaagaactaaaaatagatgtaccatttgacccagtcatcccagtactgtgtatctacgcagaagaaaagtaatcattacaccaaaatatacctgcactcatatgtgtactactcaaagcagcaaagatatggaatcaacctgagtgtccatcaaaggatgattggataaagaaaatgtgttattatatatatatacacatatataaaaacacattttcgtgatatatatatatatatatataccatgaaaaaatactcagctataaaaaagaatgaaattatgtctttttcagaaacataagtggaactggaggcctttatcttaagtaaagtaactcagaaacgaaagtcaaatacggcatattctcacttataagtgggagctaaacaatgtgtacacatgaacatagagagtggaataatagacattggaggcttggaaaggtgggagggtgggagtggggtgaaggatgagcaattacctctcgggtacaatgtgcactatttgggtgatgattacactaaaagctcaggcttcaccagcacataatatatccatgtaacaaaactgcacttgtaccttctaaatctgtaaaaataaaaattaaattgtccttatttcaaatgcagtaggtggtttctgttttgtttttgtgtttttgctttttgacaaaattgcgatatatatgcgctgtataatgatatcctaggagtcacgtttctggatctactttttcagggtcatttctaagcattgtggattatgtatctgttttagattgaaaatactgaaccatatagctttcatgggatttgagaatgaaatcatgttttccctaagaaatgatatcttttcttctaaaaacacaaagcagtctaactttgataattaattctaatatgcattgggaacacatgcataggtagatggaaagtttgatgaaatgctaccatgtgatatatgattttcatatatatctcatttattcttgcaaccactcaacagggatattatgtaacataacttgctgttgtgaaatctgtaaaatagctacaaaccaaatccaaggctgtctgagtccaaagcctagaccatttctactctgtaaaactatttcttcttcagagaaaatatttaaaacaacagtgacagactatgaatgttcaatatgtataatatggaaatttgtctcttttttctttatttttcttgctgtattagaaaaactccttgcagcgttttaagattaatgttcctttccctctaggaaagaggatagagcaaaacaagttttgttttattaatgatttcagtcctggatttaataaattttaaacctacactatgaaattaaaagggatgatgcattttgggatgaggatgagttagaggtagaatgacataaagataaagaagtgaaggaagtttatcaggcgtgaaacagaagcctggggcacgatgatggggaaggtttccaagtgggaggagctactgattagtgagtccagagggtagttcccaggaaggagcaacgtacatcaataaggaggttcaaaaacaaattgtctgtacctggtaaggacagaagtacaaattcattggtctgtgttaaaagtcttgttccttatcaaaatgcaatctatagagaacttcgttaatctggatattaggcaggcatcatgctgattcactaaatgatgacatcatctttatgagccttgataaaataaagtacaaataatccaaaatgtcctggaaatatacatgcatcatggaagatggtaggtaaacttcatggagaatcaggggcttgacaaattgatgttcttagaggattgaggtatgccacaggtagggaagaaacggttgcatgttgcacctccagttactaaggcagaagcccagatcttcatggattttggaggtagcattatttattgggtgatatggtttggctgtgtccccacccaaatctcatgttgaagtgtagctcccataattcccacgtgttgtgggagggacctatgggaggtaattgaatcacgggggcagttttcccccatactgttctcgcggtagtgaataagtctcatgagatctgagggttttataaggggttttccctttctcttggctctcattctctcctacctgctgccatgtaagatgtgcctttcaccttccaccatgattatgaggcctccccagccacgtggaactgtgagtccattaaacctctttttctttataaattacccagtctccagtatgtctttatcagcagcatgaaaacagagtaatacattgggaacttggaaactatcagttttaagtggaatccagagaaacagagggctgtgtagcacaatctgttctgcctcttaagccacatgactcagtaaatccagagatgctagatgtatctgtaatagataatgaagctacatggagtctctgacaagcccaaatataagggttgcagaacagacccatagggttttagataaaagccatgccttccttagcgtgcaactggaccccagcagactgagcaccgtaatgcgggatatgaagtgattttccaatcattctttcctcatgagttggatatgttcagatctgtcaatttatgacactgagggtttgcaacatcaatatattatacaatatttgatgggaaaagtattgtactgatgtttgtagttgtgtaacaaatcaccataaatttagcatcttaaacaacacgcatgtattatttcacagattctatggatgaagagtgtgggcacagattaactgggtcttctgcttagggtttcaatggctgagaaatcaaggtgttgactagactgttttctcatctagagtttactggagaaaatccacttccaagttggaaaaattcatttccttgcagtcacagggttaaggtctccagcttcttgacagctggggctgggagccaccttcagcttctggaggctgccagtagttctgagaagccaccggcaattcctgccaatggccacttatacttcatcaagccaataaggagaatctctgtgacaagccagcctgcaaaacagggtaatatactgtaactatcatgtgagtgacatctcatcacattcaccaaattctatcgattagaagcaagtcaaggtcccattgacattccaggggatggaatgaggcacaaggcattcagcaccaagaggtggagatcatgggggcatcttagagtctgcctgctacagataaattcagagttaggcctgaaaaggtccagaagacacaagtaagttgtagccatgagtagcccaggtgcaatatcatatacctcagtagcaccagtgtcttctcctcagctaaggaaggtgtcaagagagacatcttatgatcaacctatggaggaagaaaaaatttgtggtattttgcatgtcggctcagggcaaagagtgcattttagaataaaggaggtgtggcaacgtgtgtgcatggccgtcagatgcacagggctaagaagcaactgctagaaaggtcaaatagctgtaataggttcagctcatgtggaacttgggacactgctctgtatgtttgagactctctcctccagaaaacagaatatttactgagccagcagtcaatacatggtgctgagactgacatgtctagaaaacacaggtctcaggaccacagggtgaaagagttgccccctcaccatcacacgtgagtatccacttgaagaatcactgtgttttccagtctcacaacattaggctctcctggattagggataatggttcccaagaaagaactgcttctatagggaatatagaaagaattccacataatataaagttacttcaagttagaactgctgtctgattactttgggtttctcatactaacgtactcagaggcaaagaaagaagatactcagctaaggaggtaattagtccaggttattatgagagacagtgacaaatgtagaatccaaaaagactaatatggccatctcctgttatttatctgttcagtaagaacaatgaacgggcacttatagcagtcatggtccagtaagaggaagaaagtatggattcaactctgtaggggtgatggtttgagtcaacgcaacagaccagcaacccagaccaaacaaagagatctgtcattcttcctgtgagtgacaccggaactgctctcgttaaccttacactgttcgtctctgacttcctgttccagacttctctgttggcacattgagagtaatgtcatggtgagctgctgtgcgctcaagaatgtgctacctggaggtttgggaagttaaacctttagagaaatcttttgaccaaaggaacttgggagaaaatggatacacattttcctataacttctccagaaagtcttgagacatagtccatagacttccgtaggagatcaacgaaatgaaggaagcagctgtcgatagttgtggctaacgtaaaaatgtatctctatattcagcctcccttctcccctgttttgttcccctgcttcctggattccactcctcgataaaatacttgcccttaagcctttgccttagctctggtgtctgaggaattagagctaagatactgctcattatgagaatgtcaacacccacgccaagtctactaattccagatgatctaaaattttaagacccttagggatccagttcactggaggattctactcaaaggtatagagaaaggcctttgttcaagctgcacatcacattttgttaattaggcatggaagtcactctcctcgtacccaaggtctcacatgtgctctcctaacgtactgattagcatccaagcaaaaccacaacccatcatataccactttaagcttctcttcccccagtggtattattgctctgtcctaattacgtgacaacaaccccacggatttgaattcaaatggcagcaagcggccaaaatgccaatttcttcatctactaatctgtacttctatagtttctctccgaatgttttcttcctccattttaaagttatatttctgtacatgaataactccattatacagttaatatggtaaaggaaacaaactctttcttatgtcaatgacacctttaatactttttttatcattcctctattttaaaatcttactacattttcctttttgaaggtattattttcccatatgcctacagaaaatatgcccattggcaaaataatgcaaaatgatgaagataataaaacaaaataaagaaaataaaaatccacagtgttcttgtttttgagccatttctttgaatggatacttagcctttgctattacgttattatgactttaacaccatcattgaaatttgcctggctgggcggggtagctcactcctgtaattccagcactttttgaggccaaagcatgtggatcacctgaggtcaggagttcaagaccagcctggcaaacatggtgaaaacccatctctacaaaaaaatacaaaaaattagctggccgtcgtggtgggtacctgcaatcccagcgactcaggaggctgaggcaggagaatcatttgaactcagcaggcggaggttgcagtgagccgagatccatgccactgcactccagcctcggcgacagagagacactccatctcaaaaataaaaaataaaaaaagaagaagaaagaaaagaaatttgcctatcactgagaacagttaatttcatacagggtcataacacgctagatgattgcactgttattattataggtagataacagaaggccaggacattagtctgttttgcattgctataaaggaatatctaaggctggtagtttattttttgtcttggctcatggttctgcagactatccaggaagcatagtgccagtgtctgcttctgtgaaagcctcaggaagcttacaatcatgacagagggcagagggggagcaggtgcatcacatggtgagacagggagcaagagaggggggaggtgccaggctcttctaaacaaccaggtctcgggaagtaagaactcataactgcagggagggcacgaagccattcgtgaggggtctgcccccatgacccaaacccctcccaccaggccccacctccaacgtcagggatcacatttcaacatgagatttgcaggggacaaacatccaaactacatcagcaagttctggactaaagtaagacacatttggtttgacgcccttccattttatttttaatataccctcttccaacctaacagacatcaacccaggtctcgttttttcctgatcagattggggttttattttaaaccaagcccatgttaacagccagttttttttccaaggaaaatatccccattattagctatggccaggattttctgaattctctttcctatttgcactttgcatttttactggggcttctctgcccttcataagaggcgcgcatccttagtggggcactgttaaagcagccgcgtctccctcagccctggctacaggcagcaggtgtttcttccatcttatgcccatactccgcctccttaggctttctacacaagggaccttaagtggaagcccacactcttcttgcaatcaaagctttctctttttcctgaggttcactgatgttgttgattctataatcttttgtggggttttaatttgtgataatgtaaagtgttaggagtcccccaaagcatttatattatgagaggttgttcccaaatatggaaacgtgttcaactcacagtatgcatttctaatggtagaatttacccccctttagtaggtgggtgctgtcaaaggggagtacatgtgtgtctatatggctctgtgtctgtccttgtctacctcacttctctacttattatctatccatttaccacccattctaaatagatctgatggtaatgccagagaagagacattatcatattttactgaataaaataatgagaaaaagcggggttgaagtcacatcacagaccgagaaaaacttctagagtattactgtgcagaaaatgcagtggactagaggaaatttagccagtacttctttctttatgatcctattattttcactacacagaagccagttttctccctgctttttcacttggtaggatttggccagtgtctgttagaaatttggttaaagctcaaacaagtcggattttcaaaagcaacctgaaggtcagctgtttagttttatgcatttccttcttctctgaccaaatactgcaagttctgccaataggcaaaggcaaagataatgtattttgtatggcctagttttgtatccatatgaaatactatagacttgtttgaggttacagtttgaatattaacaaaaatcaataaagctaagatgtactagataacattcaaagtccctttgaaataagaagaaatgctcaggaaaatctaaaagtaaaatatttatttttctcaattgatatttccataagtcatttttattttttgctcttaataaagaaaccataataatgtgagaataaagtgaaatcagtggtaccattattgaatacttatttaataccccctcactacaacaccaccccaagtcccattgctcaaagacaaccacttttgtttctctctctggtatttgggaacacatttattaataatataggtataatgtaattttctattgagtaatttacatgtttaaccattacaggcattttgctttcctgttccaatggataaaaattcaactctcctgatagaaatttcaaagacagaccaggcttggtggcttatccctgtgatcccagcactttgggaggttgaggcaggcggatcacaaggtcaggagtttgagaccagcctggccaacatggtgaaaccctatctctactaaaatacaaaaaattagccgggtgtggttgcaggcacctgtagtcccagctactcaggaggctgagacaagaatcacttgaacctgggaggcggagcttgcagtgagccgagattgtgccactgcactccagcctgggtgacagagtgagactccatctcaaaaaaaaaaaaaagagaaatttcaaagagaaaaagacaaatcacctagccatgagttagatttgttacatcataacatttcagtgttagattggattttccattgtgtctagttcacccagccatctaatgcttgaagtttttctaatcactcttttctttctcagaggacgttgacttctgcacgaatccctccaggttctgtgaaatatttctcaaggttgtcagttgcccatttcataaccctacagctaggatttctctccctgtctcactatctctctcctccacctcaagcctcagatcaaaaatctgtattcttgggacttctcccttttgagctagaattccacatggaatcactactgttctacctgagagatctataaatattttaaagacaatattagtttctgtccttagttttttctcttcaatgttaatattataaattctgaacatgaatatatgtcaagttctctttccatctttaatgctatacgtaaatgttttaagtttcatggccaggcgcagtggctcacgcctgtaatcccagcactttgggaggccaaggcaggtggatcacaaggtcaggagtttgagatcagcctggccaagatggtgaaaccatgtctctactaaaaacacaaaaattagccgggcgtggtggcacacgcctgtagtcccagctactcgggaggctgaggcaggagaatcgctggaacccaggaggcagaggttgcagtgagccaggatcgcaccactgcactccagcctgtgtgacagagtgaaactctgtctcaaaaaaaaaaaaaaaaaaaaaaaaaaaaaggacaggcacagtagctcacgcctgtaatcctagcactttgggaggccaaggtgggtggatcacttgaggtcaggtgttccagaccagcctggccaacatcatgaaaccccgtctccactaaaaatacaaaaattagctgggcatgatggcacatgcctgtaatcccagctactcaggaggctgaggcaggaggatcacttgaatccgggaggcagaggttgcagtgagcagagattgtgccactgcactccagcctgggcgacagagccagactctgtctcaaaaaaaaaaaaaaaaaaagtttcttgtttctcgatgccgcctttaaagtgtagtgtttggagtggccgtgccagggagtgtctccacctctctttcctcacccacagatggttctggggaagctgcatcacagccgtcacttgtattgagctcacgtgcaaccaaaaccctttatagagttgggtttttagctgtgtctagacgcttttatgctgaattcttgaacacacatagactcagctggactcttttacgctgaattcatagacacagctagactcttttatgctgaattctaaattcttgaatttaagaatcttaaaattcttgaattttagacccaaaacagtgccaaatattttatctttgtcacattttctttctagtcagagctgacaggttgttaaatttaagaattttttgaatactggttcttttctattttctatttctgggtatgtccatatctgtatcaactaaaaatgtcccaagcctgccattactaccagtcccttagccattaataaagacatgcaaccagaaatgattgaggacagacctgctgggcatctcctgtccaggttgacactgattatttgatcaataattttgaaagatggattgtgtataagttacaatatatttgatattttgtaaaaaaaaaaaaaaaaagactcagtaagcccaagaatctaagaaaattaatactaaataactttcccaaatgttgacataagaaaaaattatacctgagaaaagcattattaatgtatttttaaaataatttatttaaaaaaattattgtggttttcttacataactagcaattatctataggctttgagaaaaatgagtcaaagcggaacacatactcacattactatagatgttttaattcagctgtaaacctttggaggataatgaccttgttttgccctatgtgcgtggggcagagggaggcaggaactcaggcctggaaggaacctcatgatagtgttgctttttcctttttccaacaaaaagttagagatgcatgatcaataaaataacaagcatataattgcattttgaggtaagtgagcagatgctgtgttgctagggaattgttgttgaatgagtataaaatatgaatttccagaaagttgtcatgtaggtaatatctgattttattggcaaggaaattctcagtccctgtgaagtcatcattaccaagttttgagaatttaatagggagtcaatgtatgcattggtgtgtttctttcttccttctatttcaggtactagtctcatcttttcccagaaacgaaggttggtcagaccatctgggattagaaacagacagcaaaagtgtccctttaacctgaggacactacaggaaaggtctttctttcctttgggcattttcttcatgattgctttacccctatactcatgctactgagctctctcctttccattttgtgaataaactgggactgaagataagatttggaataaatgtgtacttattatcaaaatgaatattttatctcttgctaattcgtagtaatttgcattggttagttcttgaagggaaatgatctaaaaatgtaaagatttatgaatacggaaaaacatgaactattatttcttttaatgtttccctttagtcaactttaggaatacaaaactgagttgttttacctcccttaagttttgggacatgtgattccagctctgttcctgttgatgacagaaagtcacattcaaatctcttgatatcatatctaaaaatcctgatttgtggtcaggcacggtggctcacgcctgtaatcccagcaatttgggaggccgaggtgggggatcacctgaggtcgggagttcgagaccagcctgagcaatatggagaaaccccatctctactaaaaatacaaaattagccgggtgtggtggcgcatgcctgtagtcctagctactcaggagactggggcaggagaatcgcttgaacccaggaggtggaggtaacggtgagccgagatcgccccactctactccatcctgggcaacagagcaaaactctgtctcgaaaaaaaaaaaaaatcctgatttattacagaaaggtccagagcaaaagcagcattttgaacttggtgtatggttaactggacagggatgtggatctgaaggagagcagagtatttgtactagcaaagggacagaaaggacaagttcgggtatcaaaaaaataggtgattaaaactataggaaaaaaccataagggtatgaattgccttgtaaagaaaccattttgagaaggagagcaggaagcaaaattagttaagaaggaatgtttttaagacaaagtaagtattcaacagtaaaaggaaataaaaggtttattgaatgttcccaacacaaagaaatgatgaatgtctgagttgctggatatgctaatgaccctgatctaatcatcatacattgtatgtattgaaacatcactatgtaccccataaatactcataattattatttgtcaatttaagaatattttaaaatcacacaaaacacaatagcagcattattatgtgacaatatactcccaaaatacagaactagtaagaaatattatcaatagacatggcttcaaagaaatagaaattgttttctaaaatatagactttgggcagtaaagcattgcagattgagagaaaacattctttttcccaaagagaagacaatttccaaataagatagtgtccataatgctttgtaactagtgggtgcctcttacgctatcagcaaacttagttccagttcaccctcctcaccttccacccagagactttagggcatgttgctgggggtcaaccttggaagatctctgcatttgaagcaatctactgtctccctgggatgggccgctttctcctttgagtggccgtaacccagcccagagctgctttcgcagaggcaatcaagctatggaaagccctgctcattttgtgttttcagggttgcctttgtttatctctaattcttaagggaaaatgcttctgtaggctcaatgagaccgagtggaaaccatagccaagtcctacagcttttgtagtttctgtgctggggagactacagatctatttggaaaaatagaaactgcattagatcaagctataactttaatatttatgaaaaagctctaattgttgactctctgcagctgaattctacattaaaccctgtagacagggtttataaaatatacatgtacaagttcatataataaggattatttgataatggtaaaaaattaaatgagtattcaaatataaacataaaaatatggcattttctcttctactctaatcctacagtgctatagtaattttttttccttctgaaacctttatggaaaccctaattaacgtaagtcaactgttcaacatctaatattgttgaaaaccttaagtaggaataaaattaagcatttatatttaagtacagttgatactttaaaaaattcttacataaaatctttaattatgatttgctttgtgtatactggcttctgcgatcataaaagaaattacttaactttgccatctctaaaagaaaagtccagagttggcattgtttccagcttatttttcaagacaacaaaaaagtaattttggaaaataagttattttagaaaataaaatataacattttttagaacctggagttctccaaatagtttgttctttcgagaatatgattgagctttctttgccactcaggttcaaagcactgggaagaagtgaaaacaattcaattattggatgcacatttttgaaagggccttacattgctaaattcaggagttgccataattctatgtcatgttgcaagcaagctaaacatcaagagaggtgttgtaaccagctaataattataaataatgtgtgaatactgtcttttttttctgattcctgtgagaaatcagaaggaacaattgcaaggaaatatgaaatcatgttcttcaaatccttcgactctgaaacacagataagaggactgctgacatgtagggaccaatagaatgacagctcgttgcatacaaagataaaaaagacagtgagtgactttggagttgtgttgccttctgcagccgagagaatttggacccaactgtcaaatgactattttttttagaggagtgtaaatggtgagtgtgtacggtgagctagtggtatggttcagaaggaatctgcagatgagctagtggtatggttcagaaggaatctgagcgctaataaacacccactttcccagtaagaaatgtagtgtgctgtgtattagaaagcttcatagactccagaaaaattcaaagaactaaacatgaatcctcctgtcagtaagtccaaggaaacctagactatttcatgcagaaatagcacatttataccgagtatcacttatcacttacagattatgttctcattcattgtcttgtttttaatcttcaaaacaatcttgaaaagaaaatccttgagagttgaaagaaatttaagtgacttggtaaattcatatggaagatggtaaaacattattgtcaatgtgctgcgtcttgcttaatgaatttcctcaaagttagagacagtgtctataatacttgtccttttaagctaagatcataaaatcaaccagtaagatgataaaatatgtagcaatgtatctaaatttatcaagctctgtaaaaccctaggatcaagcagtagcttggagaggtcagaaagctcctgagcttgcaccttcttaagaagaggagaggggaggggaggggaggaagggaaagaagagaggagaggagaggggaggggaagggagtggaggggacgggaggaagagagaaaagagaggagaggaaaggagaggctttagcatgaagcctctggatgctcagattctgctgggaattttggcagcgttatggaaggtccatcacaatcttgaagagaggctttcactatataccaagcatggcttagtctgaactggttcatctggacccaactctagccaactctagtgtgtctcatggtctggtgtgggccgagggcctccaggcctccagagccagccctgtccacaatttggtaatattccattgtttccttacagagctcaagattgcaaaccccaaggtgagaaatggaaaaaagtaatgggacctttaagctctgacgttctatgttcctacagcataagctggtggcttctgcgggtctctgcagccacctcagggcctttctgctcttctcaagagcaagagaagcagaacttcttctcttgcactggaaatacctgtggggtgtgtgtgtgtaagatggacattgagtgaagggacatgagcttcttgaatatcatgttttacgcaaacaaatgtttctgtttttttttttttttttttttttttttgagacggagtcttgctctgtcacccaggctggagtgcagtggcgcgatcttggctcactgtaacctccgcctcctgggttcaagcgattctcctgcctcagcctcctgagtagctgggactacaggcgtgcaccaccaaacccagctaagttttgtatttttagtagagacggggtttcaccatgttggccaggatggtctcgaactcctgacctcaggtgatccgtccaccttggcctcccaaagtgctgggattacaggcttgagccaccgctcccagcccacaaacaaatgtttagcattaagtattgtgtattaattaaaagactaagtctttttcataatagcttagagctcaatagaaaatacaagcaagaaatgatgagtacattcgtggttgcttatggctagaagagggaggagggatagagtgtgactcccaatgggtatgagatttttttttttctttcctgtcttttctttttgaaacaggatcttgctctgtcatgcaggttgaagtgtgtggtgcgaccatgactcagtgcagcctccacctattgggatcaagtgatcttcccatcaggcctttcaagtagctgggactgcagtgcacaccactatgcccagctaattatttactgattttttttttttgtagagatagtctcactatgttgcccaggctggtcttgaactcctgggatcaagcgatcttcccaccttggcctcccaaagtgctgggattacaggtgtgagtcactgcaaccagtctgggtatgatattacttttggcaaatatgaaaatgttctaaaattaggtaatggatgcacaactctgtgtactaaaaactcttgtttcccactttaagctagttgttgtgctttgtgatatgtaaagttcatctcaataaagctgttttaaacagaaagatgataaggacttcttttttttttctgaagcaagccagggtaaggtatttacaaattatgctgttctctttatctctgcaatgacttttaaatcttgtccattcttttcatccattatgtctgtgtcatagtttgaaccctcatccagttttggtccaatacagatggtccccgagttatgatgtttcaaagtatgattttttgaccttatgatgatgagaaggtgatacattttaagtagaaacggtacttccagtacccacacaacctttctgtttttcaccttcagtgtaatgttaaataaattacaggagatattcagcacttcatcataacataggctttgtgttacctgattttgtccagcggtaggctaatgtgagtgttctgagcatgtttaaggcaggctaggctaaggtatgatgtggtaggttagtgtatgaaatgaattttgaacttagtgatattttcaagttatgtgatggatttatcaggatgtaaccccgttgtaagtcgaagagtgtctgtagttacacagaaataataatatgtggttttggttggtttctagttgtaagttgtaaggccttttatgcagactgctgcatttgactttaacatggttttcttacccccgttctttctcaggctttcctaaagcacagttctgatcatgttatattcttactgaacacttcacatggttcaacattgtctacaggatgaaatgcaaactttttaacttgatctatgattctgtcttttttgtcttatttttcacatcatgatcttactaagccacaattcatttttggcatacaaaacatcctggcgttgacttaaagtatactccacttttccacttctctgctttttgcccttctcctaaattcaagctgtcaacatttcacccattcagctcaaatgcttcctcctacatagtcttcaatcgcacgcagcagaattacagccttgaaaattacaaacttctttgtattttaattacttgtctatgtgcttgcctttctactctgcctatctattcaaattattgttcagttgaattttcaaattaatattgtattgtaagcctctttatttgtaattatagagaaaatagattcttatagaaatgatgaagagcaaaattccatcagagccaatacggaccttcggtctacagggaagaataagtaacagatttccctcgcccagcacaagatcgatggctgagaccccaacaacagaagacagactaacaacagaaaaacatagaaacttatttaatataaattttacatgacacacgagccttcagaaatgatgcaaataaacagggagtctgtattttttggacggttgtgcaaaattggactggaggacaaagggaatggtctaatggaaatagacaggggaggctgttcacattcctcttggtgtcctcatgtcacgtgctttcctcccagatgtaggacaagccaggatgctctcccaggaggctcttcaggagagaggggagggagaaggtcagagagtcaccttcccaggtttcatggctgctgcagggagaaagggcgaggggaaggtgagcaaggccttcctgcttctgttgttttctcaaacgcccaggcaccatgttttggggtggcatgtcctgaacctggtctggcctcacctcactataggctcctgtttcttttcttttttttttttctgtttccgcctccctccctctaaacattctaatttaccccaagctctcttccccagaactctcgtgtctgacagagctcgaattctgtcaaccaggctggtcagctccagactctgactaatgaaatgcacttgttattaacttatctccttcaggagcaactctcaatccatgactgaattgtacagatggaacacaggagggtgagatgtctccttgctggaaactgcacagtgtgaaggctctcgggaattgctttatggaatcagactccttcgttccttcgtgtacacctcctagatgcatttttacagaatcagactccttcatgtacacttcctaggtgcattttcctggagctcatctggagtccaggcctcagcttctgttgtacaatgagggatgataatggcagatacttagatacttttgagaaggccacctgagacgtgattgccaaaagcaagtgaggatgactgaatgagagaacggtgaatagcagttattttaaaatttatttttaacatccctacatttattgcaactgattcttgtaggaccacaaaatgtgaaacggatttcaaaccctagcagtgcacaggaatcatcctgtaaagcctttaaaagtacagatctggccgggcgcggtggctcacgcctgtaatcccagcactttgggaggctgaggtgggcggatcatgaggtcaggagatcaagaccatcctggctaacacggtgaaaccccgtctctactaaaaatacaaaaaattagctgggcgtggtgacgggcgcctgtagttccagctactcgggaggctgaggcaggagaattgcttgaacccgggaggtggaggttgcagtgagtggagatcgcaccactgcactccagcctggcagcagagcaagactccatctcaaaggaaaaaataaaagaaaaaaaaagtacagatctttgagtgatcacttttagaaggtccagggctgtgacccgtaagctaatgttttcaaagcttctcaggtaatttagaagtaactggtccttaggttgtcacgtgggaattactgattcttccgtacatatttagtaacatctagagtattctgatccatgagaatattgtctagatttcagagcttctttctgaaatttaccgagaatgaaactctcctgaagataggctttagatctcatcctatgatagtctcacagaaaagaaggtagcttgatggagagtttatggatattctacaacagaccttaatccaggtggtattttattttattttttttaattttttgagatgacgtctcacactgttgccaggctggagtgcagtggctcgaactcggctcacggcaacctccacctcccgggttcaagccattctcctgcttcagcctcctgagtagctgggactacaggtgcctgccaccatgcctggctaatttttgtatttttagtagaggcagggtttcaccatgttagccaggatggtctcgatctcctgacctcatgattcacccacctcagcctccaaagtgctgagattacaggtgtgagccaccgtgcccagccaatccaagtggtatgtcaaatctagcctaaagagctttaaacatttttcatgcatttatttaataaatatatatatatacacacacacacacacacacatttgcatacatgtatatgtctacaaacatatatacatatacacatatacatatataaatgtgtaaatatatacatatacacacacatataaatgtgtgtatatatatttattaaataaatgcatttttcatccacttattaaagatatacacacatatacacatatttgtatatatgtatgtatatatatataaaaatctgcaattttaaaaaacagcacaactggaataaatgtagacatatagtttatagtactttgtaattgtaattaaatactttcttcagaaaattgcattaaaaatttttttatggctgagtgtggtggttcatgtctataattccggcatgctgggaggctgaggttagaggatttcttgagcccaggtgtatgagaccagcctagacaacatagtgaaacccatctctacaaaaatttataaattagcctggcatggtggtgcacacctgtaggcccagctacttggaaggctgaggtgggaggatcacttgagcccaggagatcgaggttgcagtgagctgtggtcacactactgcactccagcctgggcaacagagtgagaacttgtctcaagaaataaacaaaaattatcataatatgaaagtattgataatttaatattcttttgttttttaaatggtaggataataatgtgatttctaacttgccttaccttcgtgtccactgctttaaagacagaactaacatgaggagagaaattagaaaataataaagaaaacgaaattcataaattaaaacatgaagacattatatctgaagggctcttagattgtataagtcaatttttccctagaatatgaaattcttacctatgagaatgaatgttaatgtacttttcaaactaactttcaccttacctttagatgaccttatttcatcagaaaagaagtaaaaaccaattcttactcagaatagtttgaacttacacttaattatcatctatgctgttatttactatagatttcatttaacacagatttttaaatgattattataattggtttcatgggtgagtttattttataatgagtaagagaaagaaaatgtacccctattttatgtcaaatatttttatagtatataatatcttcaaattgtaaatgaatatagagatttaaaaatgttaatagcttctaaggctgggtgcggtggctcatgcctgtaatcccagcactttgggaggccaaggtgggtggatcacaaggtcaggagatcgagaccatcctggccaacatggtgaaaccccgtctctactaaaaatataaaaaattagctgggtttggtggcaggtacctgtagtcccatctacttgggaggctgaggcaggagaatggcgtgaacccaggaggtggaagttgcagtgagctgagatcatgccactgcaatccagcctgggtgacagagggagactccatgtcaaaaacaaaaacaaacaaacaaacaaacaaaagttaatagcttctgaatcattataatttctcaagtgagtaggaatatatttttcttcaaagctcttgcaagattttctgccaatacatgatttagaatttcataatcaatatttattgtttagaaaccctaaaagactgctttcatatttaattttttgtttctgtgattattaaattatttgcctttttaactaaaagaaaaaagacttactcctttttcttctaggtactaccaaaatgcttttctgggaagaacacaatgtacacatccaaactgtaatcagctattttctcttgtgcttgcggcttttcagagctggattatttgacgaagtacatgctgagggctccatcagagcaatagagatagagatgatagagatggagagagatagctacctctgtctaggtgcagatataaatgatgtagatgcagatataaggtgttccatgaaagggccataaatgcaaagtggtcccctcaaatgcaaggaaccgaagaaagaggcggacaaatccagtttgcccataaaggatttattctatttatttgttagagaagttaaagacagaagtgtggtcttgggcaaccacaagacagctagatctctgcactaaaatccccaagacccagaacttacatcatgcggaaaagtatgtgtgttctggaagaatgtgtaggtggctgagagaatgctgtgggcaccacagtctatgagggacacagcaacaccaaggctggttttggaggaaaggcgaaacttacagtaaataggtccttctacaaaaagggtttacatcaactaaatatcttggaggcattccggggctcgagattcatcaggaggcacgtggtggattagcatctaaaatgaagtcactctcgtccctatacagggaataatttgatgcttgatgtcactaaggcacccatcatgagtaagatcagtaatacggaactgacggcattacatttgttctacagagttattaatctagattcaaaatttggataagagacaatatcatcttttctgttcttagagcctctctgagcctaattgggcccgagttgagtgtttccatttcagaaattgtggtgtcagcatgctcaactataaaataaactggttctttatgcttttagtaagtcatacctcttgcaatttactggaaaagtagaaatgcaaagagctccttatgcaacttaatcagaagaacacaaatcagggtcttttaatgaaggtttaagctgagctttgacatgcgaattaggagacaatgcagtaatatctagtatatcttaagttttgatatttgaaagatgattgtgaaataatttttctagtttcattggcatatctactatactctaggcaaggggctggaatcaacaagcaaaaatcaacaagttttgctcttgaccatctcacagacttgtgtttctttatttttttctctatcaagccaagctctatatgaaggcaattttatgatgttgcagattttatgatgttgtgcacttactttaaagaatagcctttacaactcttgagtacactcaattatatttcttatgcccactgaagtttttaagtacctaataaaaaatagtgtatcagaagaggtggcaccgtcaggaatatttcaccagtattaggccaatgaacattagctgtcatgttttcagcattatgtggagagctctgagtcaggtgcacacctccaaaaaacctggtgtgaatatttcagtctcagcaataaaatcacacttcatgtgttacgcataaaggaagatttattaccttcatatcctcttattaatttctttctttcttacatcaggtataattccatacctcagccctttggccttaaagagtaatttaatctattagcccagaaaaccttttaagtcaatccttgacatggaaggaaggcagatatttctttaagggtctggtgtactagaaggtcagtttctgtcacagatcccaggagccgtgcagctaaaaacaaaaccctctggtgctccgtcttttcgccagtacacgcctttaaataagaaacaagacaaaagagacagatcaacgctcatccctgggcttgagcctcaggaaaatggttttaagagaagacgcctgttagcgccagacaaaaggcaattagtgctcattcgggggacatcacgtggtgagggcatgtggactcccttcatccacaagccaagtacgaagggctattgctctgttactaacagggattcatctttaattattcacatttgtatttttttccccagtaggaaaataataatgtttttcatcctttcctgcatatatttattatttttatgtaaattaagagttacactacagagtttctcatgaagaaaaggaaaatacctaaaagatagttacattacaaagaagaaaacacaaatgtagcttcctgaatttttcatgaaaactcacccagaaggcactccatatttcagaaacaaatagcatgggggccttaggacacataaacaatataactgaataaaagaaatttcagaagtcttgtagtcctacaaatatttctctttttggaaaagatttattgaagcaaataaaatgataaaattatgcatgaattgaaaaatatagtgggatggaggaatagaacatttgtgatgattcttgataaagccacacaacataaggtatagaaagtttggtcaccagccaggcctggtggctcacgcttgtaattccagcactttgggaggctgaggtgggcagatcacgagttcaggagtttgagaccagcctggccaacacagtgaaaccgcatctctactaaaaatacagatagtagctgagtgtggtgatgggcacctgtaatcccagctacttcgaaggatgaggcaggagaatcagttaaactcgggaggtggaggttgcagtgaactgagattgcgccattgcactccagcctgggcaacagagaccgtgtctccaaaaaaaaaaaaaaaaaaaaaaaagtttggtcaccatccaagtaaagaaaaaagagaactaaatctaagaaagtggcagttaagtggaaaaggagaaaggttaaaaggaagtcatcgaaaaagagaaacagaataaaactagatgttttaaaggagaaaaaatagacagtggcatcaagaattgcttttaggtttcaagttgcaattcctttaagaagtactgtctgtgaataaatattttcaaagcaaggagaaaaaattaatttagagataagggccatagaaatgataaggtttgttttggttatgctgctcatatcaaaatatttaagtaacagtaatgagcaagtaggtagagatatgagtttggaggttaagaaataggtcctgatagccaggcgtggtggtgggtgcctgtagtcccagctactcgggaggctgaggcaggagaattgcttgaacccgggaggtggaagttgtagtgagcagacattgtgccactgcactccagcctggaccaccgagcaagactctgtctccacaaaaaaagataaaaaaaaaaaaaaaggtggggggaaagaaagagagagaggtcctgagattatgaaaaagaaatgagatctattcacaaactggcagcaccaacaatagagaatgtaagatgttggttgctattgggaactaagtgaggatgatagttgttagagcacattttaaaatatataaccagcatggcagatgtatacatatgtaactaacctgcacattgtgcacgtgtaccctaaaacttaaagtataataataaaaaaaaagaaaaaaaagaaaaatttacctgccctttaaaaaaaaaattacaacactgtctgaaataacagaaaaaaaatatatatatataaactgatgcaagaacttcataaatgataatgtccattcttcttacagaaatagtggaatggtcaaaattaaaactatcatgcagaatcaagggtgagttaggttcaagaaacaagggatgtttaccctggtcagatattgaagtcgatcgaagtgaaggctgagcaaagggttccagactggttattatcaagtatttgtagtgaaagtcactatgcaagaagtgaaagaatgataggattttgggaaagaatcataactactgtttcacaaggtttagtagcaagaagacaagacaaattgaaccttgggagactgccagcgtgaggaaaggctttgtcaggagacagagaaatgaaggcacgtttgtgggcagagcaaatgtaagaagaaaggcagaaatatggacaatgattaattaatgaaataagttttaaagaacagaaaaaaagggttaatatcgaagtccagatagtgagttaagcactaaaataggaaggcaatatgtctgtttttatcttttctttgagacagtaaaaaagaataagaggctggatatacgggatgcctttgtatagagaagatttatacagattatctggggtggtgttgatacacatggtcaaatgaaaaaatggagatttcaaacctgagaaggagaaaatagattaggatataaggagaaggaggaaagtcttttagacgatgaagtcatatcgaatcaggagacacatggtagtagagctacagaaataggactggacagtagggatctggagtggattagtatgagttttcttatccacttttctccagctgtgctaaaataggctgctagcagtgaagaaacaccataatgatcacagagttggggttaattagagtacagggatcgaaagtccaacaggtaagagatttgagagcatcagtgagaagacaattaaataaacttaatatggctctcacaatctaagttaaggagaaaagtgaagccagacagaggttgataaatcagaactataaggccagttcaagggagtagacctcacagtgagaacaaagctcaagttagttgctaataaaggcacagaaaaggtggaaagtaagatctattaaaaaagaaaatcgtaaaattcaaaatcagtaatactgatcaagcgcccattgtgagcaaaagggtaagcttttattgattcagaatgactaagaattgagatatctgatgagttaagaatgttaacttacaattagtgtttcatatataatatgtatataaatatatataatattatacataatattgatgtaatcactcctatagctaattaagtacatgatattttgccaggtcaactgttatgtttattagcaacagtcacgggaatatctgaaatgttggaaatcccctatcccaattcaatattaatgaaagtaacagaaagttacatctttctgttattatatatagttacatctattcttatatctatctttctgtatcaaatatttatctccctatataggtatatttttaatctgtatctttatacataaagtattctgggtaaactgcacagaccttagcatattaaattctcttcttcggccgggcgcggtggcttacacctgtaatcctagcactttgtgggaggccaaggcaggtggatcacttgaggtcaggagttcgagaccagcctggccaacatggtgaaactctgtgctactaaaaatacaaaaattagtcaggtgtgatggtgtgtgcctgtaatcccagctactcaggaggctgaggcacaagaacccgggaggcggaggttgcaataagctgagatcaggccactgcactccagcctgggtgacagagagagactccatctcaaaataaatcaaataaaataaaatctcctctcacacactaccatcttccctaacaggtgtgctaggctctagaagtttgaaagacagaggggtgaattacttctgtattcactcagttgtataaaccatatgtcctcatccattttctactactatacagaatactacaaactggataatttataaagaaaagaaatttatttggcttatgtttctgggggctgagaagtccaagatgatggcactagtatctgcttagcatttgattaaggtgttcttactacctcacacatggcagaagagcaagagagagagagagagtgagagtaagagaacaggaggaggcagaacttcaccttattttcaggaaccaactcccatgatagcccagttctgagataacagcgtcaacacaggcatacctcagagatatttgtggtctggttccacactacctcaataaagtgaatattgcaataaagtgaattacacaaaatttttggtttcccagtacatataaaagttatgtatacactatactgtagtctattaagtattcagtatcattacattaaaaaattagatactttaaaaaaatcctgttagctttatctccagaatatcttccaatctacccacttttctttatgtctatcagtaccgtcatggtctaagccaacagcgtgctttcctcaggctatcaaagtaggcttttaactggctcctcacaggagaccaaaatgaagaaaaagaacaataacaacaacaaaaatagatactttaatttaaaaatattttattggcaaaaaatgttaacagtcatttgaaccttcagcaagtcattttcattttgctggtggaggatcttgccttgatattaacagctgctgactgatcagcatgatggttgctgaaggttaacgtggttgtagcagttcttaaaataagacaacaatgaagctaccacatcaactgattcttctttcacaaaagactgcaccgtattctatgatgctatttgatagcattttactcacagaagaacgtctttcaaaattggagtcaatcctctgaaaccctgtcactgctttatcaactaagtttatgtaattttctaatttccttgttgtcatttcaaccatgtttatagcatcttcaccaggagcagatttcatctcaagaaaccactctctttgctcatccgtaagagtagttctttatctattaaagtgttattatgagattgcagaaattcaatcacatcttcagattccagttctaattctagttctcttgctattctcactacatctgcagtgatttttctccaccgaagtcttaaactcttcaaaaccattcatgacagttggaatgaacttcttccaaactcttgttaatgttgatattttgacttcctcccatgaatcatgaatgttcttaattgtatctagaatggtaaatccttctgagattttcaatttactttgcccagatccatcagaggaatgatccatcactatctatgggagatatcgccctacaaaatgcatttcttaataggacttgaaatttaaaactactccttgatccatgcactgcagaatggatcaagaatggctgcagaatggatgttgtattagcaggcatgaaaaccacatttatctccttgtacatctccatcagagctcttgggtaactaggtacattgttgatgagcagcaatattttgaagcacttttttttttaagcagtaggtctaaatggtgggcttaaaatattcagtaaactatgctataaatagatgtgccatcttgcagggtttgttactgtattcctagagcacaggtagggtagatttaatgtactttttaagggacctaaggttttcagaatgctaaacgagcactggcttcaacttacagtcattagttgtattggctcttaacaagcgagtcaacttgtcctttgaagctttgaaaccaggcattgactgctcttgctgtgaaagttctagatggcattttcttccaatagaaggctgctttgtctccagtgaaaatctgttgtttagtgtagccaccttcattaattatcttagttagaccttctggataacttgttgcagtttctccatcgacactgctactgcactttgcacttttatgttatggagacggtgtctttccttaaactgcatgaaccatcctctgctagctttcaacctttcttcttcagcttcttcacctctctcagccttcgcagaattgaaaagagtagtgccttgtgctgaattaggatttggtttaagggaatattgtagctggtttggttttctttcacgaccactcaaactttctccatatcagcaataaggctgttttgctttcttatcatttgtgtactcattggaaaagatttccatcagaagctttttgtttacagtcacagtttagctaactgcttgacataagaggcctagctttcagcctatctcagcccttatcatgccttcctcactaagcttaatcatttctagactaaaaacacttagtcacttgaaaagttagaggccattgtaaggttattaattggtctaatttcaatattgttgtgtcttaggtagtaggaaggcctgaggagaaggacagagatggggaaatagttaaatagttgtttgatgaagccgtcagtacacatacaacacttaataagttcagtgtcttatatgagcacaattcatggtgccccagaacaattgcaatagtaacatcaaagatcactcatcacagatcaccacaacagatataaaataaaaagtctgaaatattgcaagaattagcaacatgtgacccagagacagattaagcacatgctgttggaaaagcggtactgatatatttacttaatgcaggggtgccaccactttcaatttctaaaaaatgaattatctcaaaagctcaataaagcaaaatgcaataaaacgaggtatgcacatcctaatcacatcctaaaggcctcacctcttaatactgtcgtaatggcaattatgtttccaactgataaactttggaggaggcacattcacatcgtagcaccatataaatgaatgcaaagcaaaatgggcccaagtaggttgttgaaaaactaatgggtagaagggtcttggatgctcacattaattggaggaaaatgaaaaagagacagtaggataatcaatggcaataagatttcttgccatggaaaggtctaaactagatatgaatgaaaatccagctaaatgcaaagatcaggatcggtcttttcccttttttcccaaatatacactatgttattttctactttatgtctttggtacacaaagtgaaatatggcatgggttgccaaattttgcaaagtaaataatacatagaattcagaccctactggataaatacattctatttttaatgattcagaagggccctcatgaggatgattatttttatttgtttatttacttatttattttttgtgacagagtttcgctcttttgcccaggctggagtgcagtggcacaatctcggctcactgcaacctctaccttctggtttcaagctgttctcctgcctcagcctcccgagtagctgggattacaggcgcccgccaccatgcccggctaatttttgtatttttagtagagacggggtttcaccatgttggccaggctagtttcaaactcctgacctcgtgatctacccacctcagcctcccaaagtgctgagattgcagatgcgagccaccatgcctggccatgatgatgatgatagattccttctcagcaatccagaggaattaaatctagtctatcttaatccatgtttatcaacctgtattgtgtaattcaattaggcacttaacattagaaacttataaaaacaaaagtagcataatactcagctgtgttaagaaaaatgtgatatcaactactcctcctttattacagtgactcagaacacccgtgtccttcccaacattggatgcaatgctaaagacatgatgttgctcctgctggaccacaccttgaaggaattgcctaccccacctcacctccaaaattaaagtctttcgttttgacaaaagttaatgataaggtttgatgtgctaatttcagcacctccacttcatgtctacactgtggacatatacttttttgttgttttggggtttttgtcatgtttcactcactttctctattattctttatagcaggacttgctttagagtcattactttctgttaaagttgttccttcaaaagttgacaattactggctgggcacggtggctcacgcctgtaatcccagcactttgggaggctgaggcgggtggatcacctgagattgggagttcgagaccagcctgaccaacacggagaaaccccgtctccattaaaaatacaaaattagccaggcgtggtggtgcatgcctgtaatcccagctactcgggaggctgaggcaggagaatcgcttgaacccgggaggcagaggttgcagtgagccaagatcacgccactgcactccagcctgggcaacaaagagtgaaactgtctaaaaaaaaaaagctgacaattacttttcattggcttcttcacacctaacacctatcttttcacacaaggcagaaataaattgctattagctaatctgctaaatccacttagaaatataatcaagaaaaaggaaaacatccttgtgtccaaggcattctgatttgtaaaaatggtttgtatgtgtcatttactcaaatcaactcatttcaccaaaagtactcagaaacataaccctaaacatatgtgtattccatcccaaagtttttcatgtagtcagtatttttgtatagtcacattataaaaatattttatttaatagtgttgttgatatattagtatatagtgtgagattcagatacttaaattttttgaaaacttgcattcattaacatatcaacatatattttctccttttatttacattaatctgtgatatcaacatgagagcaagaattatattgaaatttatatttttcctggaaagaaagtgaagttctgtgaacatgagtaatttgctcaccaccatctagccagtatgtctgtagaactgagatcaaaatccagttcttctaactctttctattttcaaagtagagattcctcctaatgccaaacaagagttccctggctctgttttctatcctaggaggtgattgtcttaatgattttgttttaaattgtatcttttttcagttttatgtgcagaggatataacatatacaaatataattcatggaaacactcaggttgttcagagttggaatgtcagtgattttgttgttttaagcactatgacgtgtaggagacacttacatatactaacagtatagaaaggaatgatcttaatattatattaattataattaattaacaaatttgcataaattttactaaaagtatgacatcagccaacagaatattagtagtcaagtgtgcacattggtgtcaaaataagacagtttctagcctcaaagagagtagttaggaaagcatcattatatacacaatatcatatagtatatcatatttctatagtgcttacaactacaaagcacttcccctccttttcttcctactcaaaatgatcttgtgaactaagcagggcagggcttcattctattttacagataaggcagccctagatcagaattcatggcagacattcaatcttcaaacacgtatcaagagactgctatgtgtcagcagtgatttgggggcactgggcatgggaagctaacaccagtagggtgcctcccacaggcttccagagtaagggagaagaaggaaccatcatccgtcactgggaggctgtggtgactgccataccagaggacaagggaggcagaaacagtctgaaggctcaaccgtgaacaatgtgtgtctttgaactgtgaacccagtgtgtctgtgtttgattccagtgcctttttcaggagcaattgagtcacaagccatgagattctgatgataaatgttactggaattcagagaaggaaagaacattgggatgtgctggaaccgttagagtaagtgaggttcagtgttggctttacaggatgggttagtggttggatagctacagggaaggggaagcattccaaagaagcaaattacaaagcaggagcttggcgagagacagtgggtcttgctatggtggttaattctgtgtcaacttaactgggttaagggatacacagagagcagataaagcatcgtttctgggtgagtttgctggggtgattctggaagaggatagcctttgaatcagcagatcaagtaaagatttgccctcaccaatgtgggcaggcatcatcccatccattaagggtccaaatagaccaaaaaggcagagacaggatgaattctctcttcccttcagctgggacttccatcttctgcctttggagatcagagctcttggttctcggatcttccaactccaggatgtacaccaacacatcccccacttccccacccaggctctggctcagactgggatttacatgatcagccctcctacttttggactcaggcagaattacaccacaggctttcttgggtctccagctcacagagggcagatggtgggtcttctcagcttccatgagcatgtgaacgaatgcccatgttaatgagtgtgtgcatatgtatacacacataccgatagattagatagacagatgatagatgatagacagatgatagatgatagacagatgatagatgatagacagatagatgatagatagatagatagatagatagatagatagatagatagatagattctctggagaaccttgactaatgcagttgggaatgaagtgagttgtcaaatctgacagaggtagtgtatgtagactgagaaaaattagaaaatgaagcttcaccagtagaacggcacaaaattataagtgaccattaaggctgggagagagagtttgatctttatgcagaagaaaatagggtgtggtatgcagaagggtggcatgacaatatgagtgatttagaaagcttatcgcagtgaaagatggattccagaaggaatgggtagagacagatttatcagttaaagagctgctgtaacattccaggcatgaagggtgaaagtctgagcttcagcctcagtagccagactcgagaagaaagggtaaattcaagagacactttagaagggaaaatgatgagcacagtgacagactgcctctagcgaatttcaaaatggcaagcatcaaacattactcttctctttgtactcattatgcttttcatctcattgtactttccattaattctttatgacgtgtcatttgagcaacaataatttaaacatttaagaagatgtgtgactatcattttctgagaagtacaatgagatgaaagatgttaaaagtacactgcatatagtaagtgctcaataaatgttcatgaagaaattaaaatttaaaattgctaacatataaatcctttcagagataagttttgggatctagagttgtcacacttgagttatacaaagcttgaagtcaagaacaaagaaatgggggttttaagcagtaaaatgttacaggagactgctttggaaattcaagaaaagaaattgatacaaacaactcgagagatgatatattaaaatacaaatgagaagtatcccatctaatttttataccagaggtatactattgaatcagcaaaattatgaaatttttatggattggtagtactagaatatactcaagagagctcagaaatgaaaacgtatctgtctagtgacaaaaaactaaaaatgaagttttatctctgtcaatgatttgtatatgataatgactgtattattattatgaacaaaagctgaataaaaataaagatattattaggtcacttcatgaaattaaatttttgaataacaagttaattataaatacaaatcttccaacatttttcgatccagatgattctcacaaaatttagagacaaatgtgttgtgcactgacttcacaattgaggaatggaatcaaaatcattgctcaaatgttaattataccattttgcttgttcagaaaaacatatctcagtaaaatctgatatttataagtttataaaaatattcacggaaattttttacaaagaaagaaaagccaacccagtcaatataaaaatattaattttataaataagaagtttgcctcttattcagaaaaatgtttttccccagaaaaattttacttacattaaacatcctaagcaaacagctgaaattgttttgaaacatacaaaatattgatgcgatgactgtctagtaaactagtttatttggaaattttcaatcatgtcattcatatagattctgaaattaaatacagaaaaacatctccaatgtacgtacagtttatgcactgttaggaggttttttctctgtgggaacaccatagggtacccttacccaaacctagatggtatagcctactacacatctgggctgtatggcatagcctactgcttaggcaatgagcctgtacagaatgtcactgacagcaggttactgtgctgaatactgcaggcaatttaacacagtgtaaatatttgtgtatctaaacatatctattataattttatgaaacctctattacatatgaggttcatcactgaaacattgttatgggaaacatggctgtatattcccctgaaatcattaattttcatcatttatatgctcagcatcatttatatgctcatttatatgattttatagagttgttcagatttagttcatgaatgctttcttcggttgcatcctacctaaacctttacagagattcatagctggaattaatctgatttttttccatagtacatgtttatctcctttacagcacttatataacaatgctgctatagatcagccttccctggcatgtgtgaggaattcattcagtatttgttcaataagcaatacattgaactttgaacacctcttctttcttctctggtaccctggatacggaaggtgctcagaaaattgattctaatctcttcatatttttgcagccctcagcaatgttaaataacgtgtttaaaatgagatacataatttagggttaaacttcttttttacacatattagaagtattttaaaaactaaaagagattcaaaccgcaatcaaatttgcctttgttttactaaatgagaaatgctaatattaggtttatgataaaaatattttatcaggaacaacagtaagtaaataatttttttaaaattttgacatcacttgtcctaatgttatatcagaaatcttatctaatctgttttttacctgccattgttctctgagaggaatacttgacataatgaactcaaaatacgactccatgtttatttttgtgtccttcctcagttttacttcagtgctcaagttgtttgtctctattttaaaacattttctttaaataaaaatgcgtgtacaaatcaaggttgaagctagatgcatctttcagtgatcattgactttatctgtgtctttatcaagaataaagagctagctaatgtcagaaccagggtttaatttgttggccggggcaggggtgggggaggctctgttttttcctattaaaaaatccaacactgaagtatcctcctgaatacgtacattgatatattgtgtataaagagaaaaatgaacatgtaatttgtctcctttaaaaattgacttttttagtataatgacacacacaaagtgcaataaggcaattctcccgaatgcattttctttgggcagacagatgtaagatgacttcaggagcctcaataattcatgcagcttcctatattgtcttttacattcataacactttaatctattgttccattgtcttgcttggccaatatagagaagtgatgactgaattcggtttgaagtctcagtcttttctcaccctggttttcttgtttctattctcccacaccaataaatacgtgaaacctaataaggataaaaaaattctgttgagagtagaacgatattttaaaaacacgaggtgtgacttctagagataggtaagtttagacacatgcgtgctgcatgccaatggacttgttatgctcttttttctcttcaattaatcagtactagaattataccagagacacatcttatagccagtttagtgacattgcttgacaacgctcacatacttactgaacgaagtttataatttttcatcctcatagcaccttctatccttattacaactaagtatgtcagaattgccttattatatatcacacacgaaaaactaattctaagagaagttccatcatttactcaaggtggcaggattactgtcttaatcgaaatttaaactgaagttttctgattaaaatcatgtgataatagcattactctctgggaactcacctgtcagaggtaacaacattttgtagctttcctaaagattttttctcaaggagaaaaatttagggttctagatgaataagaggttacatcttaataaccttcaacacatatcacctgtctctaaaaataagcctgtaattgtcagactcctgttgattaatttcctttgctgggaagacttgatcccattttcattgcttccctgctagcaaagccctgttcctgtcaaatcatgtgtattacagtgcttttgatttcctctacaattagtctagttttttaatgatagcggtatgtgcccatgataaaactgtagtctgcaaaataggaaatggtgttaagaacaacataagaagacttttgtttcccctataattagagcggtccaaaatggaataggctttctcctaaaagaaatatttataggtgtgctgaagctggtattgtatgacggcaggtcagaatggcaagaagaaaaatcctgcatcgactgaggggtggatctagattagtcttttctagcactttcctcgtaagaatcatctagggagtttgttaaaatacattttcccttggttctggctatctgtgtgtcagctagatcccgaggtcatttttacgatctggaagttttgacaatattgcctcggcagatgactaacagaacttccgcctcagcaaaagtctttgcactggggctaggaatgtgtcaagtgagagcttttgtgttttgcgttttttaaattagtattatttttattgacaaatcataattttatatgtttatggggtacaatgtgatattttgatatataacaatgtgaaatgattaaattgagctaattaacatatccatcatctcgtttaccgatcattttttatggcgagacgtttgaaatgtactcttttagtcatcttgaaatatacagtatagtactgactagagttgttctgtcgtgcagcagggggagggagggagggcatgggaagttgttgaatgaggggtacaaagtgatagctttaagttgtgattaagctgtggttcctagctcgagggttgaaaacagttgatggactgcaaagaatataaggcataaaaaaaaacgcaagaagatatagaaaaagaaaggaaaggattgaaggggtgggagaaggaagaaagaaatgaatgtaaggagaagaaaacatgaagaaaggaagagagagcgagaaaaaaaggaaggagggaaggaaaagctgagctcagatggaagaggggtatttaatgctcgttgaatgcatgtgccaaatttcagggataaattgggcagagtagaaaataaattaaatatgactcaaatccatagtaaaatataaactggatcccaggccaatttttttttcttttcatctactgtcagaaaagtaaagtttttgtagtagggaaataaggaacatttgatttttataaatctcctaaaacattaagaaatttttgagtttgaggtgaactaggaaaccaaatatcaaatatctgtctcttttgtaattatttcttgcctggctctcaacctactgtcttctcttttttaattaaaggcttcctgggatacatatgtactcatatttggtcatgatatcttttgatacaattataattcaaataatttaaattatcaaagaataatttccatttgtagagatgctgaacagactctaaggatgaccgtatgttccaaggcagacatgatccacacccaaaagcgtaaatagcttatatgagcagctcttagaatgacagccatatgcaataatcagctggacacctgtctctttgtgtttgcatacagcaaaatatacttagggagcatttctacatcacaaaaggaagttttattcagctttattatcaatgaataatatatcagaatacagtttgcatagtgccactcataccaaaattacagtgaattttcctcttgagatgactcagtctcaataagagatcatttgtctatatacatataacctgcacagaatgcaatttttgtgcataaatattaaatcattatgattcattttgtttaaggaactaaaaatacagttaaatctattattgtgcctaactataagagttttctgactatgcattacaatgtttgaatcaatataattttattatatgtatgttgttatacagtttaaaagtatgttagcttagagtatttaatatgtggcactcacagacaaataacaaaacgaagtccctagaaaatagcatgatattaaatgttttatcatgaataaaaaaatatttgaatagtgcttcatagaataattacctttctctgggtttataatattggtaaagtctaaagatcttctgattggaaaggaagataataatggtgtcttaagataacctcttgaatcttctcagaatcactcagaatgagacagaaatgctagagggttcacaacgagcatgctgttttgtcagtccccctcttcatccttaccatggtacagcagaaagttgctaaggatttctctcggtgaaatctgagctttgaccacattttgaagtcactccatatatacctttggaagaaatgccaaagacaatcttttgcaaaatttcttgtatttatttgtaactgaaaaatgattgagcagctattttgtgccaggatgtgggcaaggtattgagaaaaaagaaatgattatggcattaattatttttctccagcagttcacaatattctacaaaaaagagatactggggcaaaaccagaaacaaaactaaacatcagtaactaaatttttccacactaaagacacaaatgaggtaatatatacattaagacttaaaatttaaatacatccaagcccctcaagctttttcccacccagattatgccctctgcaaatcactctacagctgctgggatttgtttacagtggagctgggcacctagaactgttgtgaacatcaggtctggcatgtgtggcatagggtcagggccgtgcatgttcccttaggcttcgcatgctggtcaggatgtgcacatacttggccaagcctgtgcccagggcagcagtgtcctttgccctctgtgaagggctgactggcccggatttgttcagttcagcctgtttggtgagaaatctctcatggaccttttctcactggataaccacaaagagatgaatttagattatattctctaaatataatctacattataaaggagggaactggaaaaaggatgctggagttgaatttgccttccatctttttctacggtttccttgtgtcaaaaccatttctgtcctcatattgccctttcaaatgctaattacatttaaagtttttttcacagagcactttacagtttacaaaagtaattcaatgtgatttcatggaataggaaaataacatgttggtgtgaatatctgaggctttattctcactaagtacagggtacagatacagtaagtgaagctggtgaatatttgagagccgtgggtggtggtccgcacctgtggtcccagctacatggtcactaagtacagggtacagatacagtaagtgaagctggtgaatattcgagagccatgggtggtggtcggcacctgtggtcccagctacatgggagaccgaggagggaggattggctgagtgcaggcctggaaggcaatgtgctaggatcatggcgctgcactccagcttggcaacacagtgagatcccgcctctaaaacaacttaaattttttaaacaatgaatattttatcatagtaacagtagcaaattttaaagcatttattattgaccaggtatagtggtatagtgataagtaggtacatatattgttttatttagtgtttaaccctcaggaataagtatgcttattgcccttcacaggtgggaaaagcaaggcaaagagaaagtgaacaacaatgaaactaggaacgtaacccaagcgctcgtgccagagcgtgtatgctcgatcttgggaccacaccacttcccttggtaaattttcaagcatttagtatttgtgtgaaggcaatcatattgtgcagaggaatgaccaggctacaaaacacagtgtgtgggagaccgcttaatgctaacactaattctatgggtgacattcagatctataaaagattaagtgaatagagctgacttattgagaggggtttgttgtagtcgacttaaaaccaataaaagacaacatgatgtcttaaagtcacttcaagataaattaatcaacttataagcacatatagccattaagatcaattcactttacaaagattagaaaatgataaaggggcataaaatacaaacttactatctgagaaaatcaggttgtagggcttttctcctgcaaaatgaagtaattgtcagcaatgtccacttggtagaacagtgttttccactgttctcttcatagctttttctaatacgatagttaaaagaggaactagctcttcagacccaggcagttgaaaaccagctcattgggttccagctccacgggtccttctctacatgtttattgcacataataatgttcctcttggggaaaatatgctgcaatatccctctgatttattgtatttctacatattgttaatgtaaggactctggtattcaacaaagaaattatggcacatctgggtacacagaatattctaccttccacagaaaaggtcaggagagaaagaaaagagagaactgaaatataaacccttcaaattgaggtgaaatcctgactttgccccttggttggcatcatcattaatcactactaagcaactgcaattagaagagattaactggaacttagagttgctaaacaaaaagaaaaaaatagaaaggaaataaagctgtcttcctacgatagacaaaatcacagggccattttcttccattgatttttgctctcattaagatatattcatttactttccttttgaagcttgacgtaagaatcttgaaactagaattgtcttcaatgaattattttgcccattactcttcttatacagaggtgaattccagattggcttgggacaatgactgtttatgctttaaccatctccaaacgcaaataactagcaaaactctttatctcattctagtattaggcactccaagttctgcagcaaatattcactctgatgaccatatggaaaataacacataatttctgctttcttgtatcttaaaatcagaagatgaagccaaaacacaagataaataggaaatccaaacagtgaccccaaaattgtgttttgtgaaagaagaatagaaacacaaaagtggagagagagacctcattaggatgtgagtagcaaagggggttcagtgaagcagcagagcttccgttatgtttataagagggataacatttagagataaatcttaagatagagaaaaaagaagctgatgcaccaagaaagagaagaggagagcattagcatagtggtgcaggggctggaaccagcaccatgtgtttgtggaaacaaggaagacaggattatcagtcagcttctggaaggtatgttggaaagggtttcacaaatgtaaaagaggttattgataaatgggaagtatatacaccatatatttaaatacaatgtatttttattaagcagtgacctctttaaatgtaaagaatgtgtgctttctgacaaaggttgaatatccagcatcataaggaacttaaatttacaagaaacaaaacccataaaaaagtaggctaaggacatgaacagacacttttcaaaagaagacacacatgcaaccaacaatcccacaaaaaaaaggtcaacatcactgatcattacagaaatgcaactcaaaaccacaatgagacactacctcacaccagtcagaatggctattactaaaaagttaaaaaataacagagctggcaagattgtagagaaaaaagaatgtttatacactgggagtgagagtgtaaattagttcagccattgtagaagacagtgtggtgattcctcaaagacctaaatacagtaataccatttgacccagcaatcccattactggggatatatacgaaggaagataaatcattctattatagagacacatgcatatgtatgttcattgcagcactgttcacaaccgcaaagacatggaatcaacctaaatgctcatcaatggtagactggataaacaaactgtggtacatacacaccatggaatactatgcagtcatagaaaaagatcccgtgctttgtaggaatatggatggagctgcagaccattatccttaacaaactaacacaagaacagaaaaccaaacaccgcatgtactcacttataagtgggagctaatgatgagaacacatggacacacagaggggagcaacacacactggggccttttggagggtggagggtcggaggagggagaggatcaagaacaactactaatgagtactaggcttaaaacttgggtgatgaagtaatctgtacaccaaacccccacaaaacaagtttacctatgtaacaaacctgcgcttttactaaacttaaaaaaagaataaccacatgtgcccttaaaaaggaatgcacgccttatgcttagaattttagtaaaaaatggttaaacaggtggttttacatgcacacacattttgacagctaaatgagactaaaaggttgagtcctatggcagccagaaaacaactgtaattttatcttgcaacaataggaaaaaagttcatcttaaagtccacctgggatatcactattttgttttacaggcagttagacatgataataatcattcatctacaatatttactggtcatctactatagccaaggtacacaatttttgtaattcagaagcttagacaggtcctgataaaagactttcatacagacatatgtttatgacatatacctatggcatacatttataacatggtgtgtccggaattggtttcttccagtgggttcttggtctcactcacttcaagaatgaagccatggaccctcgaggtgagtgttaacagttgttaaagatggtgcgtccggagtttgttccttcagatgtgtccagagtttcttccttctggtgggtttgtgatctcgcttgacttcaggagtgaagccacagaacttcctggggagtgttacagcttttgtctggagttgtttgttcctcccaacgggttcgtggtcttgctgacttcaggaatgaagccacagaccttcacaatgagtgttatagctcataaaggtagtgcagacccaaagagcaagcagcaccaagatttattgtgaagagccaaagaagaaagcctccacagcatggaaagggacaccagcgggttggctgggtggccagcttttattcccttatttggcactgcccacgtcctgctgattggtccattttacagagtgctgattggtccattttacagagtgctgattggtccatttttacagagtgctgattggtgcatttacaaacctttagctagacacagagtgctgactggtgcgtttacaatcctttagctagacagaaaatttctccaagtccccacctgacccagaagcccagccagcttcacctctcaatagttataacagttaataagagcaatgttgaagatatgcataggtagaaaaagggggttcagtgaatttaatctgtattagggattgttaatgatgaagtatagtaattatatttagccaaatggaagagggataggtattctgcatagaaggcacaacatcaagctataggggcaaaaaactagtatttatgaagctacaaagagtttggtattgttggacataaagtagatgggaggaagaatgagactgacctatagaaaacataaagcagatgatggaaacctttatacaccagttaagggtttgcttcttgttgtctatgggtagccattgagaggtctaaaaaggggagaatcatgataatcgtagttggagagagataaccctgatggctggtaagaatgtagagagggaggctatttggaagttaagtaagaaggatggtcactcctaaggccaagatctccagcctcactggtctccttgttgttcctccaaccacacacccaccctgacttggtcctcctctttctgggacactcttctcccatttattcatggctagctcatacattctttaagtctttactcagttatgacttcatcagtgaggcctacactgacaagcccatttaaagcttgggatttttttttgttttttgctttttgttgtttgttttgagacaggatttctccccttcacccaggctgaagtgtagtggtgtgatcaaggcttatgccagtttcaaacttctgagcacaagtgattctcctgtcttagcctcccaattgcctggggctacaggtgcccaccatcatgcccagactccatttaaagttttaatctcctctacattcctaatcctccttatcctgttccatttatcttactctatcctgggtaccagcttctgatagccaatgtattataatcattgtttattttctgtcttccccaactagaattaagcttgagaaaggcaggattttgctttgttttcttggccaaatcaaactcaaaactcagctttaggagtgctagcacatattaggcattcggtaaacatgaacttaataaatgaagaagattaagatggaaggtccagttttttttttttgttttttttgtttttttgttttttttttgagatggagtcttgctctgtcacccaggctggagtgcagtggcacgatctcggctcactgcaagctccacctcccggggttcatgccattctcctgcctcagcctcccgagtagctgggactacaggcgcccaccaccatgcctggctaatttttgtatttttagtagagatggggtttcaccttgttagccaggatggtcttgatctcctgacctcgtgatctgcccgcctcggcctcccaaagtgctgggattacaggcgtgagccactgcacccagtcaatggaaggtccaatttaagaaacattgagactggtgaattattggatatggaggctaagagaaagagccaagaattgctccattttccagcatgggtgactagtgggttattatttccctaatggacaaagagaagctggagaaggagttgatgtagaaagaaggtgctgaattctgttttgaatatgtggagcttgtcatgcctgtgggatgtgctggcagatcccacagatttgtcccacagagatgtccctttaaagctcagagaagcagctaggatagaaaagaaaaatttggagtcatcagttcccaagtgatgtgaagaccctaaagtggaggggaggccagggagagtggtgcccgagatgacagtgtactaaggacaggattttaatgaatatcatgaataatgatagatgtatagtaccatgacctgtcaatagttaagtacatcttcctataagatgatttgggaagctaacttgtggtgatgacgtgacctgggacaatcccaagaggcaagggggttggttgaattatcacagtcctcacagctgctcaagcttctgtttgtgtgtcgccaattatgctgaaggatctagaaagatgtgccctccctgctcctcctcaggcttagcatgcactcagtggtttctgcagcaaagttgcaaactttaatgctctgtatttgtcggcagaaataagacccaaattcctaaacgcatttctaattaaactatttgattctcagctaattgatattcaattagcagatatccctaaaatgactaggacactggggccatgtagcgatgttctggaatgtgactttgaaagctgcgttgactttagaactggctacattcattttggctgaagaggtcacctagagtataggattaaaaggaaagtgtatttttaaaaatattatgcgatatttaaaaaataacatactttaggttcaatattattttatgactcacacatgccatatttgtgtgaaaatcaagaggcattctgaaatcattcgattctttttttctgcctgaattttttactttaaaaagattattatgacattccattagtggttttgacagagtgatattggattctcaaaatgaaagatgtgtgtgaaatatcagacttgtcttatttttgaaataaagacagtggcccctctcacctggaagagtgctgtctcaaacgattagatcctggcagacaacagagaacaaacatattttgattaaattatttttctattcaacctggtgcagtgcgtaacctctatgtctatggctctttgtttgatcttttcatggaggtgagtgattttatttacaaaatagaggccaagagaggaagttaaaatatagaatgatttgtgtactcatggatatgcaaaggaaggtttgaattagtcagaactacatttagagctaataagctactaatgtctaatgtctgcctttgagaatctgttttttgtttttgtttttgtttttttgtttgttggttttttttttttttgagatggagtctcctctgttgcccaggctggagtgcaatggccccatctcagctcactgcaacctctgcctcctgggttcaagcaattctcctgcctcagcctcccgagtagctgggactacaggtgtgcgccaccaggcccagctcattttttatttttagtagagatggggtttcaccatgttggccagcatggtcttgatctctttacccctgattcacccaccgtggcctcccaaagggcaggtattacaggcgtgagccaccgtgcccagctgagaacctgtttttaagggtaaacaatagtggatggtttataatgaagggatccagggtaagaagctatcccgagagagttgagcatccccaaactaggggactgagtttcaggatcctgagctcccagcagcagaaagttgtcatgttggtgacacatggatatgaatggcctgtgcagctgaaaaaggttgagaaggcagttggctaaaatttaaattgtcatccatgtaagtaaaatgatttgtgcagtgatgatcatacctggaaaaagcagtgctgggaaaaatagagccaagaaaaatgcgagcagaaaggcataaggcaagagactcgtcgggcacccagaccagctactcacagtggtttattctcttgaggagtcagaatggggcctggactcaatatgacgttttcacagggcattgagggaactgcaactgcaatgtgggttacttgctcgccgcatgcgcagcccaactaacaagagcgaagtttgggtacgaagcaagtgagcttattccgaagcctgcctgaggaaggggcacagcgtcctgcctttaaatatgccacttcacctttggagcagaaagtggtacttttataaggtagtggaggaagtgagcaagagcagggtcccccttgctagcttggtgccttacgtaccaggcaattgagttggtgccttcctgggcagaaataagttgtcaaagtggccaagtggacttgcttttcacatgccctcttggtggatgaaagttccgaggctgcgggggccgtgctttggtctgcaaattaatagactgtcaactctccaggagagatccctcttggagcacagagttaaacttgctctgcaggaaatgtctgcggggggtggccgtgaaaggttgtgtttacatttccaaagggctaagaaacagggaaaaggtggaaaggagaaaaaaagagaaaataatgtttaaaaactatctcttagaaaaatgtgggtacccggttacagaaccgcctgtggggccatgcatggggattatgaagacggggttgccacttactttctttgctaagaacttcctgtcatcttcccatcagcagcgagagcactgggaaaacttcttaccacctcactgcccgagagcctcacctcatccaaacatcaacaaatccagcctcatttttcagaagggccaccttagtctttccatgatcacaagtgaaataattaaatgactaaaagttgtacttgtacaggtcacagccagataatccttcatttgcagttaactaaacagcatgctacacaattggatgtaaggaatgaaggtgacatagcaattttccatctgtattatctgagaccatgttattggaaaacggatggtcctaaaagtagaaatgaaaagttcacaagggcaatgatgggaagttgttttaatgggatcctaaggtctgcttctactaagcaggaaacagagagtgaagcagttactattttcttgctcaacaagtgaaagcaaaaagagaaatccacgttacagagaagactgaaacagaatcccataaaaatgtttctcagtatcatttctcagaccaaccaaattgttgtgtttcttaaactgagaagttgaaataccagagagaggtcagaattctgctgagatgtattagaatggttgaggtttggcctattggagttgcagagattcttctgcttaagacctcttatgaatgtttgtagataataacagtccctcgccagaggcttagcttgtcacctctgcctaccatcaacagatgctttcctgatcacactgttttttttagccttagccactttgctctctcaagcagtggctttcaaggtttttgaccacaatcttctgaaagagacataactacatcttgaaatgtaagtgcagaaatgtatactttcagtaaaagagtcacaagacaatactactttggcagatactttaatatttccttttgtctattctattctattctattctattctattctattctattctattctattctattctattctattctattctattctattcttctattctattctattctaatgctgatcccaacttaccaatgtttgttcatgggcaacttacaggctgtatgtaatctgcagtatgaaccacactgctttaagctttttttaaaaaaaaattgaagcagaatttacttataagcttatttcttagaaatgaaaccaaaaaattaaaatattttatagaaattaaataaaataagaatatagagcagcgatagtttctggtgaatcttaactaaatattaagctacagcttaatgttcaacttatcaaccatctgagggataaatagggtcagtccagattaaaaatttctattacactgtataatttcggtctgtgtttacttgttggtgtatttatatacagaattaatatttctaatacaaattttcttactaattataattttactttaggagacaagatatatttttaaataaacaaattcactctacataaatataaccagagatttattttcaaagaagttaattctggaaggcattatgacttttatctttaatcatggaaacaaacttttgtggaacacctgtatttgagacataggaaaagacttcctgataatttttaaaaatccatttcagtttttaacacctacgtattttttcctatgtgcaaaatatctgaggaagaaatcaaaatagttaaataatccagaaattacattcagtcaataatgtcaacttaagacaaactgtgatttgggttgtattttataagtttgtttttccttttaactgaatgtatacgatgatttggtcaagttgcttggatttgatttatgctgaaataacactcagaatcaaaacaaagcttggtccaaattccagaaagtagggtaattccctaagtgtaacctgattgaaaatatatgaaaatttactctcatgtacaaaataaccattatggtttaggagaaatagaaattataagctaatgaagatagagacttggcaatttactaaaggatccaagagtatttatagcttattttttaaactgattaaaaatgtgtcaaaatattacattctaaataaaagttttgattaaattatttcattcactagctttgaggcatggttaaagtgaaatagagttcaaagaaagggaagaagtaaattgctaaaagagtaaaaccaattttgatgaattaagtcatagttaaaagagaaaaagaaagacaggtgaaaataagattaggctagaatagaagaaaaaaatgagaaaaagtctaacctcagtaagtaactagaaagtaagacttgagattaaataattccataggtatgtcatagttcaattgtacatttcatgaaattctaattctaatttgatgaaagataattccaggaaatttgcatgctattattaaatcactttaagatttttctccaaatgtgttatattagatatacatatatgatatatgtcaatttatatatatataaatatagctctctcctctttgagatatatacgattttagtaggtttctgaggtcactagttgtctccattttctctgcacttaaaatgatgcacagagtttagaagagaagattgggtgagagctctgcatctctaaaaacagctgcccttgcccggatcatgctccgcaaatgttctgacctaaggctcgaatcagatgcataggttatattgactcaagtcgaatatctatttttgggtttaagtgcatatgtattttcaatggcaaattaaagtttataaaatggaatatgataaaagataaatgcaaaaccaaagagaaattgataccttgatattttcagtgaactttatcaaaattcaaaattgaatatatatatttatttaattatatataatatgtatatatatgaatatatagagatatagatatccatatacataatatattatataaaatatataaatatatatatatatataaatgctacataaatatacgacctcagacttctaaagctgaatataacaatggaattaaaagttaaaaattagatcttctgggcatcttagaattttgaaatctttgaatataggaaatttagcaagaactttaaaatgcttaaatggttttaccattgtattctgctggattttattttatggtaatcaaagttgtcagaaggtcagagactcataaatagagaacagagcatcaaaaagctcattgacaagcctaatgcacatgctgtctcttctttaaaaaatgaataaagatgacaagaaacattttgctcttcttttgtaagacgcagaataaactgtcatcttttctcttatgaatagaaaatgcatgacataaaataggaaacaaaaaatatagaaacgtagaaaatgtgtcataaaatagaaaacagaaaatgtgccatctcatgtactaaatttatctgatgacatcgcaaaagaaataacctagtcactgagtttaacattttgatgtcttatgtaatcataaccattgacatgaactttatatgtgttttctgtctatcaaagttcatggtcatgaaaaaaaacgtaaactatttttactaacatttttaaagtgaagaagaaagccttattgtataatttatagtggattctaacttcattgccaagaataatacattatagtttcttagtcattttcattatttgtaagagtgttaaacaactcctaatcattttacttatttttaaagttaataaagcaatatatgtaatatgtaaaaacattttccatgtaaagttaaatttagaaagtgtaaaaattggtgtgtcactgttcacccttattccgcccttgctccctcaagttctgatttcccagtaggaattccataaaatagaatagcttattagaattgtagttgatatgcaattaggtaaaatgttaatttgagcacaacacatctttataatcttgaaccttcctctattactatagttttattattatttattagtatgttttttcatttattcagatattatttctgtctctcaatgtggttttataattttcttgatataaattccaagaacctaaaatcattgctttatcaccttttgatgcttttggacttgtcacccaggtgaaattcattttgaactacagataaagagatacttgttatcaataattgtgactgtctgagagttcactctctttacaagctagctgtttagcctgttccattttcatgactgtttcaagacagcaggaggttctgggtcagagacaaagaatagtttattactggaagcaatagccagtcacttgactctgggtcccagaagcctaaacacagggcattgtgaagagagccaggtgacacttgcctgccaagtagactgtggtacagcacaaacgaagctgtgggaatctcctcttctcatcgcgggcattcaacattcctgctctgcttcagaaggaggagctctatttttcaagactaaacaaacctgctcttctctctgtaaggtaatgggacctgtatcttccaaggctctgtggtatatgaacgtcctggaagaggtttttcagaataaagtgcagttatggtctcacaagatgttaagaaatgtgaattgaagtaaaagttctgtgatatattaagctatgatatactaaaacttttagtttgcatttttcatctgtgaaaagtctattgaatctttttcctgtgtataaatagattgttttctatgtaaaagtgaatttttggtttcggtcattgctaaatacctagtgcctgttgtagtgtctacacatagtagacactcaaataataaataatatttgttggataaatacatgaactaaacaagtaattcatgtttttttcttggttcctaattttttcccatatatatgtaaaatatatatgtataccgtatatatatatacggtatatatatgtgaaatatatatatatggtatatatatgtgcatatatatatatggtaaaaaagaatttcctttgaattatctataaattgggtggaggggaggtgcttttcaggagggccacagtgcgaggtatctttcatgccttccttataaacacatacacatacgaatatttaaaaagtataatcaggacaatcaaaactggcatgaggtattataacatcattgtaacacctgtggaaggaaagtaaatcttagggcccctgaaccactaagctaaaggcaaagtcaagctgggccaacctgcctcccattctgttcaaagtcagcccccctgctcactacatcaatgcatacttgactgccctctttggggaggcgcatcagaaactcagaagaacgcagccatttgtctcttatccacctatgacccagaagcctcctccccacttggagtcctcccacctttgcttctagttgtcctgcccttccagaccaaaccagtgctcatcttatacatgttaactgatgtctcagatctccctaaaatgtataaacaaaatgtgctctgaccccctcgggcctttctctctgttaatgggcttgtcctgaacattggcaaaataaactttctaaattcactgagacctgcctcagatattcaggattcacacaccttaatttcatagacagtaattaatgaataaaatgatctttgtcaaacacaaaaaaatgtatgttctcattttcttaccagaagttttagatttttactttgagggtaattttaaaacaccaggtcatgtgattcatggtctaacctcccatgccagtttggtagtctatgacacaatttcactcaactacttttcactccttgagtgttacacgtgttctccccgtcccctctctgtcttgtcttggatcagtttccaaacctctgcacctaagggctcatatctttatgtaatttgttcctcaaaaaaatattacatgttaattcttctaggaaatcttccttgaatacccatcaaaatgagtcaagggtccttacagtgagctcacctaccaatctatataattggtaatcacagaactcatactaccaaaattattgatatgtttgtttaaatcctttctggagtatgtatcacttggtatctttagcatttatttcaatgcttagagcatcagaaatggtcaatatggaagaaataaataacctcctgagtgcttggtaatagcagcaatatgcgttaacatttgagagcccctgtgtgcttattcattgtgacgcctctcactccgagaacttgtacttggattggccattgggagtttataattttttttttcataagagtctgatgctttaaaagcagctaccatttacttaccactattggaataattttaagtgtaaaattccatgaaagctgaaaactgagtaaaagagttgttcccctcaaacgggactgaagattagggaggtagacctgtacaagaaaaaaagacaaggaagtgggtgagaagtagagtaagggtagagaaatttgttgaaagtttcatttatataataatataaaacatctgtatgatgccattagaataagctgtaaattctgttaaaaaaagacaactggccaggcacggtggctcacgcctgtaatcccagcactttgggaggccgagggaggtggatcacgaggtcaggagatcgagaccatcctggctaacacggtgaaaccccgtctctactaaaaatacaaaaaattagccggggtggtggcaggtgcctgtagtcccagctactcgggaggctgagggaggagaatggcaggaacccgggaggcggagcttgcagtgagccgggatcgcaccaccgcactccagcctgggcgacagagcgagactccgtctcaaaaaaaaaaaaaaaaaaaaaaaagacgactaacatgaaaattttaacatgattgaaattttttttttttcgtttttactttaaggtcatggattttcttctgactctggacctgctgagaagagttctgtgttattttatggcacaaatcatagctaatgtattatccaaaatattgtttaatgagaactaaaaacataggaatttgggtgaagaacaaatttcttcacactttttatgattccttatcgacacctcctacccactaattcttcaatctggccaacaaaaatttgatcacagatatgtttgcttcacctttaaagtctttacaaagcacttaatctagtcttaaatacaactgttcacatgcatttcgcatcaatttatatagtacttagttataacattacaataataaatacactgcaaatcaggtttggtaacacatccacttatattaacaatgccctgatgcacgttcaataattttgtcttttcaccctcaacaggtaaagaggagagagagggagagagaaagaaacactaaatgtgttttataagcaaaatcagctgttacatcatgatgattgttcaaacagctttcttcgctgatacaattgcaaaaagattataatgtccagtcaattgcattggcctaatctagagtataagggttttgcttctgggaatttgtgtttatatataaagtaggttttttaagttagtatatattgaaaataattagtggcttaccataatactttctctaacaatcttctgatacacaatatctcttttttctatattaagcttattaaatttgttccctaggtacttaaaatatgtcttatattccatatagcaaacctacaagatggatatgaatatccttattctgcagattagaaaaatgaggacaatgttgtcaagtgactgaagtggacccataggtagctgtttcccaatactattttgaatctcagttgtatgctctgcattttcggctcaacactaccacctcctgaaaagacttttaagcagaatttagaggaaaacaaatcaaacacatcagaaaacatcaaagcaaatgcattaaataagattatactgaaataagttggacacactgtggagatttccacttctgcccatgaagaattaacagctacagaaattgctttctgagagtaaatgactagaaacctggaaaaaaagatatgaagcaacagttttaggtgacaaacagcacaagactaaaacacctgatgggggaagaaaacaaatgagataagatttatgtctggaggaattttctatagcaaagtgaagggaacctgaactaaagcccagcagtggattgaacagcttcaggatttcaggaggctgaggtaaccacagcagtggattgaacagcttcaggatttcaggaggctgaggtatccagaagttgaaaggtaaagtactttggtagaataagatacataccgggagaactttcaagatcttcagaagagactcttccagttttgcttgtttgttttgttttgttgcaaaatagagatgagaggaaattccatgagactggggaaagaaagcagtaggcaaaataattctacggcaactgcattaggaatacttcatgtcctatctgccagaatgtagggacttcttaatatatggggttagtgtagaatccagaaaggacacatcccttagtagaagggttaaattagttaattgtgctaaactagcacaagaatacagatgttctagacccaacctaacaaagctcaataggataaagtaggataaaactaacccataaggttcttacctgtgtgactaaacaaaatccaaaactctttaaaaaatgtaaaaaaaaatagcacaaataacataaaattcacaatgtctaccacccagtaaaaaattaccaggcatgcaaactaacaacatttggctcataaccgggagaaaaataaacccacagaaacatatgcagaaataacaaagatgatcaaattagtaaaaaaggatttcaaaagattattataaatcttatggttatgctcagtgaagtaaatgaagataaacataatatggagaaaataaaagatataaaaagactggaatggaacttcgagaaataaaaaacatgtcaaaaaggacaattacattcgattatagaaaaagcatctaaaagattagcaaacttgaaagcctaccaatcaaaattattcaaaatgaagcacagaatgcaaagaaaaccaggttgaacagaaaagaacaatctttcattcagttttaagacaatatttagtggtctaacacatttgcaattggagttctaatagataatttcaagggagaaaaatatttaaaaatgtatacccccaattttgcaaatttatttgtttaaataaaaacaaattgagcacataaacacaaaatatctgaaaaccaataatatagataattttaaaataaaccaggaaaaaaacacattatatacagagaaataaaaataaatgtggcagaaaattattactagagatcacatcaaccagaagtaaattgcatggcctctttaatgtgctagaaaatgttagctatgaattctatactcagtgaaaatatctttcaaaaatgaaggtgaaataagatttttcctggtcaacaaaaagagttttatcaaacataggcacaacaaatgatgtcaaaattgattcctcttgcaaaaggaatgataacaggctgactttctttctttctttctttttttttttttttttgagactaagtatctctttgtcacccaggctggagtgcagtggcggggtctcagctcactgcaacctcttcctctgaggttcaagcgattctcctgcctcagccaccctagaagctaggactacaggcgcctgccaccacgcccagctaattttttgtatttttagtagagacagcgtttcaccatgttggccaggatggtcttgatctcctgacctcgtgatcagcccgcctcggcctcccaaagtgctgggattacacacgcgagccaccaagcccagcctgacatttttacctatgcaaaggaataaagagcaccaaaatgggaaaagtgtgagtaaatataaaacaccctgttcttaatttttagcctctttaaaaagaaaattgagacttctggttctgtataagaagtttgaaagtaatgagggagaagaaaaggaaaaatcagttaggtaaacagttaaggctggtcctcggagaggcagcctgcctgaaaaatcgcagctacaggcaaaaatagagcagcctggggaaaactcaggatgcacctgcacagacaagcacgcaaggtccggcacagaagccttttgttcttcgtgtgattaaccagctcccagggaaaagtttccccttcttttcagacatgtatgcagtgggctcggtgggaacttgcacagggaggagggggcttccctaaaacaaacccacagttttacaaacaagagaagcggtgctttgtgcttgcctagagtcatacccacagctacacagacaagggggagggagttgagcagacagcttttcagatgaagaaaagttacgcaaacagctacagaactgagaggagtttcttatacaaacttttgggattcaactgtaaaaacggaaaaccacttggctccccgctcccctgcagagagctttcattttttgttcattacactttcactccaacctcaccattttcattttcacccatgctccttaattttctcagtcatgagacaataagctgagataacaccttagacaacaagttaggacaaagtgtccttttgaaacagacaatgagatgcagaagggcactgggctcctgtctttccagggcaaggacaagtcgggctcagctgtgtgcaacttgttcactaaagggctctgtgagaaacggaaactgccccttctggcatgaccaagggaagatgatggtggtgtgtaagcaccggctctgggggctgtgcaagaagggcgaccactgcaagttcctgcaccggttgacctcctgcgatgcccgaatgctacttctactccacgttcccgcaccagttgacctcactgtgatgcccaaatgctgcctctactccacgttcctacaccggttgacctcaccgtgatgcccaagtgctaattctactccacgttcctgcaccggttgacctcaccgcgatgcccaagtgctaattctactccacgttcctgcaccggttgacctcaccgcgatgcccgaattctacctctactccacgttcctgtacctgttgacctcaccgcgatgcccgaatgctacttctactccgtgttcctgcaccagttgacctcaccgcgatgcccgaatgctacctgtactccacgttcctacaccggttgacctcaccacgatgctggaatgctacctgtactccacgttcctgtaccggttgacctcaccacgatgccggaatgctacctgtactccacattcctgcaccggttgacctcaccgcgatgcccgagtgctacttctactccaagttttgtctccgtgtaaatatcgccatgtccccagaataatgtgtctcaactatttcgtggcttctgccctgagggacccaagtgccaatttgctcatcccaagatgaatcttttattcaacctgagttacacgaagtcatctccaccatacccctttgctgttccagatatttaaatggtgctcaggttaacaccacttatgccagcgctgcagctctttggatacacagagacaaatgtagggatccgagaggccacttccaacgactgttgctatctattgcctctacagattattctgttctatttttattttataagtttagaaagagagtattaagcactaaaaaagaggacactttgtcctaacaattgctaaaaagctaaactgaaaaatgaacttttctcagattcattagagaagtgaagccacggggaaaaggactgcccctatattggagagacagaaaggccgatacaggaatcacagtgtgccagagcagaaagtcaagagcaagaactctttgggaatcagtggtggaatctgaactggaattgacaaatttctgtaaggtagacgtggacaagtgtgagaattagaacccccaggaggacccagtcatagagaagcagccgtacatttacatcttgtatctccaggagtttcaccaggacctgatattgaagattagggaaaaatccccttgtacttccagcagggggtggggaaaaggaaccccaggttgaaataggaaacagggcagaacattcagttttggaaaagatttcccctcaagagaaactaacagagccaaacctgctgggattttcttagagcctaagtgaggtgggcaaggggagagtcccaaccccagctgctcaagcttttctgttccacttaagaagaaggggagggtggccgggtgctgtggctcactcctgtaatcccagcactttgggaggctgaggctggcagatcacgaggtcacgagttcgagatcagcatagccaacatggtgacattccatctctactaaaaatacaaaaattagctcggcgtggtcctgggcacctgtaatcccagctactcaggaggctgaggcaggagaatggcatgaacccgggaggtggagtttgcggtgagctgagatggtgccactgcactccagcctgagtgacagagcaagactctgacttgaaaaaaaaaaaaaagaagaggagggcagaagatgagaagcattgtggcttcccagaggcatagactcactaaagacagagctaatcacagggctgagaacacttcaaggctcaccataaagttctgcgttcacaacagtgtggtatttctataaagataaaatgtagaataaaggaacagaatagagatgtcagaaacagacttatacgtagttatttttcaagatgttgccaggtaattaacaggaaagaatagtcttttcaaaaaatgatgcaaggacattgggttatttatatgaaaaagaattcatttcaacccttattttataccatttaaaaaattaaatttacatggattattaaatttatgagctaaagttcaataattcctagaagaaaacatgaccttgatttggtaatcatttcttagataggacacaaaaagaacaaattataacagaaaattgataaattgaattagtaaaaatgggaaaaaattttaaatgacttttaagaaaaggaaaggtaagccacccctagttcaaagaaacttgcacagcaggtatctgatgaaggtctgtatccagaaacataatgtatcttgattagaagaaagtaatcaactcaattaagaaataaggaaaatgggtcgggtgcggtggctcacgcctgtaatcccagcactttgagagcccaaggcaggcggatcacgaggtcaggagatagagaccatcctggccaacatggtgaaaccctgtgtctactcaaataaaaaaaaaaaaattagccgggcatggtggcacacgcctgtggtcccaactactcaggaggctgagcagggaaatcgcttgaacccaggagggggaggttgcagtgagcccaggtcacaccaccgcactccagcctgggtgacagagcaggattctgtttcaaaaaaaaaaaagaggaaatggggaaaatgtttgacacttcactaagaaacgtgtataaatggctaataaacacaagaaaagatgtacggtatcattaatcattagggaaatgtacattaaaaccaccaggagtcaccaccacacatgtagaaagcttaaaccttttaaggttgacaaacctcaaataccgatgaggaagtaaaacaaccaccattctcagacattgctgaagagaatcagaatcattcggccactttggaaaacagtacacatcatgctttacagaaagaagtggtatagaaatgagcagaggcactagtgtccctttaggaccattatattctaaagtgccaattggtaaaattattctttagttctacctggaaaatctacttctataatttaacttgtaattctgatctatgatatctttcagaacacgcctatgtgaacttaattaaatcttggtccaaacatgcttatttttatttcttctttattttatttatttttacttattttttaaatgagaaccaggataatgagatatttcttcttttacaagaatatgaagtttacctttcatttaaaacagtactactggcaccttgtcatataaaattttacatggagttacatattctaagaacagctatctgagaaatgtgtaatttctttttcaatagttttttatgtttattatcctatgatgtatgtgaagacatatttcatatgtaattatgagattatacttaattatatttccaaaggtgaagaaatttttgtatttttattttaaaataacaatagaaaagtatttgaaatatctttttaaattctcaattatgattcataacatcttatttttatttcacttcttacttttgtgtcttttttccttccatccttcctttccttctttcttttctcatttggattatttttaactggtgcctcagttcttcttaagtatatagaacttctaaaattataagcagagaatggtctttggttcccagaaaacttagattaaagagttaaaagttactcattatcatatagagttcctcagcaggtcattttgtaatgagagcagactcagtattataatataaacctcactggtcctgtattctttacaatgaacaaccaaagaccctttatgaagcttgatatattttaaaacattcaacatagttttatttcatgtccttgctattttataaacaggccttcaatagtcacatgatgaggacttttgggataatctacctgaaatgtaccactctgccctttctgttcttctgcaaggcaaatctgaggaattttttttattgttcatttttccaagaattcctacaaactgatgtctttactgcctacaaagtagcaggattttaaaaagtcagataactctgtttgcactgatatggccaaatatttccaattttcaggttaattctccactttttaacccagacaaacaaacattggattagattttacaagatgtgcaattaagaataaatgacagttgcctctatatatcaaaaccaagcacggacacaaaaccatgcttgcactcagtcttctctgaagaaatcacattactcttttccttcttcctatttggttacttttatgaggaatgaaaccccatgttgcaaaaagaataaagaatactcttcaccattttttttttaattttgcaaatttataaataaatgggtacaatttcttactaagtttctcattttcagcctaggcagagacatacttgcagctatcttatttatctcagagaaaccagcaatgagagctttaagcctagcaaaagtcagaagacaaccaataagagattttggcataacattaaagatagaccaagctaagacaagaacgaggatttttttcaatatggataatccaggaagaaaccgcaagaataatgacttttaaaatatccaaacaaatgtaaatttctcttccccctaacccttacagaaagcaaacagaaaacatcaaaaccaattgagaaactccaagtaggcacaagcacttcaaaattaatacagaaaaggctaactttataaaatgagtaaatttcgatacagaattatattcacacaatgaatcaggattatttccaccccatacatggtctttatcaagagaaagggatgtaaagaatatgaacctaaacatcaccgttttctattttaggtgacagcattctgtgactcactagaattagaaaacagtgacattagaattagtgacaattagaagggaaaggaagaaagggaaagaatggcatcttttacttactcgtgataaaagcaacaggaaggagttggcatcagggaagatagattggacttaagctgattctcactgctataattatctactgtgtctggttttgatcctgtttactgtgtgatacttgatatcataatgaactgttgattgtgtttatgaacatttgcaaggtgctcgtttgctgctatttttcggttagaaatgttgttttgtgtgccaaaaatggcttgaccagctgaaaataattctatataatttcaatttaatagagatacactttcctaaattcaattttatgcagttttgttacaacttgctaaaccacaggaaaaagggaaaaaaaggacatactatgtatataattcccttcaaccacttcctctgcttgtacatttgttgccagaaacaattttatgatttgcgatcggcaatagcattttcaaaaaatggtaatttttttcccaaaaattaccaataattttttattctaaaagccatgacaacttgacaaaaaatatgttaaatttctagtctctttttaatgcaaatatattaaaaactaaaaatgaatttgtactcaaaaaatttctggcacagtctcccttaagaaaatccctaattggatagaataggcatgttcccataattcactattattaagaaactattggctgggcgcggtggctcacacctgtaatcccagtaccttgggaggccaaggcgggcagatcatgaggtcaagagatcgagaccatcctggttaacacggtgaaaccctgtctctactaaaaatacaaaaaattagccgggcgtggtggcaggtgcctgtagtcccagctacggggaggctgaggcaggagaatggcgtgaacccgggaggtggagcttgcagtgatccgagatggcgccactgcactccagcctgggcaacagagcaagactctgtctcaaaaaaaaaaaaaaaatagaaaagaaactattagtgagcaattaataccctagctggatctctccatcaacaacatttagtgaacatcattaggctgtgcagcttggagaaatgttcagaattatttaaaatttatccatgatgaagaataatagaattagcaatgtcatcattacctaggtacctggcctttaaaaacacaatattaacaattttatttcttcccaaaatgttgccccttttatcagtttcctgattgtgttttcagctgattttagttatttggtgctatgtaagatttaaggggtgtgtgtgtgtgtgtatcacagatattgaatgcatagcccaatgcccatatcttagttattgatatctgtataacatttatgcagaactttatggcttaaaacaacgggcacttgttatcccccagtttctgtgggacagggtttgagtcgctcagccagatattactagtgccagctcagggtctcctgtgtctgcaggtagaatgctgtcatgggccacagtcatctcaaggctccactgaggctggagcatccccttctggaactctcatggctataaaatgaagaagtcacttggttgctgttaccttgctgtgtgaacctctccacaaggttatttgagtgtcctcactaatggcatctggctttccccagagtgggcaaactctcaatagaggacaagtgaaggggaagctttttatggcttagtccctgtagtcaccccgccgttccttacacgtattcattggaatcaagccactacgtcccaccgatgttcaagggaaagggacttaggctctaattcttcaaggagaaggtgtcaaggaatttgtgaacatatttacaaatctttacaataactttttgcatacatccatgcactggtataacctagcatttatgctaataaagtgttatgtgcatgcttttggttagtgtctagatagaattttttttgtgtgtaatttactttcaatccatctgtgtccatatatttataatatgtttcttataaatggtgcataattggatcctatattgtatcctgtctcatagcttttgtcttcaagtagaatgttttcaccccttatactttttattttcttttatatatatactgctccttgcagagcagggatacccaataggcagtgtgccaagagtagcccaacccttatactttatgccattgctgatagagtgggatttatatagagaatgtttcagtttattatctatttgcactatctaattgttactttattctactgttattgccttcttttgaattaatccacttctcaatcttccattttatcccttctattagttgtttacattataattctagtggttgctctttacggcatgcacctccgacttgatagagtgtactctaaattagtataatggttttagcaattgttaaaaagtgtatgtggcctacaacattttaactccacttacagtcagtattcttttaaagttacctacacagttgtccttccttcattgctagggttctgcccctccatcttgaatcattttccatcagcgtggcatatttcctgtagtatttcttggtaattcagatctgttggtaaactttaaattttctcaatttgtaatttcttaaaaaaagttgtcatttggccttcatttttggtggttattttagcaggatttagactttcagtttgacaatatatttttctcctgaacgttacagataccatttcattcttttctgtgtatttaatttgttcaaggcaacaatactccttaaaagatgatgtgcctctttcctatgaatgtcctcacaatttttctccttacttttgaattacagcagtttgactacgacatgcctatgtgtggttttatttgtatttatcttgcttgggagttgctgagcttcataaacacatgtattttatcagttttaaggcctttatctctgcaaatactgctactgcttcactctcttggtccttcatcattagaacttcagtgcacatacatgagacattccgatcacatattttatatgtctgttgtgcgttgttttcttcttttcattctttattctctgtactaagttttggtattttctactgacctactgtagagtttattaatattgtcttctgttgtgttcagtctgttgttaaactatccaatgggtctttatatcaattaattcatgcattgaatgcacatcagttattatatcttttggttctagtgtatctattttttcttacaattccacttatacatcacaattcttccttgttcatttattttgtctcctctatttaacatatttataataattattttagttattttaaaattcttggcgtaattctaatgctattgtcgtcaatggacctactgattttgtttttttttctttgaattattggtcacatttttctgcctgtttatatgtatggtaattggctatttttaattttatacctctgacatatataaaagatggcagattattttaattttccctagaagttctcctcgttcctgtgtgaggaagatagggtgacaagctgatcactatgatgtaatcaggtctgtgcctgaggcaatttcagcaccactcagtctatttctagtttgcttctagtctgtgaatgtgcctttcatagaattttttaattgagagcctggcaattccctatctcctcaccccaccaagcaaagatggaaggatattcattattgtctttggaggatttttcatttagctcttgagattttactcatgtggctaaaaatctgacagccatcttgaggggagactggcagtgtgtttgaggacatctctcctccgtgcttcaaacacacggccagactaatcctgtcagactaatcacagtgcatctgatgagagttgattgtaattggggttttattttacattttccagttcactaaagagttggcatttaaaaaaatcatcctctcgtttataatttccatctctcagttgtaatattcttgttcttttcttttacccattttaaaattacattttctgtcttttccttatagatttgaggatctctttatatattctggaaatcattcctttgtaaattatgtcaaaagcaattacattatttccaagttcatcttgttcttttattctctttgtgatattctttaataaacaataatttttaattcgatatactcaacttcatttattaactttacagtatgttctttcttttacgtcatgcttaaaagaatttcctacttcaagatcgaaaggatactttcacttttttgtctttagtctccttgaaattgagttttgtgagtagtactaggcaggagtctaagctctttcgtttactcttcaattttccctccctcttgccctttctccatctgtcccttccttctttcctttctttcttccttcctttcctccattctcttttgccctcctttttgctcccacattctccttctccctgtccttccactttatccctctgtctctcatccttttcttttcttcttgggtcttatctctaattgtatgatcacaatttattggaaggctcattgtttttctatggttctgcacaaccatggcagtcctcaattgtctatatgaggtaatttcttggctctttattctcttttatcatttgagtgttaatgtttcattaccatactgttataaattttattatttataataaattgataacaaataattggtaaagcagcccctctcaccttgttagcattcttcaagaggattttgataattcatgaatgtttatactttgagatacattacagattcggcttataaatttacactgaacgcgtattggattttgagtgcattaaatttatagatactgttagagaagtttgaaatattattcattaactctttcaaaccatgaactagatatatcttctcatttattagaaataggtcttcctactatcttttaataaacaagcatttttataggtatcacatatcatgtttttaaatacgaccatattttcaattctattaaaaatgaagtattaaaaaatatatatttgttgacttatagaatacattttttatattgacatattttcactagcctttctaagccttattattactttacaaattgtctatagattcctttggattttctacacagacaattatataatattcaaagaaagtttgttttctttctaatctttcacacttttatctatttcctcaaaatttcaaatgtatcagttataattgattatgttggttgattgcaatgatgtcttcatatataattatttatttttactttctagtattatttgtgctttcagcaaacatttgttaatctgttagtcttttcacagagccagttcgtatgcctggatcaattgattcctgttatatcgttttcctctttttgtttctttttcacatttcttaaattgcatacataattattgccatctcttcttttataatatacattttataatacacatttgatgctataaattttcctctattgttttagccacatcacgttttcatatttagaattacagtcaattgtaaatattacttagctcaaatactttctaattttcattataatctttaagttttgtgaattatttagaggtatgttatctttctgttataaaatttaacccaatgtcattggtctagagatagaaatcaattgacaattggcaaactttgtttatgaaatgccttttgccaagtttcttaaatgattcatgagttattaaaaagaatgtatattatgcaactgttaggcgccatgttcacttgatcagctaattatgttgtttaagtattctgcgtactgtctccttactttctctctttatcttgctctcactctcatttgcttaatgaaatactaaaaagaaaacccttatccctttactgcagaaaatttggaaaatgaaatcagtaaaaaacattacttgtaatctcatcatccagtaaaattttaatgttatttttctaattaatcaattgtacctcttttgaaatatgttacatagagatttcagatataaatagatacagatagaggtggagattatagaagaaaagaaatatttttcccccatcttaggttcatggctgagacccctgtagcaaaagacagattactaagagaaacacatacaaatgtatttgatgtaagttttttatgacacggagctttcataaatggaaattgaaatatacaggtaaatctgtacattgttatgcttaggtttgaagaagagtgagtagttgtagagaaatatgattggaggacaactgtttggggaacttagcaaggcctatttgttcatgtgcttctctgtgtccttgtgtcttcagagataaggatgctcttttcttccaggtatagaagggcacattttgaatgaaagtcatacaacctgctttggagaagggcaggagaaggtccgagtaatcttcctgcttctgctgttttctcaaatgccaaggtgccatattttggggtagtgtgtcctgaaccccagagatggagatataccctggtatcccctccttgaaaatctgctaccacatcttcggggtttatttagccaaaagaagtcaggactgactgtctctaaactttagtgtcttgtcagtctactattggcaaagtttctaaaacagctatgtgttgtcactaatgaagaccagttctgtgtagtttcatacatttttttctgccctgatgatgcctggataatgatggaaagtggagccacagattttggaaaaccgcaagcatgactacaagtagaagcccattgaatatcaacaggaaaagtagttgcagtcataatccctttcttagtttggacccttttccccaaagaaatgtcccttctttttccatagggaccaactttgcacatgctgtaagagggagtcctgttaaaactccctcccccagcaatgggttgcctacttgtagattacatttgaatagctaagaagagaactcttcaacaattgctgccactcacagcctaaagtatattttcaaaagggaacattttattaacttgctaataaaagaaagagttttctttgttatttcaattggaagacagcttttctatcaaattctcatagtcttgtaataaaatagttttcgattgtctaccacgtcttaagaatcaggttgctaataaaatttagaaagataaagtattaattagtaaattgcctggattttagagaaatttaatggactatgttgattcctctttgtaaatttgtgataaacctagttaggtgtgatagttttgttttgcataggaattaatggttcagccaacacttccctgatgttcagaatagtttaaatagcataaatcaatatacagtacatgtaaaacgttggaggtcagaaactgatacctcaaaatgtagcgctttgacatgttgaactgaagtagaagcctcaggtctctctgaattcctgccaccttcccaactctcaatcctctgtctctcccaaagcagaggatggagtgttctctgaagtttcctcatttgcccaaggcttagatccacccaagaagaaagcagttaccactggtttctcccctgaggtccattaactcccatatcacaggaaaaaggactgaagtctgtcaacacagctggacagatttttgtcacaaaccattgtctggtttctaggccaaactgaccgtgccctaggccattgtatgttctccaagtccattgattttcctctgaaaatcactagccctcaaatttccatgttcctcctgtctcccctctcataaaaagaagggcatatacacatctgtatcccattgggctattgagtaatcattgtcctaagaatctccatgctgtgcatgttaataaatttgtatggcttttctgttattagcctgccttctatgagttgatttttcagcaaatcttcaaagggcaaagaggaacttttccattgtctcctacagaagcatttaaaattctgtaaaacaatgacaaaatcaaaagccatgtaaaatcgtgtgtgtttgtggtatttttagcaaaattttatttcatatttatataatccaaaattctaatataatagttctaaatcgaattttagggtccatgaactcatcctttgcacttttgaagcagaggaggactgtgacagagttagaatctcagtttctcagttccacaggctgctactcttcacatggcagctggataatgttcgattttcagtcctgtgtatttataacacatttcaacctgcagaatgcttgaaattatctgctagtcactcttctatcttgaccaacatacaaaatcattgatgtagaattcagtgttgcaaaattttgaaaaaaatagttttggtaataattttaaatatcattggcattagagtctgacagaccaaaattaactccttgtgttataattcattagcttaaaggcatgatgattgtgacaacctcactgagtcttgacttctccatttaaagataataacatgaacctaggttgcaagttcttcatgaagattaagtgacattttatatataatatgcagaaaataggtttgatatgttgtaagcatttgataaataacatttattataataattttcagcaacaataagaaagaaagtcaaggtgttcctaagagacttagaggtttaggtcctacattgcaaaaggtttagtatctgcactgttccaacagaaggagcagacatatagaactcagttcccatccttggtttatttattttgagtattcgacagaagaaaggagtcaatgaaatgagaagacctgtgcgggcaaactaaccttatgtagaatgtgtcctcttattataaaatgagaagacaaccccttttcacaactactacaaaacaatgccatacccatccattgttattaccagttatttccaactctcccctgctatttccagagtccaccttcctgtggggaaaagctaacctagaataactgtatttcctacacctgagaggccacacaagtattacattttacaaggagtaatatttttttttgcaatttctccccaatgtactttatatccatctagtccatagcagaaatagtaaaatttcaaaattcaataaaccaaaataaaaaggtctaaaagctggagccctatatagacagaattataaacgcacattattacaccattaagaaattgttttataacatttaacattattgtaacatgcctgtgttgcacaaattcatatatactatgaataaagtcacatacattaaaacatagagtatgttaaatatggtattcagttttgtaaaaccaaatttgtctgatgtgatgtttttctggaaaacacaataagaaagctttccgagtataaatgacaatgggtttttacacatatgtctagctctcaatgtgtaaatgacaatgggtttttacattcatgtctccaaactggattctgcaaattgtattctaaatgaaaaatatcgctctagtaaacaaatctcataagacagcaatttatctcaaataaatttttggccaaatgtttagtctgtaggagagaaaaagcaatatattttcctcacccatcacagagttcatagctgaaacccttgtaacaaaatacaaattaataagagaaaacatacaactttgtttaatataagttttacatgacatgggaaccttcagaaatgaagacctgaaaacccagggacaactgtgtgtttttatggacaatcgtgcagaagtgtgattggaggacaaacgggtatggtctaatggcactaaactggggggaacttatgaaggcctgtttgttcggattcttgctagagtccctgtgtgacagtccttccctctggctaaacagcaagacacttgtctcatgagggttttcaggagagaagaagcagggagaggtcacagtgaccttcctacctctgctgtttctctcaagtactagagtccatatttggggatattttgaaactcaataagtctttgctgaaatacagtgtatctatattcttttatctttaacttttgtatattacacaccattctacttttcttttttttaatttttttttttgagatggagtctcgctctgtcacccaggctggagtacagtggcgtggcgagatctcagctcactgcaagctctgcctcctgggttcatgccattctccagcctcagcctcccgagtacctgggactacaggtgcccgccaccacacccagccaattttttgtatttttttagtagagacggggtttcactgtgttagccaggatggtctcgatctcctgaccttgtgatctgtccgcctcggcctcccaaagtgttgggattataggcgtgagccatctacttttcaaataaagtgatatatttgctaaaattgtgtgtaaactaattatagcaaaatttttataaataaaattatttcaaagataaatcttacatcctacagttacacataaagagtagtgttgtatcagatctacagtgtctaacagcctttctctctgttaatgttacaaaacattgatcattggtagcccatgctactgtcattttaatacaagcccataaacttgaattttaaatgaatcacccaaatgatttttcaggtagtcatcttccagaaagattggcttgtagaattgaaattttattctacgttttctaactatcaatagttaaaatctacatctcaaaagtgagctgtcgagtcaatgaagcccgggagtttgcaggtttggctttgaggctccatgtgtttcaccgtgaataagtgtagactcacacattcaagaagcatgttccaccctgtatatgaataatagtcttcaacctgccaggcttgcggcttgataggcattatagcacactgtatattgaagacgtttattttatgtcactagaacaattactccagcgaaaatttagtttgttatgtactttgtataaaactcatgtcttctcacatgaattactgggaagccatactttttaaaaagttgtaatagaattaaagaaagttaactcctagaataatagcagaattggcaattgatattccatctagaaatggctttcaaatcttgagatgactcttaaattcaaaagtttgagagttgagaagacacattataggactttataataacagaaaaaattagctgtaggggttgtagggtagactcaggtttgtgcactgcattccatccatgttatcacaattagagacatcatctaaaaattgagtgagttggttctttttccaagagtcagtacaaactgaaattctaaagagaattttttaaaagttaaacaacttatggatgacaagtttaaaatgaaatattcaggaaaattagggcattaattaattcattcatccattcatagtatttatttggtaactattaggttctggaaaatgtgctaaaatatattaagaaataaaactttaaaagtccatactttcatgaaatttgagattatttggggactagagacaagaaatgttatcaaaaatgatgttagtggtatgataaaaagggcacagaattctatgaaagtaaatattagaagataattcaaatagaagtttcaggaaattattttgggggtacaaaataattaatagataacaaccttaagtactgaggggaactggttagataaaggagaagatgaaaagaaaagtgtttctcagggaaaagctgtatgtgagaggaggctgtgatcagataatggaaagaagctttgcaggtcaggggcaaggttcaaggtgagagagttggcagaaaggagggaatgcatcaggcgggtagcttaaagcatgccaaggattgcaaaatttagagcaatgggaaaccaccaagatttttatgctgacataattatacttgcatttttgaaatatcaatctagttgtagaattgagtctggaatgtagagtgagaactggcatgctgtgacagaggtcagacctgagagagtgggccagagaccaggaaaggtgcatgatttcaatagggagaatatgtagatatttgtgagtcatcagatgaggtgagtgaagaagatggaaatgtaaccaatggcaattaggtttcatacataagtgaatgaatactattactttttcctaaacgagaaaacactgaagagagaacctaatggagatcaatatagattcagttttggacatgttcatattttctatgagatacataaataaatctcacccatgggccacaatgggattgacataagatgtcagcaaatatataaggaaagacatgagatgcatagaaaacaaaccacaaaatagtagacacatattctaccttatcagtaattatattaatgtacatgaattgaacactgcaatttaaaggcagacactagcagataaatttttacaaatgatacaactgtatgctatctaaaagagacacactttggattcagagataggaagtaaaaggatagaaaaagacaagcaaacggtagccaaaataaacctgaagtgattatattaaagtcagacaaaatagtccagaaggtaaaatttgtagctaaagataatgaagagaatttcatgatgataaaagagtcaatccatcaggaagacataacaattataaacacatatacaagttccaaaatacatgaatcaaaacctgacagaattgaagggaaaatgtacatttcaacagccgggtttttaatatccatttcagcaatgagtatggtgattagggagaagatcaaaaagaaatagaagatgttaacaacatggtcaactaactagacctaacagacattgatggagcactttgctcaacatgagcaaaataccgattcttctcaaggaagttcaacgcacattctccaggacaggccatctgttggactgtaaaacaagcttcaataactctaaagagactgaaataacacagaatattataggtgctaaaggatgtgatgccttgcctcacccatcacaagggtcacggccaatacttctataataaaagatgagttaacaggagacaagcatgacaactttgtttaatctaagctttacatgataggagccttcaaaaataaagacctaaagacccaggggaagctatttttatgcttcctttcgatgaagaatggaccattgtgtagagatgtgattggaaaaaaaggataagatctaatgctaatagactgaggggagaaatccagcaaggcctttctggagtgaaagcataaagaaaacaaacattgaacatggattttgatccagtggcatttgatccagtgcatttttgagaagcaatcttgacagtggctaggaacaggagctgaatccctgtgcttcaattgccttatctgttaaatggggataatagtagccaccttatatggatgtcctaagaattaattgatgtaaagatttataatagtctctcggcaaacaatacaaatttaataaattgcagccaacatagttataatcatatcgattcttcagagtaaccacccagtctttgcattctcatccacacgttgccagaggagagcacaaaagcatacaaagactcgcctgaagccttgcagccacaccacacagcaccgagacctcatcaatccccctcactttctgctaaatcacctgccccacacgtgattaatgtgccccgacctctcatgtctcattttgtagtcctgatttatgtctttctgttgtgttgtgagtaatatgtttacagagggggagaaaattataatattgaagaaagggaaacaaaagtgaggcagtcaggtatgtgaaagttatagtaagatttttatgtcaatgcagctcaacatttctgctatattctgttttgtaggcagaacaaaatctctcttagttagaggctgaaatccaagggacttcgatttattccaattttcaagtagaagattttattttactcaggtaaacatagactgtgctgttacataaataaataaataaataaataaataaataaagcaagcagaaggtgcggcatagatttaaaaaactatacttggggaaaataaaattaaataaaatcatcgtcaaaagttcttgtgcactttgaaattcagattgcatcgtgagcttggattgccaatatccttcacgctgttgcttgccagactgatagctctttccattcattacagatagaaagtgactatgaagctttacaaagttacgggcaggtgcaaagctgttgatcccagcctagaagatacattttatatgcctgtgaagattgttcaaaaaaccccaactgtaacaccaagttgttagaatagtttaagaaagattaagccagagaagggagcttcattttttgtgctgacaacacttacggggttttagttgaacccagccaagaggataaattgcaaagtaattaagaggaagtctaaatccagatttgttcagtttgtttcttaggatcgttaatattaactgactttcacattcagattcacttaacttggcaaatgccatgaaaacgaaatcacataagattttgcagcctaacattctttccgaaatgggaaaagctactcagcctaagaaatatttcatttgattttgaggtgtttcacagactatgaaaaatttaatttcacaaacaagtgccaaacattttgtttgtctttgaaaaataatcatttcaagaagaaatcaatgactttcagaaataaaaccagtagccataacaactcctccaggcattttccctgaaatgagtgggtagtgactattttaaaggacattttcattgactttgctgtattatctgacactttaagaaatgtcagagggtattgtttcagggactcttatttaaattcaggttaacgttatacgcctgcttctcaggctccatccagcttcctttgtgactcagttcaataacaaataatgatgaaccattgaaccacagacatggataaagacaatcccatgtttccattacagacccaattcaatggtttcccatgttctttaattgtatggattagaatgcacagaaaaatggtatattagacattagagatttcctctcactttccccacaaaattttgacatgattctcccagaaaaaaatgcaaagtagaaatggagattcccgtgattgacagtgatgttggagcaaagcacatttccagcatctgcttgcgtgaccctggtaaagcatgggcatgtgcggttcaggctcagagaggcgtggagtttagaaaaaacagcttaatagcaaaacattcactctttgtttcatggatggaaagattaaaacgtatcaattacattgttcacaacaatttaaaaaatccagctttcttttccaagcatttctctcacatcatcagttatagtcccagactgcgaagtctagggttattcaggtcaaattatctaacatttgcaggtgccaatgatgagctagccattttgcatgataagtaatctgcaccccaattatcataacatcctcccttcttacagatggcttagccaaggaggagaaatgtaacttgcgcagattcacatagctgaatctatgtgaaatcaaaatgtttgatttcaaaacttacactttaatatcacactatgctgactctcattattcttaaagctgaattttgtaattgaggaagagttgatttcaaaatgtctcaaatcctcagctcaaattcatgggcagttttcattcacttctacacagcatacatgtgtaatatatgttatatataatatagattttattatgtaaatatagtttaaattatacatttttaaaataaaaatatgaattttctttttcattatttcaaggttttacatgtgcttagttttaaaaatgagttagcttcttttatctttaacttttgtttgttttccaaatgtctagttgagtcattccatttgagatggtaatttttaactttccttgcttacttctagagtaacaaacctttatccttaaacctctggatttggcattatttttccatctatactgaatctttattgtataggagccaggataaaaataagaataagaggaaaatattgaacagcagaatgagaaatgtatgtttgatgccatcaattcttcaaatttttcaatattattttagagagaaacatggaattatttgctgtaaaatgttaccctaaaacaacaatagaaagtgaaaaatctaaatatcacaattttcaactgctgaaataaaagaaaatatttaaaaaattgagtcaaatgtttaaaacaaattagtttttgaatggtcttaaattttaggaaagataaataattcattaaagttcaaagaatttactttctccattaccttaggtctatgcaacatattagtttacttttgaatgaggaaataattcacaaaaggttgatctttacttttagaagaaataatttaatatactataagaatgatcaaaagtttttattatgaatgaaaggcaaaatgcttgtgtaaacatttatatcttataagtaagttttctgttagtatgctgtgttctgacatcaatttgctgacactaactgggtgtcccgtaatccagtttaattctgacagttattgcctggagttagcacagacccacatattaagagcaaagtcgttcacaggactgtttccacttcagacaccagccacagctttgggtatccctaagctaccacacttctgcccagccagctacaaattcagggcttcccacaatctctttagattgaataatttgctagaatggctcacagtattcaggaaagtgctacttagaattatcatttcattataaaatttgctcaaatggctcacagtactcaggaaagtgctgcttagaattatcatttcattataaagaatatacataaactgccacatgaagaagtaatagggcaagctctaggagagtcctgagcccaggagctttcgtccctgggaagtcgtggcatgccagcatcctggttcacttacaggttcaccagtcaggaaggtcctttgagcctcaatggcccgagcttttattgaggtttcatcacctaggatgattgagtaaatcactggtcaggtgattaaattcaaccttcagcacccatgctttccccagaggtcaggctggtccagagttccaattctcgaaacacaagtttggcctttctgggtatcaatcccaatcctgaagccacctaggcaccctccatccccaccaggagctgcctcattaacataacagaaattttcccatcacgctggaaattccaagggtttttgcagctctgtaccagaaacatgggaccatgggatgaagaccagatctattttatattgtattatagatgtcctctgtgtgtttatctaggctcataattgatatggagctttaaatagttttttctgtcatatacatttcgatgttcttccactttgttgttttaaaattactttccaagatagtgaattccttgcataaggttcatattttctaaatgcacacaaattcttttgcactggtagcttaaaattgtttagtaatggtaaagatggtttgagactgagataatcacccagagaaagatatattttttccttaaaaattaggcaaagctacatagcattaagatcttttactagcagagtacattttcagatgcccctacattacataaattagtgcaagaccaatccagaaaaaaagaagtagccgatagaattatagtgtggaagtcaggcagtctttactttatactgacgtatcttttaacaattaagactaagagaaagaatgtttttcaatttgtgtatcacctcttagaaagctgaacaagtctgatatgacataggctagctaggccaattagggataaattagagaagaacacagacccaatacaggtggttcagactaatccattcgtctttcattcgtttaaacatttttattgagtgcctgtcattctagaatgacagcagttacaattctaggcatcaagagtgtagtccttaagatagaaacaaattccctgacgttggccaggtgcggtggctcacgcctgtaatcccagcactttgggaggctgaggcaggcggatcatgaggtcaggagatcgagaccatcctgggtaacacagtgaaaccccgtctctactaaaaaacacaaaaaattagccgggcgtggtggtgggcatctgtagtcccagctactcgggagcctgaggcaggagaatggcgtgaacccgggaggcggagcttgcagtgagccgggatcgcgcccctgcactacagtctaggtgacagagtgacactccctctcaaaaaaaaaaaaaaaaaaaaaaattccctgaccttatgaaatctacattcttctctaggagtcagagagaagcaaagaatgtgaaatacaatgtcaggtagtaataaatgttatgaagaaaagtaaagaaaataaagggataaagaatgatagagtgagatggtaatttagaaagggtggctaatgaggacttgtctgaatgggtaacgtttgccagagacctgaatgagatgaaagaataaaccatacaaatatctaacagaaaaacatccgaggcgaaagaacagcaagtgccaagttcttacggaggaaatgaggttggaacgtttaagggataacaaacctgtgactaaaatatggcaagtacagtagagaacaatacaagatgtggtttgagaaatggctgggtaccagttgatagaaggtctgtatagaccaaaataaacctgaaaaaaggaaaagaaaattagaaaagaacaaaggccttgattataattacctaaaattgattcattttaacatcaatttcacacaattttaataagtagtatgttccaaagaaagaaatacgtatggtcaaacagatttagaaaatgctgggttaaaaccattaagccttttttttttttattgtaaagattttttagaacatttcatcatttgatttgtgttcaatctaatacagagattgtaatcagaatttttcaaatttattgtcctgaataactttttcttctagtagattatctcccaggattagggttccactgaattcctttaggaatcattattagttgtcaaacactgtaaaaagatctgagtggcaagaggtgtgtatttaacaccaaaactagaaatgtagtttagattttatgttatttatcacttgccaagagaacatacagagagaaaagcattgaaaaaaaaaatagattacatggagtgaagttttataaggagatacagcctttagaggaactaactttccaagttaaaaaaaaaaaggtatttagttcttaaaatattccttctgccttgttttcctttctccttttttttttttttttttttttttttgagatggagtcttactctgttgcccacgctggagtgcactggcatgctctcggctcactgctccacaggttcaagcaattcttctgcctcagtctcccgaacagctgggattacaggcccgcaccaccatgcttggctaattttgttgtatttttagtagagacaaggtttcaccatattggccaggctggccttgaattcctgacctcaggtgatccacctgcctcagcctcccaaagtgctaggattacaggcgtgagccactgtgcctggctcccttctccttctgagcttttgattatacatatgttagactgtgttgtctcacagatcatgggtactctgtttttgtttgcttgtttgtttgtttccatgttttctatttgcatttcattttgggtaatttttacagacttttcaactttactaattctttcttcagctgtttggagtctactaataatcacttcagggcaatcttcatctctattaggtttttcttttctagtatttccatccaattgttttttaaatcttcatccctctgctgaaatgacctttctggtcttgcatgctgtctgctttttccattacagcctttaacatgttaatcaaggttaataaatttccaaggtttgtgcatagctaagcctgcttggctccctgggagagtgttgttttcttcttgttattttgtgtgtgtcttaagttttgtggggaaagttgggcatcttctttaaaactgtaaacatgaagttttttttcctgcttagaaatgagcatgcctttccttcttgtaggtctttagtgtggagagttgaattattaatctaattaggagttgaactgggcttaggtttgctgtgctacggtcacctctaggtaccacaggtttaaacttcctctggagatatattgggtttagggttgtggctgctttgccaggggccaggggattttttttatgtctcttccttttgcttttggtcttccctgtgacctatgcacctatgcctcagagagggtctttttcttttcttttctttttctttctttctttttttttttttttttttttgagacagggtttcactttgtgctctgtggcccaggcttcagtgtgcagtggcatgatctcaacttctgcctcccaggttcaaatgatcttcccacctcagcatcctgagtagctgggaccataggcacatgccaccatgctcagctaatttttaattttttttttttagagatgaggtctcactatgctgccaaggctggtctcaaactcctgggctcaagtgggcttcctcccttggcttcccaaagcactggcattacaggcatgagccactgggcctggcttgtctccttcttgtaagttacatattgctagagacttgctcattggcagtgtgcatgtgtggatgggtgtaacttctgttgttctggataggcctcagtcctaggcaggcagtgaacccctgggtgtcggtggggggtagccttctcagtgccctacttttcctctagctgctgtaggcctgggttccatgtgaatcctgcaccaccactccccatttcaccacatatacacagataaaaactttggtttcacaagagacatgggggaaggatcctggtgaaattccttgcttctcctacagtggttaaagttttctttccccagtctatactacaaaacaaactttctcaagattctttaattttcatctgattcaggtagaaaaattctgcaagaggatatggacttcccctatatacgtggcccttagtgctttactctgcctcagcaaggcacactcagtccccatcaatcaaccagtcacctgtgctgagctcttcgcactggtctcaatctgcccaggtaaaacagtgctggcatttcatctccccctggaggctcctctctcctcagatttcaggaccgttggttgtcctgctcagctttctggtgggttccagaaaagttgttaactcaccgtttatttggggttttgctgttgttgtaaggctagaagtgacactcatttcttctgtcttcgtggaaaacactcaacaggtaagaaaaaaagaagcaacatcaacaagcttactgaggctatcactagtttagtcacggtagcaaaacaatagatttcttatataattatcacatctgaaagtgataatataatcactattgcaaagatcaggaataaagtcattttcttatggagtcagcagattataggaatggtggctcaagcctccattgagcttgtggactagaacgacagtgaccactctttggttgtttgcttatcgtagggagcacaacaggcttccctgtgctggctgcggacatgacgacgcgctgggaacgacagcagtgggaggtgtcatgtttgcttttacacacttcttgcctctataaaagcctgaacttaaaatttaatttttttagtaaatagctctcagtgtattacaaagtgtacattcagttatccacaactaattatttctttctgtttctaatgtgccaagaactagtgcatgctaaatataagggaagatacctgattcctcaccaaaaatcttggtacataaaattgggaagaaagtaagcagcatcaatctgtttataaaatctctttgtctcagctttttcacctgtgagatagaccatcccatattattcattaatgatatttttttgtgaccagcagacttctcagtggtcagatacatgtacctcgatccttaaaggtagcaaccatcactcatagtgaccagatttgcagaggcagcctctcccttctgtcccacagaagtctacagggtatcctggggtcctcattgcccgcctctatgaaaatcccacgtcctaaatggattgtgtgtaatttctttctcatccagacccattcttccttcctggtgccttccctgccccatcttctctttcgtccctggcccagatctctaccttgtctgacgggccgtggcccttgcttcctctactacattgtgacacttgattatatcttgtcttatatctttctccaaagatttcatggatcatgtctttccaaaattactagactccctaaggggtgaagcatgtcagtcttattttgcatcctcacgctcccttgcacactgtcagacacagagcaggcatgtgacaaatgctaggttgcaacaagtctgagtttcttaatggaagaaatttagagagagaaagcgggggtgctttggtgagagatatcaactcattgagtataatgaggaaggaaccggccaaccgccgtcaattaagaagtggagcaaatgggctaaaatcgctgtaacgtgctccacctgagctttctgccgtccagggccgctctgtttcactggggtggaggctgccactgctggcagctgaagctgagcgccagggtctcttcctctcctcctcgtcctttcggatcccgggccctgcggccgcgcttccgcttcagaccccgcatcaggacccgggacacggggacttcttccgggctgcaggcgctgggcaggcgcggcgcccccgcgtggttccttcgcaggggacagcaggtttcccgccccgccgcgtgggggcgcgcgatctgccgtctgagttcaatgcgactccggaaggacgcaagggagccgcgcaggtggccagctccttaggcgtgtccgtcccagagcaccctggctttatctggtttattgctcatggttcaatcgggaaattaggcagcgtgtccccatgacagcagacgcgggtgacggctcttgcctccctccccagtgcgcacccccgctggagcgcaggagcttcctgcaggttcgcgccagctcgggcctgacactcagggcaaagcggctccaaactgcccactgagcggtccgcacacacagtccttgccctgcaggcttttcctggacgactgctgaagttctagtcgattccacagccaaaaacatggaacaccttgagcaaaaaccattatccaacattagccgttttgtttttttttttttttttttggtcaatgaacttttgttacatgaagaacagaacaaagctggatctaccatatacctggtttgaatttactggccagaacattagcaattaggttttgaccaataatatcaagtcttttcagaatatctctggggaagaaaaaactaaaacaaaatgacagcaaacaaacttcccatagcggccagattctaagtctagtgcttttaattgaaagaggagaaatttggccaactaaaactacatcatattcgtatgcgatgaaaagaagaaaataaacatttctggtcagaaatgtagatatgattaattttaaatggaatcttaattaaaatatgacaacttgaattttcaaaaaaatgtccttggccgggcgtggtggctcacacctgtaatcccagcactttgggaggccgaggtgggcggatcacctgaggtcaggagttggagaccagccggaccaacaaggagaaagaaaccccgtctctactaaaaagacaaaattagccgggcatagtggtgcatgcctataatcccaactactcgggaggctgaggcaagagaattgcttgaacccgggaggctgccgtgagccaggatcgcaccattgcactccagggtgggcaacaagagcaaaactccgtctaaaaaaaaaaaagtccttttgttatgctattttaaataaaactttaaacacttattaaaagtatggtatacatttaaagatagcttttcctcgaagaaaatgtcagcaaggaaaatccttgaattctgtaacatatggtgtttttgagtagctatattcatcatataaaagcaatttatattttcattaaagaaattcaaattttacttatttgacactaatacctacacacaggaaatttcaaacccaagaaataataaattatcgttattctagaaaacctggtaccaccttgctctaccacagccattgctgtggttttcatctttagatgtcttgggtgctgagagctggccctgcatcccaggcacattcagattctctggcaatcaacttttgtgggagaagggaagaaaatacgatggggtagagagagaagttggacactgacgcaatcaacatcaagcctcagccaacccccaaggcagtctgaaactggacaggctcttcacagttgcccagggaggccaaacagagagagtctttataccctggcaaatgctagtcatggggagacagatgccagagggagggggcctggacttcagcaagtggctttcttcagcctgaggtaattcgccaaacgtctggggaactgcagctgacagctgcgtgtctctcccagcagtcagggagtcagtctttcaacctgcaatcggagcatgcagccatttggggactttcagtttgcagagtaaggagagctttggtctggggcggaaactttgcttttctttttgttgtttttctgcttttttttctactggggagaactgtattcttaggctctgcttcttccgtgggtcccactgtcttcaggagaggccttcttggacaagcagcctcctttccttagagagcaggtcatgggatttccaaggtcacaagtaatgtctaccagacattccgtttacatacagagaagggagacaactgtctcaaaaagtctctttattaaatcatcccctggtcatcctatgtcatagccctatatttttccttttatggatttactccagagtgggaggaaacccacatttttctctgctgtcttgggctatggcttcaccttttgtttaaaaatcaatctcatctcatctgctattttccaagaacttttcaagaatctagtctattcataacaccctttctggtttttctgtgctgtgatgactttccttcttaaacctacatttattttattccattttgctcttgagcaggaagtctgtgtattaagttctggccttgattgcaaatgccaagtcagctcagtagaatggaatgggtatgggttgtggcttcaggcagacacttcactcgggtctaccacttactatgcaacttagggtcaatcacataccttttgtgagacccagggtctttttaaagtgggaatagctggtgcggtggctcatagctgtaatcccagtactttgggaggctgaggtgggcagattacttgaggtcaggagttcaagaccagcctggccaacatgctgaaaccccatctctactaaaaatacaaaaattagccgggcatggcggcgggcacctgtaatcccagctactcgggaggctagggcaggagaatggcttgaacccgggaggtggaggttgcagtgagctgagatcacgccactgcactccagactgggcaataaggcgagactcagtctcaaaaataaataaataataaaataaagttggaataatagtatgtactgcataaattagacataaggatataaaagtgcttagcataatgtttggtatagaacctgcacacaagcaatggttgtcctctcctttctttgtatttgtatccctcataacattttttgttttttgttttttgttttgttttgttttttgaaatggagtcttgctcttgtcgccgaggctggagtgcgatagacgatctctgctcactgcaacctctgcctcctgggttcaagccattctcctgccttagcctcctcagtaggtgggattacaggctcccgccacaacgcctggctaatttttgtatttttagtagagatggggtttcaccgtgttggccaggctggtcccaaactcctgatcttgtgatccacccgtctcggcctcccaaagtgctgggattgcaggtgtgagccaccatgcccggcctgtatccctcataacattaatgtgccttgtgttctcatgaaaaagaaaaactttaatacaatccaaaatccatcagaaaacgagacaaacaaccttaaagattcagcgaggcttggtttgtttctaaagtgatcgcttaggcaatagtgcctataatatcgtcaccaccaagtactgccttgaggtgtcacagaatgtcatacgtgacagtgatagcattctacattacaccctcttgcttaacatatttgtttttaacaatttttttatttctttgtaaacttgactggttaaaataaactagtattacctagaagtaggaggtcaatcaaagactaatctacagatatatgaaattcagctggagtcatttatatgtaatagttgtatgacatctgagaaatatcacaggactaggccttctacttgccagatctgtgactttgctttgagcctgtcactttgacctttagcctcagggtcccagcagaaaaccttcttaatatgtctcctgtgttagtttcttaggactgctgtaacaaaagttccacaaacttggtggttgaaacaagagaaatgttttctttcacagttcgggcagatagatgttcagagtcaaggtgtcagcagggttggttcctcctggagactctgacggagaatctattccatgtctctctctgttccctggaaagactgtatatggaaagtggtctgcaaatgccaaagcagctgagaaaccaaagaacgaggcagacaaatccagcttgtcagtagagggtgatttattggagaatttatagacagaagcgcaatcttgggtggcagcaagacaggcagataggcagatctctgcacctgttacccccagacccagggctcatagggaaaaggtgtacatcgtctgtatgaataactaagggcagctctccagaaggggcaagaatgccaggtacatcacagcctatgatttgcgcaataatgtcaaggttgacatttacacaagggacagtacgtaaagtaggaatcaggaggcattcacaagactggggttgatcagaagtcaccgtggcagattgacatcaaggtgaggtcacttttgctccccactctcctagtttctggcaatgtccagccgtccttggcgttcccggctttcggtgcattgctcccatctccacctctgtcaccattccactgtctttcctctgggagtctctttccatgtttttacctggcattctcctatgtgtctgcgtcctaattttcctcatcttattcagacaccagacattaaattagggtccatcctaattcagtccgacctcatcataacttgattacatcatcaaagaccttattcccaaataagaccactttcacaggtcctggggattcggacttcagcatatcttttggagaataaaattcaacatgtaacatttcccaaacatagaacattttacagtggctatggtagttaagatattgtgtgtcatgaatctaaaaccaagtaaccaaagatgaaatattttgagaaggattcttgaaccgcctggaattgagttggaaattatgaacaaaaggaaactgaggacagcaacgttaaagggaattggggaagacctttcttctcattcctgctcatctatgtacctctgctccattcttctctctagctgtaaatcaatgttctctgttttccattttgtgtcacagaacatggctaccgacaacgtcccagggctgaagagaaacgtcaaccaagaagataccaatatgaaccctttttaatagagagagatggagaaggagaaacctcagagacttgccttctgactttatttttccccccaaaagagatgggcttattttctgcaagaaaagaggcttagaaggcatttttaaaaggagccaatattaaagttttgtgaaagtttttctagggaaggagagttattgatggtaggatggtgtggcatgttcggtatagatgatagaagtgagggtgtgttagggcccaggtaaaggcaggacaccatgtgtgtttagtgggctgactttctcctcgtttgcttttcatcagcaatggtcaataactcctgtgtgtcagatggttactagaggaggatgttagacagctgctaggtgagcccagcatctttacatgaacaacccaaggggacactgcaagtttattcaaccttatctgtgttagagtatcttcatggccacacggtaggttgtgagatggacatataaagttttagtaaaatcacttttcagatttccttgtagatatgtctaacccttaacttccaaggaaaagcaacattttaaaaaataagtcaggccttcttagtaaatatgtgttgaattactaattttataaattgaactcacaaagaaataacatttgatttataaatatgggtatgtgtggttatttcatccttggagaaacttcaggagcgaccctttgctctttataaatccactgactcaggcagagtcataggcaacagaaagaagcccacattcttgcctcactagttcattagtttttaagcaagatatttaaaaattacctctagcacactaaaaagtactgtcttgccaaaactttagttttttttcctttctctttttgtttgtttgcaaggggcagtctaaatagaatatcaacttaaagaaggccagggcatggtaaattaatttctttataatcttattttctatttctcctttttcttattttttctttcttcttctcagttgaaatactcttttcaatatttgttaattacctatcctgatatttttaaaccatcatctccctctctccaagctttccttattctcattccccaaataatgtaagtctaaggaagcgtctttctaaaagctttcccacaggtaggtgataaaaagctgaggagattttcttctttcttttcagtgggtgttggtgtgatcagtgacgggagaaagcagcttcccgtgcagtgcagttcttgtaaagggaggagtagaggggtggtgtctgtttgatgaatagctttcattgttttttatttattttccccaaagcagtgttctccgggcagaatacttgattgtaaaagcaggagacttgtattcaccttctcgttttacattgattttctgttctgcttgaagcctttgtgtttataaatgtaaaaagaaaaaattaggaaaatctgcctgtatttcacatggtgattttgggcctgcctcttgactggggcaccagttgcctttttcataggaaagtgtagaggtgtagacttcacatccaccgtatgcactaagcttccctagaggtcatctgcctgtgggtattaaatggggctgtaatcatggtctctgctggactttattcccctgtgctcatagttttcagagtgttggtgagtgattcaagcaagtacagccaactgtgttaccagctatcacacgatgccctatttttctaccagctatcacacgatgccccatatttccttttttctcccctttctgccatccatcgggcaccagaaccctctgtcccctgattcagctatgactctccgaagcttcagggcgttgtcatgttaggggagggtggggacggacctgcatttctctcacattcagtcacatcccattagacctctgtatagaccccatgctgtactcaggatctctatcatcccattagacctctgtatagaccccatgctgtactcaggacctctccacattttcacttgcttgaacttgctgtgactctacagttttcatgcccttcgggtgagttatgccctaggatgcctcacagtttcccaaagtgagctttgtccaactgaagtcaaaacagacacctctctaatgactgtagtctgtacaatgtagatactatattcaggaaaaataaacaaaatacaaatttgtctatatatgtgtatgtgtgtgtgtatgtgtaagccccaatatgtggtgttttatagataatgggaatattttctttgaaaatatcaatcttaaagaaagatttaaaagtaagaacaaatagaaatatcttttatgcatattcatctatttttgaagtctgcaactgcaacagtggattcacctattccttgcatttctatccatttttgcctcacatgttttgatgctctgctgttaggctcctgcctgttaagcactgttacatcttcgtggagaaatgacccatttatcgtcacttaatattcttcttctttactcctgataactttccttgttctgaagtctgctctgcctaaagttcacagagttactcctgctttcttttgattagtgctagtatagtgtatctttctccacctacttactttttttttttttgagacggagtttctctctttgttgcccaggctggagtgcagtggcgcgatcttggctcactgcaacctccacctcccgggttcaagtgattctcctgtctcagcctcccgagtagctggaattacatgcacccgccaccacggccagctaatttttctacttttagtaaagatgtggtttcaccatgttggctaggctggtcttgaactcctgaccttagatgatctgcccacttcagcctcccaaagtgctgggattataggcgtgagtcactgcacctggcccatctatttacttttaatctatatgtctttatagttaaagtgagtttcttgtagacaacatatacttgggtcttattttttgatccattctgataatctttgtcttttaatagttacatttagaccattgatgttcaaggtaataacaggtatagttggattaatatcaactgtatttgtaatactttctatttgttgaccttttttttttttttttttgggacagggtttttctttgttccccaggtgagtgcagtggcgcaatcacagctcactacagtctcgacctcctgggctcaagtgatcctcccacctcagcctcccaggtagttgggactacaggcacatgccaccatgcctggccaatttttgtatttttttagagacagggttttgccatgtcgcccaggctggtctcaaacttctgagctcaagtaatccacctgcctcagcctcccaaagtgctgggattagaggtgtgagacaccacacttggcctccctggttctttgtttctatttttgtatttcactctttttctgcctttgtgtatttaattgagcattttataggattcaatttcctctcatttcttagagtttgcaatacacgtttacaaataatataaacccattttgaaacaacacttaccacttcagaatagtatgaatagcttataataacaatcctaaatcctccctcccatttcttgtatcattgctgtcactcatttcacttacatataagcatacatacatatatatacacacataagatagatacataagcatatataataaaatacattattgctgttgttattttgaacaaattgtaatctcaggccaatcaaaaataaggaaaataaagaattttaatttaccttcactcattatttaatcaatgctcttcctttcttgctataaactccagtttctgacttaaattattcatcctctccctaaagattttcttttaacatttcttttcttttgaaaatagaatcatgctttgtcattcaggatggaatgctgtggcataatcaacactcactgcacctcaacctcctgggctcaagcaatcctcccacctcagcctcccaaggagctaggactacaggcacttgctcactacaccttcaacctcctgggctcaaacagtcctcccacctcagcctcccaaggagctaggaccacaggcagttgccactatgcctggctaatttttatttttattctttgtagagacaggtgtcttggatttttggcccaggctggtctcaaattcctggactcaagtgagcctactgccctcagcctcccaaagtgctaggattacagacatgagccatcatcaaccacgttcttttagtatttcttgcaacttacagaattttttttttatctctagcatttctttttgtttttttcttaagattttcatttctctgtttacattgctcacctgtttttgcatgctgtctgctttatgcgttagggcttttagcatattaataataattgctttaaattccctgtttgataatcccaccatttttatcatgcctggttctcatgcttgctctttctcttcaatctgtatttgttttttgttctttgccttttagtatgccttgtaatttttttttttttttttgagagccagacatgtattggataaaagtagctgctgtaattaggccttttgtaatgtagtggtgaaatgttgggagagtgtaaatgttctacagtcctataattaggtctcagtcttttggtgaacctatgcctttggactgtaaccttcacaaatgtttctgatttcccactcttaagtgggggcaggatggctagatgggctatagttgagtatttctctgctctcatgtggaagctaaagttggctgcagttgtgcattttctctttcacaggttagttagactatgttaaaaccctgtcaagttaggctctatttcattcctcttcagggtagacctcattaagcagaatgcagtgccatgcatacttcaaaatggtttcttttcccctccccttgctagaagcattgggggatttttctccaatatttagaatgtgaacctggtcaaccttgagagataagaatacaaaagcatgggggctccctataactggaacttcatggaatttttaactctcagacttgttcacactgatcctccaacaatttatcaattaaagttcagatttccttaccctggcactggttcctgcagagaattttgctccagtatggtgtgattctctgtatatgcctttttgttttcaatctggaggcagcagtttgacctaatttttcttatggctcttggcatacttgttgatttttcactttttttttcaagtttatacttgttagaataaagttgtgacttccaagttcttttcatgaggaactcaagattcatctatttttaacatttttatccatttccattttccatttggctgtcctttctctgtaaatatacccatgcatatttcataagaattgggatattctctgacagaactacattacagttaccaacttcaggaaatgagattaaatcttttaatccaatcgaccatcagtattctaattctgtcaaatgacctatcaatcttttttgttttgttttgtttttgtttttgagacagagtctcactccattgcccaggctggagtgcagtgttgcaatcctggatcgctgcaacctctgcttccctggttcgagggcttctcctgcctcagcctcccaagtagctgggattacaggtgtgcacaactgcacctggctaattttttgttgttgttgtattttcagtagagtcagggtttcaccatgttggccaggctgatctcaaactcctgacctcaaatgatccatccacccctgcctcccaaagcgctgggattacaggcatgagccaccgtgcccggccaaatgacctatcaatcttttttatagtacttttctcttcattacaggatttagtctaaaatcagatgtttagtttttatgtctctttattttcttttaatctagaatatgctagaacacttccacaggattctttgtcttttatgattttggctgcttagaatattcctttgggtttttctggtgttttctcataattagatttaatttatgaattcctgaccatatcacatctggggccacatgacatcctcatgttcctcaatggcaacattactttcgatccgtctgttaagatgtcatccaatttctccactatataattattatattttcccatgctactcataagtggtccaggagaaacactttatgaccatgcaaatatcctatttttcatcaaaatattgctctggatttaatatctttgtgatttgtgcctgaactaatctttattttgatggttataaaatgatgattttctagttctgtttccagtttcgatttctagtttctagaagccggacaggttcttctttcctgctgcacagatagaatcgatttgccaagacagctgatttccaatagagaaagatgttaataaacacagagccagcgaagcagaagaccagaatttattgctcaaaacagtctctctggaaatttggagactaaggtttttaaggataacttgctgggcgggggggtagggaaatgggtaatgctgattggttgggtctaagatgaaatcatggaggctaaagctgtcttctcactgtctttagtttctgggatcacaaaaccagttgagccagtttattggttcaggtgtgcaacagctggtccaatcacatgcagggtctgaaaaataccctgaacaccaatcttaggttttacaatcatgatgttttctataggagcaattgaagaggttacaaatcttgtggtctttggctgaatggctcctgagccacaaccctcaacttgtgccaaatttgttagttttctgaaggaggcttttggtccctgagtcaggatgagattcctttccagaagaagctgttatcatctttgttttaaagttaagctaaatttcctccacaattagcttggcctatggccaagaattaacaaggacagcttggaggttagaaacaagatggagtcagttaggctggatttctttcactgtcataatttttctatgtcatatttcttttactgtcataatttctgcaaatgtggtttcagttttagcactccctacacattttctacttggggtgtaacagtctattgtcagcaaaataaaagctaggtcttaagtcaatgtgaattattggacctgaatttgtgtgcatgccgacacatatacacaccatgcacacacatatgtatatttttaaaaagataaatgcatatatatctgcatatttaatggatgagaagacttttcttctttatatcacttgtgaagagctttgttctcatatgctgatttggaaatctcagaatattttttgatcctagtattcaataatgagtaatcaatcatgaaacctctgttgaagtttatattctaaaatcgtcatttatttttaaaaattcatttgaaaacatttagttgtggctataagttgttagtagaaaaaattagaactgaaactcacttgttaccagaactaaagaaaaaaggcaaaaaggattttatctctgctttgcatccataagggaaatgaacataactaatattcggtggaacttttatgtaaaaatacagctcttgaatttgtgaaagcaaatataagccaacactccttttttttaaaaaaaaaaattggttattacctaatttacgttgtgtctacataaaccaatttaaagtctgattttaacattcagtgtgggccaagagaaggggaagaaaagtaccattaagataaaaaaggggaggggccaagatggtggaatagaaacaggtccagtctacagctcccagtgagaccaatgcagaaggtgggtgatttctgcatttccaactgaggtacccagttcatctcactgggactggttttgggtgcagcccagggagagtgagcagaagcagggtggggcatcatttcacccaggaagtgcacggagccgggggacctccctcccccagcgaggggaagtgatgagggactgtacccaccccgggtacagctttcccagtggattttttgcaatctgcaaaccaggagattctgtcgtgagcctgcaccaccagggccctggatttcaagcacaaaactggacagctgtttgggcaagcactaagctagctgcaggagttttcttcataccccagtggtgcctggaaccccagcaagacagaaccatttactctcctggaaaggaggctgaagccagggagccaagtgttcttgctcagcaggtcccactcccatggagcccagcaagctaagaaccactggcttgaaattctcactgccagcacagcagtctggagtcgacctgggatgatggagcttggtcgggggaggggcatctgccattactgagactttaggaggcgattttcctctgacagtgctaaggagactgggaggtttggattgggcagaattcaccacagtgcagtgaagcagctgcggccagactgcttctccagatttctcctcactgggaaggcatctctgaaggaaatacagcagccccagtcagaggcttacagataaaactctcatcttcctaggacatagcacctggggagaggggcagaggtgggcacagcttcagcagacttaatcttttctgcctgccggctctgaagagagcagctgatcctgacaatggggattctccaagcatagcacaccagctctgctaagggacagactgcctcttcaagtgggttcctggtccccatgcctcctaactgggagacacctcccaaaaggggtcaacagacacctcacagaggagagctccaactggcctcaaaccggtgcccctctgggacaaagcttccagaagaaggagcaggcagcaatctttgctgttcagcagcctccattgttgacacccaggtgaacagggtctggagtagacctccagcaaactccagcagacctgcagaagaggcgactgactgttagaagtaaaaactaacaaacagaaagtaacaacaacaacaacatcaacaaaaaagaacccacacaaaaaccccatccaatggtcattagcctcaaatatcaaaggtagataaatccatgaagatgatgaaaaaccagtgcaaaaacgctgaaaattccaaaagctagaatgcctcttttcctccaaatgatcgcaactgttctccagcaagggtgcaaaactggacagacaatgagattgatgaattgttagcagtaggctttagaaggtgggtaataacaaactcctctgagctaaaggagcatgttctaatccaatgcaaggaagctaagaaccttgataaaaagttacaggaactactaactagagtaatcagttcatagaggaagataaatgacctgatggagctaaaaagcacagcacgagaacttcgtgaagcatacacaagtgtcagcagctgaatcaatcaagcagaagaaaggatattagagattgaagatgaccttgctgaaataaagtgtgcagactagattacagaaaaaagaatgaaaaggaacaaacaaagcctccaagaaatatgggactaggtgaaaagaccaagcctgtgtttgattggattacctgaaagtgatggggagaatggagccaagttgagaaacacacttcaggatattatccaggagaatgtccccagcctaacaagacaggccaacatttgatttcaggaaatacacacaacacgactaagatactctatgagaagatcaacctcaagacacataatcatcagattctccaaggttgaaatgaaggaaaaaattttaagctcagccagagagaaaggttgggtcacttatgaaagaaagcccatcagactaacagtgtatctcgctgaagaaaccctgtaagccagaagagagtgggggccaatattcaacattcttaaaggaaagaattttcaacccagaatttcatatccagccaaactaagtttcataagtgaaggaggaataaattcctttccagacaagcaaatgctgagggattttgtcaacatcaggcctgccttacaagagctcccgaaggaagcactaaatatggaaaggaaaaaccagtaccagacaccacaaaaacacaccaaaatataaagacaatgacactacaaagaaactgcatcaactaatgtgcaaaataaccagctagcatcatgattacaggcccaaattcacacataacaatattagccttaaatgtaaatgggctaaatgccccaattaagacactggcaaattagataaagcgtcaagacccatcggtgtgttgtattctggagacccatctaacgtgaaaagacacacattggctcaaaataaagggatggaggaatatttaccaagcaaatggaaagcaaaaaaaagcaggggttgcaatcctggtctctgataaaacagactttaaaccaacaaagatgaaaaaagacaaagaagggtattacataatggtaaagggatcaattaaagaagaagagctaactatcctaaatacatatgcacccaatacaggggcacccagattcataaaacaagttcttagagatctataaagatatcttcaaatcttagagatcaacaaggagagctaactatcctaaatatatatgcacccaatacaggagcactcagatttataaaacaagttcttagagatctacaaagatacctacaaatcttagagatcaacaagaagagctaactatcctaaatatatatgctcccaaaacaggagcacccagattcataacacaagttcttagagatctataaagagacttacactcccacacaataatagtgggagactttgataccccactgtcaatattagacagatcaacaagacagaaaattaacaaggatactcaggacttagactcagctctggatcaagtgggcctaatagacacctacagaactctgcatcccaaatcaacagaatatacatttttctcagtcccacatggcacttattctaaaattgaccacataattggaagaaaaacactccttggcaaacgcaaatgaatggaaatcataacgaacagcctctcagaccacagtgcaatcaaattagaactcaggattaagaaactcactcaaaaccacacaactacttggaaattgaacaacctgctcctgaatgactaccgtataaataatgaaattaagggagaaaaaataagttctttgaaaccagtgataacaaagagacaacatatcagaatctctgggacacagctaaagcagtgttaagagggaaatttatagcactaaatgcccatatcagaaagctggaaagatctcaagttaacaccctaacatcacaattaaaagaactagagaagcaagagccaacaaatgcaaaagctagcagaagacaagaaataactaagattggagcagaactgaaggagatagagacacgaaaagcccttcaaaaatcagtgaatccaggagctggtttttttggggggaaagaaaaagatagaccaccagccagactaatgaagatgaaaagggagaggaatcaaatagacacaataaaaaaatgataaagaggctatcaccactgatgccacagaaatagaaactaccattagagaatactataaacacctgtacccaaataaattagaaaatctagaagaaatggataaattcctggacacatacatcctcccaagactaaaccgggaagaagtcaaatccctgaagagaccaataatcagttctgaaattgagggagtaaataatagcctaccaaccacaaaaagcccaggacaggacagattcacagccaaattctaccagaggtacaaagaagagctggtaccattccttctgaaactattacaaacaataaaaaaagagggactcctccctaactcattttatgaggccagcatcatcctgttaccaaaatctggcagagacacaacaaggaaagaaaacttcaggccaatatccatgatgaacatcgatgaaaaatcctcaataaaatactggcaaattgaatccagaaacacatcaaaaagcttacccaccaagatcaagtcatcttcatccctgggaggcaaggctggttcaacatatgcaaatcaattaatgtaatacatcacataaacagaaacaatgacaaaaactacatgattatctgaatagatgcacaaaaggccttcaataaaattcaacatcccttcatattaaaagctctcaataaactaagcattgatggaacatatctcaaaataataagagctatttatgacaaatccacagccaatatcatactgaatgtgcaaaagctggaagcattccctttgaaaactggcacaagacaaggatgccctctctcaccactcctattcaacatagtattggaagttctggctagggcagtcagacaagagaaagaaataaaagatattcaaataggaagagaggaagtcaaattgtctctgtttgcagatgacataattgtgtatttagaaaaccccatcgtctcagcccaaaacctccttaagctgataaagaacttcagcaaagtcttaggatacaaaatcgatctgcaaaaataacaagcattcttatacgtcaatcatagacaaacagagagccaagtcatgagtgaattcccattcataattgctacaaagaaaataaaatacctaggaatataacttacaagggacatgaaggacctcttcaaggagaactacagaccactgctcaaggaaataagagaggacacagacaaatggaagaaaaattccatgctcatggaggttaaggatcaatatgatgaaaacggccatactgcccaaagtaatttatagattcaatgctattcccatcaagctaccattgactttcttcacagaattagaaaaactacttgaaatctcatatggaaccaaaaaaagagcccatatagccaagaaaatcttaagcaaaaagaacgaagctggaagcatcatgctacctgacttcaaactatactacaaggctacagtaaccaaaataacatggtactggtaccaaaacagatatatagaccaatggaacagaacaaagacctcagcaataacaccacacatctatctacaaccatctgatcttcaataaacccgacaaaaacaagcaatggggaaaggatttcctatttaataataaatggtgttgggaaaactggctagccatatgcagaaaactgaaaccagaccccttccttacaccttatacaaaaattaactcaagatagattaaagacttacatgtaaaagcataaaaaccctagaagaaaacctaggcaataccattcaggacataggcatgggcaaagtctttatgactaaaacaccaaaagcaatggcaacaaaagccaaaattgacaagtgggatctaattaaactaaagagcttctgtgcagcaaaagaaactagcatcagagtgaaaaggcaacctacagaatgggagaaaatttttgcagtctacccatctgacaaaagtctaatatccagaatctacaaagactgaaacaaatttacaagaaaaaaacaacaccatcaacaagtgggcaaaggatatgaacagacacttctcaaaagaagacacttatgcggccaacaagcatatgaaaaaaagctcaacattactgatcattagagaaatgcaaatcaaaaccacaacgagacaccatctcacaccagtcagaatggcaattattaaaaagtcctgaaacaatagatgctggtgaggctgtggagaaataggaatgcctctacactgttggtgggactgtaaattagttcaaccattatggaagatagtgtggtgattcctcaaggatctagaagcagaaataccatttgacccagcaaccccattactgggaatatacccaaaggattataaatcatcctactataaagacacatgcacacatatgtttactgcagcatcatttacaatagcaaacacttggaaccaacccaaatgcccatcaatgatagactggataaagaaaatgtggcacatatacatcacggaatactatgcagccataaaaaaggatgagctcatgtcctttgcagggacatggatgaagctggaaaccatcattctcagcacactaacacaggaacagaaaaccaaacactgcgtgttctcactcataagtgggactgaacaatgagaacacatggacacagggaggggaacatcacacaccagggcctctcagggactgggggcaaggggagggagagcattaggacaaatacctaaagcacgcggggcttaaaactagatgacgggttgacaggtgcagcaaaccaccatggcacatgcatacctatgtaacaaacctgcacattctgcacatgtatcccagaacttaaagcaaataaataaataaataaataaataaataaataaataaataaaaaatgggggaagaaaaatagaggagagagggaggttatccatctatgcatctgttttttcataacaccaagtacttccatttctatgtgctaaatatatgatatttattaaaaattgaattgccattgtaatgatattaggaggtgggacctttgggaggtgattaggccatggctccaccctcatggatgggactggtagagtctggccccctcttgccttctcttaccctctccttgcccttctactcttctgccatgtgaggaacagtgttccccccctctaaagcatgcagtgtgcaaagtgtcatcttggaatcagaattgccaaatctgctggcaccttggaccttccagcctccagaaccataaataataaatttctattctttataaattgaaaaaatataaaagaagcatttcaactccttggaaatatgctacctccattgtttttggttggtgacatgcagatttgctcttttatcttgtgctttttttctcttctttcagtcattatattaaaaaggaaggcacttagttctacttaactctgttgaatgctctgtccactaacagctgaatgtctcaacaactacacagcattaggatcttggcggctcccgtgtcaacttccagcgctctaaacagtcccctgccctgtgcaatgagcatcatcaaaaagacctaccaagagaagcaaaaacaaagcaaagccttttctctgaatacactaatttaatgtattcatgtgaaagtgcttcatatcatacaattttaaggccaaagagaaagaacgtagcaaaaagttctttaaattttttgtgtgtgtatgaatagttagctaagaatcctagttgaatctctgagagttagcacacaaatgcacagacgctcgtactctgaatatggttgtattttaacaaaagataatcacatatttcttaagtaaaaacatgagttcaatatctgaattcggcacgatggggatgggagaacagaggcaaatgaatgtggttaattatgccagttaccctgaatggatactgcagtcactttcctggcagcagtaggcagcagggaagtgttagagctgctgagtccccgcagcagctggagaagctggaaaagcgagaggtgctaaagatgtttctggactggaagagggcggattccgtactttctaactgcaccctgttttcacactggtgaagacgactctgtcctcagcactcagcagtacactgtgtggtccagaggctgccattcacagttgttgggaagacgtaaaagcatgcagtgaggcctcccaatacagtatcgtgtgttgttctcttaagcctttccacttccaggtaacctactttctctttgcagaggttgctgaagtcaaaagcagctcactcccagttcactgagcttgagttccggctgcaacttggccttgagatttttgaaacgttgatatggaagataaagaaaaacgcagattcctgtcttctaaggaacaaaggctggaagacagttctgcagattctgcctttgagggattagagggatgtgcccaggaccagatcttcagttatgcaaatataccttagagaccacagtaagaaagacatcgctctgaaatgctctggtcccaaggaaaatattgctctatataataatggaaaacgttgtctgtgtatcatgctgagctgcattttattttgtacccttgagagagcttttattttcttataaataaggattggtcttgttctgggtctgaaaactgttgtgtatttttgagatgtctatttttcttttcagttgcctgtaagagattgggagccgagggcctgagggtgaagcctcgtttgtgcaggtgactgtgggactctggtgtaagtaacgctgggcccaccctggtaatgaaggaagacccaggcccaggcaggggcggtgtcacaggcacaggggctcgcaccctgggcactgacggtggctgtcgcaccagggccgctccttgcagaaacctcactgagcctgtgcctgttgagtagcttcatgaggagcggatatcaggcagagaaagcccgggcaagagagtgacacacggggcttctgcccagaacacgtgcgcccacaatcccgggagctgtacaaatcccaagcggggaagcggaggcctcgacagttcatgatgcggacatgaatgggaatgcggccgcttgccacacctccttcttcatttggggaaatgcttgaaggtttgttttgtgaatgctaggttaaggtttggaagtttattttaaaaattgacatcatggccgggcgcggtggctcacgcctgtgatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcgggagaatggcgggaacccgggaggcggagcttgcagggagccaagatggcgccaccgcactccagcctgggcgacagcgagactccgtctcaaaaaaaaaaaaaaagaaaattgacctcaggcagggtgtagtggcgcacgcctgtaatcgcagcactttagaggctaaggagagagcccagaagctcgagaccagcctgggcaacatagtgagacccccatctctaaaaataattttttaaaaattaatcgggcatggcggtagaggcctgtagttccagctacctcagaggctgaggcgggagaatcacttgagactaggaggttgagcctgctgtgagccggatggtgctactgcactccagcctgggtggcagaatggaccctgattaaaaaacaaacaaacaaaaaagatgtatcaacattagccactcagacattgttttaaaatagtttaatcttctatttgagttacaacctgaggtaactcccaatgaaggagataaattatatagaaattaaagaatttaggggaagactctgtaaaaatgtgaaagaatggaaatcagggtgcttcggtgggggaacggtccatgtgacaaatggaatgcctggaaccgggagggcgctgggtgaggacagagctgcactaagtataaatccatttataatctgtggtctgagaccagtgagaaatttacatcctccattaggttttgagaaaggctcacagattttccctaaaaacaaatgtaataaaaagataagaagtcaccaatcccctgtaaaccttgtcatgtttcaagtgaaaacgtagcccaaagtcagaggcatggacattgtccccagagagatggcccaggcagggggcacgtgggtgctgacgcttatggcagttgaggggatctggatgggctattggaaagagattgccttgctgtagcaaatccctgccagccataatttaaagggacagaagtcattagtctgcaatgtcgctgtctttgtaccaataaaacttgtatttgcctttctttgcaagcctcattgctctgtaactcaatgtcagcagtgagtgagacctgtctcagaaacagtgacaactgcaaatttcagcagcattaatgttatacacgtgcatctggtcttctgaaggttaagtaagttgggctgttttccaagctgcacctttattctcagttctgccagggaaggaaaaaatactgctgatcttctatggtccagaaagtttgtaccatttgttttctaataaaagcaacaataaacttaactcaaaagggaaattgaagttctagcctcttgtttaactgaatcaattgtttgaaatttaatcacaaagcaattgggcaagtttttctctgatttgtttggacgtaatctagcaatctgctgctaaatccttgttctttggaaaagaggtaaattcggcttggagcaccctccttacagcctgcgtgcgtctaaagctctcgtcataatttatgtgaattaccacacatttacgttttcatggaccattttgcctgaccactttgttctttattagtagtaatatacaggatctagcaatcactttttaatatctgaatatttgcataaaatctcactctcgcctcctgtggctcatgaaaatgtttcacacaaaccttaacagggctcttcctaagatgtcctgagacgccgtctagggaaataaacaattctcaccttgttatttatagaatatgtcatattaactcagtacttaatcctctacaattctttctgtgcatgcaacggaacctaatcatcacgactatgctgtgagggaggaatggcccctttattgtacagctgaggtgaataaggtttaagccacacgcagttgaagtcactgcttacaaatgcgtatctagtggggaaattggggcttgatgccattcgtttgccctccacgttttatgctcttttttctgcatgactctgcctctcatgttattatgggtctcacccctgcagtatgtggataatttgactgtttcaagtgtgatgactctgcctctcatgttattatgggtctcacccctgcagtatgtggataatttgactgtttcaagtgtgatgactctgcctctcatgttattatgggtctcacccctgcagtatgtggataatctggctatttcaagtgtggttccttaactgtgactgtaactccatttcagctcctattaagaggtgaaaaatacttccctgtctcttaacttggatggagcttgtgatttcctgtaatcaaataatctgtaatattgcatgccttctaagccctggactcaggatgcctgtggcttccaatattattttcttggaatgtttctgacactgtgtgaagaagcctagaatgaagaccacatggagagagacacctagctgtctcagtcatttcagccttgaaacttaggctcagaaatatgagagccgcccactcagaccttcacttccagccgtgctgcctgcagcctgtcccactgcagtcagcccagggcaggtgagcagaacaaatgccctgtttacctacagagttagcagaaataaaacatggtggttttggtgcagtttgttacacagcagtaaataactgatgcagcaagcattattagaaatcactgcacgaatgcataggcatgtttaaaattcattacgttaagagcaaaaaaaagtatctcatcatgatgcaaaggaaagtaacagtaggaagggttatttcctaggtccaagtgttattatttttatttcctgaattcactatgaggcatattgtgggtcaaagttttaataagattaaaaacaatatagtaggctggatgtggtggctcacacctgtaatgccagcactttgggaagctgaggtaggcagattgcttgagcccaggagttgaagactagcctggtcaacatggagaaacaccatccctacaaaaaatacaaaaattagcctggtgtggtggtgtgcacctgtagtccagctactctggaagttgaggctggagatggcttgaacccaggaagtcgaggctgcagtcagatgagatagctccactgcactccatcctgggttacagagtgagaccctgtctccaataatgataataataatgataataataatatattagtccattattaaaaatcataagggccaggtgcagtggctcacacctgtaatcccatcactttgggaggccgaggaagtcggatcacctgaggtcaggagttcaagaccagcctggccaacatggaaaaacccatctctactaaaaatacaaaaattagccagtggtggcgggcacctgtaatcccagctactccggaggctgaggcaggagaatggcttgaacacgggaggtggaagttgcagtgagctgagatcgtgccactgcactccagcctgagcaacaagagtgaaacaccgtctcaaaaaaaaaccaaaaacaaattataaacaagtttggacagaaatagggtttcagctgcattataagaatttgctgagtcttataaaatgttttttattaatttttattagaacttataatagccattctattggattgaacagcacacattttttaaaaatatattaaaaataataaagcagttggaaagtgaagcaagttgttttccagcaagccccagctttgtgctttcagaatgagcttgaggtcagtcagacttgggttcaaatcatggctcagccgctcactggctttttgatgtttggcaaattgcttaacctctctgaggcttgattccctcaagtgtaaattccttagcatagctccaaattaatgatgagattcatttgtatttaatgtttcccttattttagaacatcccatgcctatgtttcaaaaataaaatagtgcttggccgggcgcggtggctcacgcctgtagtcccagcactttgggaggccgaggcgggcagatcacgaggtcaggagatcgagaccatcctagctgacacggtgaaactctgtctctaccaaaaatacaaaaaattagccaggcgtggtggcgggtgcctgtagtcccatctgctcgggaggctgatgcaggagaatggcgtgaacctgggagtctgagcttgcagtgagtggagatcgcgccgctgcactccagcctgggtgacagagcgcgactccgtctcaaaaaataacagtaataaataaaattaaaaaataaaatcgtgccagaacccaatttggtggctacaatgacaatacagaaaatatatcctccctggtatgcacaagtttccattaattctcttggtttttcaaagtaaacaacaatattgtcttcaaataatattaactttacttccttttttccaattgtcatcatcattattttctactctgttactgccttatgaccttgcttatatgactcaggtcttttaatatgtgttacaattatgaaaagagcttagtaccttgaatatctaggaaaaaataatctgaattttaaaaatcgaatcagggataatggcaatatttcagaagtagtgagatgagatgtgatgacggcaagaactaggaagatatcttaggatatcaaaaggcatgttttagaaaaaaagcaggcaggttccaaatggctgtctaatataccctggctatggctttgtggattcagtggtgacccagtgcagatcacaggccagggcagagaggactacctctagcccagctgagcactttgcaaaaatctcagagaatgaaggttctaaagacagatattctcattcgctagcctgggtttgggatgaaatctgtattttcaaaagtgtcccagataattctttgtatagccaagctggaaaccaatggtctaattggccatgtccaacgaacgaatagacaatctttttaatagatattaaaatgtattataccctaagtaaaaaagaaacccatttataattctccatttaaaagaaagagttccaataatatagattaaaaaaagtgtcacatggttttaaacacacacacacacacacatatatatatatatatatatatatatatatatttttgagatggagtcttgctctgtcacccaggctggagtgcagtggtgtgacctcagctcactgcaacctccacctcctgagttcaagctattatcctgacttagcctcctgagtagctggtattacaggtgcgcaccaccacgtccagctaatttttgtatttttagtaaagacagggttccaccatgttggtcaggttggtctctaactcatgaccacatgatccacccacctcggcctcccaaagtgctgggattacaggtgtcagccaccacgcctggcccgcatggttatatttttatattcttctctagtttgaaacaatgtaccttgtgcaaaatatcttctgttgattattatttgtaagctgcattttaagtttacaaagtaactctacatgcgttctttcctgcggccttcacagcagctcttagacagtgggagtagcaatgcctcacacctgcctagtcttatgcatcttgtaatgcacccttacttcctttctccatataaaacttacatgtggcattcattctctcagaactgaaatatccactgcttggagttctcaaaatatatggtgttgaattccacttttgtgctttttcgtatgtcggcccctctgctgagaatttcattcctggacttttatgcgaattttattcacataaacgaaggtctctgctctgtttgcgttcctggttggattgatcagcaggacaggcagggagccaagccctcaacactgctatggcctcccacatctctgaggtacatcgatagttcccaagtgcagagacaatcctcactgcccttccctgccctcttaggggatttgttttttgcacagaacatataacaaaggaaagaacccagcttcgactttgcatagaattccgttttcaaagctctgttgtccattttcctctgcatcagcaatcctcacacctgttttcttaacctcatcataacctcaacatacacaaaagatggccttagcacaggggcgaacctcttccgaatttcctaggtttgggcatgatcctctcgctgcttcctcagactcttccctttcctcttcctctaccctccccccaccacccaaaatgttgtaatgctagtgactgtgaattacttcatagtcattttcatacctttgcatgtctgtaattaataattaaaaaataaagtgtttgcaaattttagcactttaaatagtattagtgacaaatggctggtcacgtcattattgcgtgtcacgagtcaggaccccccagggtggaatgccagcctcctgccctctgccaccctttgctgcagatgaggcaagcctgctcactccgcaggcttccgctggggctatcggctcagtggctgtggagcatgtctgtcacgcgtgctgtacagttaggccaacgattagtgatgaaggtgacaaatagacactttttgccgtgcactgagggggtcactgttagtaccacctagacaggaatgtctaaagatgctgtcaatgcaaccagcaaatgtcgaatatatttttctcgaagacaaaacagtctaatctcatgtaagaagagtccattcattcgccttgttaacatgtcttagtcctatactagagaaagcataacctgatgtcattaattgaaggatgagactctgtggttatcgtgataataagtatatgtctggtctctgcccctggttcctggcacatggctcttaaaacccttggaatctccagagacacaacagtgtcctttgtatgctaacgagatgactggtggttaaggatccctaactaacatcaagatggggcacagtcaccagaaagaccaaggactgattagtggtcgggattttcagccccgcccccaacctccaggtgagaaagagggctgaaagttgacttggtcaccagtgggcaatgatacaatcaatcatgcctatgtaatgaagtctccataaaaccccagaggactgagttcagagagcttctgaacagctgcacgcagggaagcgtctgaagggtgctgtactcagagagaacacagaagctccacacctcctcccgagtaccttgcctatgcattttcccatcacactgttctgcagactttgtaatatcctttgcaataaactggtaaacatcagtaatgtgtttccccgaattctgtgagctgtcctagcaaattaatcgaaccaaagaggggattgtggagaccccaatttacagccactcagtcagaagcacagatcacaaccaggcgcttacaactgtcatttgaagtgggagacagtcttggggactgagccctccacctgtgggatctgaggctactttcaggtaaatagtgtcagcattgagttacattgtaggacaccctgccgatgtctgctggagaattaactgattggttgttaatggggaaaaattcatacattccttttggtgaccagacatgaagtattcagtgttgcaggttgagcgtaagtatagaaaaaatagtttggttttctcttataactctacagagactccttctgtctgtctaaatttctgggggtaattacactaattgtaaacagctttgtctgctccatctggaagaaagtgctactagccataaactattcccactagagagtgatgatgtgtatggggggcatatggattggggagtggagaggggagtctgcaccctcagccctactagcaatgcaacatttggggaaagtagcgggaagggaacattctgatgccatgacagatatcttttcacacagatttattgtactagttttcaaggtaaactgttttagtagctaaacagaatttctttaaacatgtgggtaccaatttgctcctcgcgcagtgcatgtgatagtgagataaaaaccaatcacacagcatggctggagcacagaaaaacaacattttactttcttttttgagaataaatggctttgttaacacagccaaaacaattgatctttttatttgtattttattcctggtcaatattttaagggctgactggagacttgaggccctgttgggtggaattaaagtttacaacagcccacgttttccatagattatgaaggagccaagcaaacatggtctctattagaaactcaacaacctcagcccctagattaaaagaaaaatcactcaaaagcagacacacaaaatacaggaagaaggaatactgtctagatgtgagactgatttttctaagtctctctaaatttctaagtctgtctacaaatgtgctgatttgtagcttgctcaattatatgtatcatgaaattctctactctacgttctcttcttctttatacaactgtagaacagtctttgtcattcctgttttccaaacccctcaccatccaacactcccttcaactccatgtattcagaaaaaatattcctgaagagtaaaaggcaataaaattcccaaccattccacattacttctttattcagttttgcctttcagtgaagtatgatgtgggacagcaaacaaaataaatgagcgtagatgagaaaggcagtcacttttctcaactccggcaggctctccttttgacaggcattttctggctgtttcagaagttgtcatgcctggtagttgtggcccagacattgaactgtccagagaagttctcgtgctgtccaagcaaaatgcttgcatcctaattccagaatgcacaacacaacatttgtactaaaagggagagtcttcctgttcgatgatggtttcataaaaatcaggtggcactcctattttgttggatgtaatttaaaaaggtcattccgtggctgggcaccgtagctcatgcctgtaatcccagcactttgggaggcagaggcaggtggatcaaggggtcaggagttcgaaaccagcctgggcaatatggtgaaacccaatctttcataaaaatacaaaaattagctgcgcatggtggcgtgctcctgtagttccagctacttgggaggctgaggcaggagaattgcttgaacctgggagatggaggttgcagcgagcagagatctcgccactgtactccagcctgggtgacagagccagactccgtctcaagaaaaagatcattccttcatatatatatgttcatcaagatagtagacaaattaatacagaaaaagagattcttatttcatccatgaagatgcatggatacctgttcttctcacagatacacatatcctatttgttatatctgaacaaagtcttgaatattaaaacaaaaagtggatgaataaactctcgtaacatacctgcaactttagaaacgtacacatgatttagcccttagtggctctacactttcatccagctcgcagagactcagtgtttttcagaaggatcttatgtgactagaaatttaaggtagtgaatcaaacatttgccttactgtagcttaatattttaatacctctagtacattaaaaatagcatacacattcaaatttcattatatatattaaaattaaatttactttgggaattttatgatatcttcaaatcactgaagttaaaacaatggggttcaaacttatttttctattatttataaaataattttaattcatctcatctcttaaacataagacatgataatttatgtacaaaaatgtttaatgcagtgttattcatagtgttaaaaactggaaacaatgtaaatgtgtaattacacaagtataattgtgaaaaaacattattaattttttcggtaagaaaagataaaaattacctatagtcaatgataacacttttgatggtcattcttttctatgaatctgttttttaatttgatttttgaaaaaatattcacaaaaataacttttagacgaataacatatacataatttgctccatgtacatttatcatcgtaaacagctttattctttttttccttgttcaaattcacacatccaggaaggggtagaaccagatcacatatttagagcaatcttaatctaaagctaggttctttctattgactcggggaccctggggctgcgtgactctcataagtcagatcaggtacagaaccagctctacataccacaacgccctcagagagttttcagcaagtccctcctgcaagcagctttattttaaacaaataaataaatagctcgctgaaaggcaaaactgaataaagaagaaacttggaatggttaggatttgtattctcttttactcttcaagaatatatatatatgttctttacatttactgtcttttaactttctcccttcaggcactgaatttaccaggcagccaggattaccaacttagtatgattcactacagctttctccattccagtacagctatatacaaaatagagacacccatacacatttcctgttgccgtttgccttttagaagggttcatacattttatgctgacctttcattagaagggatcatacgttttatgctgactcctcggcttttgctcttctcacttgccagtgcatcagggaggcttctttgtcagcgagtgaaattctaacattcttttttagtgactgtgtatataatatttcatgatgtgtatacatctcaactatttccccactaaagggggtttccattgtttctgattgttttaacactataaataatgctgcattaaacactattgtataaaaatctttaaaacataagacttaatttctatgtcattcatcccaagaagtgaagatgttaagtcaatgatgtatgtcctggccaggcgcggtggctcacacctgcaaccccaggactttcggaggctgaggctagtggatcacctgaggtcaggagttcgagaccagcctaacacggtgaaatcccgtctctattaaaaatacaaaaattagccgggcatagtgatgggcgcctgtaatcccagctactcaggaggctgaggcaggagaagtgcttgaacctgggaggcggaggttgcagtgagccaagatcgaacgattgtactccagctgggcaacagagctagactccatcaaaaagatgtatgttctgtaaactataatagacattgcctaattacattgcaaaatagctggtacaatgtacacgcctcagaaaaaacaatgccttttcagtaaaagtagatgatatatttctatttaatgttggctaatcaaacaagtgaggataataataatgactacatttgagtatcctttctaactttacgacaattggaattttctattttgtcaattcttattgtcatttacttatagaattctggctttgagttacattttgtaagattgccctccattttaatatgaaatattttgagaaaaatattttactcctgtatattctatatttcagaatgtaaaattgatacattcaatgaaagcattcgctaggatttaaaaattgtcatttttaaatctgaaaatcctgcattgttcttggaaactgaatttcatcagtgagcaattggaaaaccttatgaatggcaagttattagtaatgtgaatgaccttatggaaaccacaattcaagacattgtggaaatgaatttggattgtccaaaaatgagacctagaactggaataggagtacaagtttctgaatggtttgtcctcctatattcataactacaacaaggattaaatatttttttcccaaattgcaagtctggaaacatttttcatgattttttaaaaaagaaaacctaacttttttttttttcttctcccaacaagctgaagcttgttgcttgactgaattcttggagataaagaatgtgccctggtacactgaaggggaaaatcagatcacttgcagctgacattactgccaaacgtcagtgaggaggccacagtcagctgggagaattttaccctttaaacatcgtccatgtcgtacttgtggagccactggcttgtataaagatagttattgagaacatttcatagcagggatgtggggaaaccatgcatgtcagaaatcgtttttattccaagatgtgcttcagctctccttctccttctcaaagctcgattctttaaagagattaaagttcagtggtacgaggccgtataaagacatctgaataattccacgatatctagacatttctgaagaaatacactcttttttaaaaagtagcagttatttatcacaattttctaatttatgatcccggattcacgactggttagggtagtaaatatttatgggaagagatgcccctggaatccacttggggaaaagagaaagaaagtcacttcccctttgaaggcagctttactcttccagcatctcgccactgtttcagcgttcctacagctgtttctgctttggacaaatattatgtttttctgaagaaacaccttatttaatgatttaatgttgtaacagtatttagagcctagtaggttctcaataaatatttattgaacgaataaacagactgtcacatcattttattaaatgagttaaaaagggccaaccaaattcatttcttaggtattagacattaaacaccaaattgtgtatagaacaggatgctgggagatgaaagctgtgccaggccttgtagcctcaccgaaaccatttgaaaaatgactaccacttttcagcccagcattttttgctattttggattttcttagttcatagcacctgtcttcatgtcacacaactggaaatgcgtgatcctttagtctctggatttttttcttaactaatacattttagatattacatcagctatatttagcatatccttttcatttatttgtattttcctcatattataggccagtttttacagtcgaatatcccagatttcacattcttataaagttgcataattcccctaattttaaaatatttattcaattggctgggtgcggtggctcacgcctataatcccagcactttgggaggccgaggagggcggatcacgaggtcaggagattgagaccatcctggctaacacggtggaacctcgtctctactaaaaatacaaaaaaattagccgggcgtggtggtgggcgcctgtagtcccagctactcgggaggctgaggcaggagaatggtgtgaacccgggaggtggagcttgcagtcagccaagatcacgcctctgcactccagcctgggtgacagaacgagactccatctcaaaaaaaaaaaaaaaaaaaaagaaatatatatatatatatatgtattcaattaatatttttggttgcatggtatgtcttagatactgaggacgtagaaatattttcttatatgtaaagagtatttacatgattaatctcttcttaaactgccactttgtatattgtgtatttttaattttcatattgaaacacttataaaaatttttcataggatttcttattaaaagtatcatagacctcagcatatcttagtaagacccttgtaaaaacaatgagacaatttgttatcttttaaaagtaaatcagcagcagaataatactaaattaataaaataagtgttataaattttgtgatgctaatattttcaaaatcaatcatatttaagaatgcaatattcaaaacctgccatggagtgcaatttcagggatgcagcttggttattttaggtttagtttttgtatcttagccatttttggaaagctacagaagtcgttgtaaaaaaccacatctattggttgttatttctacatcttcaatttcccataggaatcttataatctagttataaaccgtaatctttcctattcatctagtccttgaagactcaaaggcagtcaatttcaagcaatttatagctaggttttattgcacgactggcagctcaggatgcctcccagaggcacgtgaaactgaccaaagaaagtctccatgagccaaggtggaaggtggtttgaattcatctacttaacttcccatttcgtaagtaagatttccgtagagcccagttcataaagagagctttgtgactgaaacaaccaaaattacatcaaatcagttatgcttggaaccctgctcacttgcagaaaggcaacacaagagctctgtgcagaaattgccatattacatgatacagtttgcactttattcattcacactaacttatagtctatgaagatttaaaatatgagggtttaaagtgatttctaagatgatataaaaacgaagtatttatgtttaataaatttcctctctaggacttttgaaaaacacatatcatgaactaatttccgaccaaacactttataataaaaaaatgaaattgccttggcaaagaagaaaaattgttttcttatgaaatgacacgtttgcttttatacggcacttcagttagatgtaatgattttaatctgagagctgcaggtacatatttttctgtctttctatctacctatctacctgattttgtttacacattttagaattatttgctcaagaaaatgttaaagagaagtgacaaactctaatttaaaatataaacacctcaagagatttgctaaaatagactcaaaatgcattatgttaggaaatatttccacagagaactaatgataagtggacaagtaaaggtaaacagcttaaacatttttgttggttttactttttggcatgatggtgttaaataaaagtctcagtatttttagaaaatgctttaagcagtacattctatttttaaactatatgtctctattttaagtcatagtacgtgatatggagagatcaggttttatgttgcaagtgtattttaaacaacacattcttagtcacacatacattttaatacacattaaatttaagctgtcttactgaattttgaaataatttagtgcggctaaggatgcgttttgttttaagcatattcacaacataaaatatgatttctgaaactcgaataagagaatatttcctacctaggcactaaaaatgtcttaaaaataactcaaaaacaattctaggttcaaatccaagaatgatattaaagacaaaatatccacataggtaataggagtagtgtttattgccatttaatgggcagcagttatgatttctaagaaacttggaaggtccttttatgggaagaggacttgacctgggtcttccatcactcttgaccttttggaaagtgagcgaaagttagccaaaatacactaagaaaagtaattcagccttgtgctgactctttccacaccaaatagcacctatgtaggaagtaaatcattaagctttgaccacgtctacaaggccaaaatgactgcagcatccgcagacaagccaggctgctcatcctcattgggacatgccacacttcaaaggtgaccgagccggtatagtggcacacacctgtattcccagcaccgaagggggaggattgcttgaggctgagagtttgacccgtctggacaatgcaagcgagatccccgttttcaaccaaaacatttaaaacttagccaggcgcggtgttgtgcacctgttgtcccatcttcttggaaggctgaggtgggaggatcccttagatggccaataatctattcagactttgccttgttcatttcttcacttccttctttcattttatttaaatagattgtatgttcacatgataaaaacaattcaagggttttacaagagaaaatgaggttttatccctaaccctccattcttcaatttttttcctccagggacaaaaagtctttccagttcttttttatcctcccatggctatcttacacctggatggagagctacatttagacatcctaatttctttacacctgaattgcagcttattttgcattagtgttctgtacttttttccccactgacaatgtatcttgggaaaaaatgccatgtttctaatgttacacaagtattgcatcacatgtattcggcaagactgattgaactactttaattctgattggtctgtaagttgctattaatctacaacaaataaaggtacattatgaggagtggtgacacaggcatagtcattttcatgtagatatattaacacaggagaaaatacatttcaagctgtggaattactgagccaaattcatgtacattccaacttttatagatattgccagattgccctctttagaggttgtactaacttatatacctatcaataaggtaacaaagtgctgttctccatttgcttgaaggcaaagtactaacaaacttttctgtatttgttaatctgacaggtgaataattgtctctcatatttttactttggttttatgctataattaatgaggttgtatagcttcttcttattccatttgcactttccaatattttatccaacatcctggaacacacctgtttctcctcaatcccccaaaaatagctgctcaacagtccaactgcatatatcttttctcctcttacctttcgttctctaaataaaataaatgcattccccattagggtttggtgcaatcgacgatctttccactttacatcactttattaatttggtttcttactcaccattttcttgtcgaggccacagatcaacccatttattaacaagtctagtaataattgtaagaagtgtagccatctctgtgaagacatcaagaacaactggaacgcggagctccagcttcattcttgtcagtttcttttgagaactttctgtatacagcagaaatatcagtacccatagttcatgaatattattagactttatggattttttttttgagacagagttttgccctgatgcccaggctggagtgcagtggctcgatctcggctcactgcaacctctgcctcccgggttcaagcaattctgtgccttagcctcctgagtagctgggattacaggtacgtgccaccatgcccagctaatttttgtacttttagtagagacagggtttcaccatgttggccagactgttattgaactcctgacctcatgatccacctgccttggccttccaaagtgctgggattacagatgtaagccactgcacctagctaggttttatggttttaaaatacactagagactgctacaaaacactggacactcttcatatactttgttatttctgaaagttattattttaccagtaaatccccatttcctataagctaattagatttatttattgtcacattcaaataattctattatagaatcagtagatactgagtttataggttaaaattgttacaatttcatgtttttaaaaactttgggaaattattattatccctttaaaaataagtatgaaagtattgaattgtttcccctttaacttttaacacaaggaactataagaattggaggctatagagtgtgtttacagttgcagctataagaaattcaggtttatcagtagttactcattagaataatcactgtatttaatctaactacagataaaatataaccttagctatatacttttgtgaggtatataattaacagcatgaaggaatgaagtataaaaataatctttctagaatctacttttaatccaagtcatgtatttggcatcacacagggtgtattgtttaaattttctaaccttggttgtaagtcaacataatttcagaggtactcggtgagggtacatttgaataaggtgagccctctcagaacaaatcatcatgttcaggtacctgaatctgggaagggcttgtgatttagaaatgtatcttttatctatagcatttcagaaaggtgaaagaattttgtactagtatgagtcatactagtagaatgaccttaaaaaattatatgtcctactcatttttttaaaaaaatgctttgttcctacaaattcccaaaaaccaacctatcagttaatgtaaatataatacataatgtatcaataataataatcaagcttcagaattggtggtttgccttgaaaaaacatatatgcacttgagaaaactggaatttttttggacaaaacattaaccttcaaacttcttttgttattgtgggggccaagggaaaacttctcttttgccttctgaagatttaatgaaaatcaattgacaaaagacaatgtaataggagaaaaggcatacaaatttattaacacacgcaggaggcatacaaaatacaagagcaccaaaaaatgtccagatagttgatgcttttataccatctggaggttacagaaagtatataagcttggatcttgggaaaacaggttatggtagtaaatcagctttagacaggacagggtatgggaggcagagaagaggaggcctggcctggcctgcaaaggtggtctcattacgtagatgaaacctcccaggcagcaggactcagggggaatagatgggaaatgtctcttttggacctttaaaggcgtcactctctgccaatcttttctagatctggagaagggagggtctcagagaaagccaggctgcgtggatgtggattttccctgcaggtgcaagtcttcccaacagaagacctttgcagggctgcccatggtcacaggccctctgaacatccatcttaaaatatatcaaagaagggtattttggggtaaaatattttggtttccattatttcagtcatcttatattctttttatcttgtatatttgaagttcctactttcttcgttctacttgtttctttcagtaaaaatagaactctagtgcttggccttgaaaactgctgctagtgaaaagaatctcacagagataaggagggaaaattttgcttgctcttgacaaccgccaataaagcgtttcttacatactagcaatttctttgagttgccctaattcttccttgataagtgctcaagcctgtggtcatccaaaacctgttattttcttttatcttttctatagctgatcctacggaataaagcattgttttggtattaagaatatgtaggtgtcagattttattgaaatacatataaacttgcaaaagtttatctccgtcttatgtgttaaataaaaacataaagattaatttaggaaaacagaaaaatattaaagttcatatgcagttttgaaaactatttctttaccattcaaattaccaatatggcattatttatgattacgagagtattctatgttaaaatgtcagttaagtaaataattttattggttttctttataaagaagtactttttgtgataaaaatttctttaggtttaaacaggagaatctatttgtgtgagactattctcgcattggtatgaagaagtacccgagactggataatttataaagaaaagaggttacattggcccatggtcctgcaggctgtgtgggaagcatagcagcttctgcttttggggaggcttcaggaagcttccaatcctggcagaaggcaaaggggaagtaagcatcttacatggtaggaacaggaacacgagagatgggggggaaggtgccacctacttttaaataaccagatcttgtgagaactcactatcactatcacgggatggtactaaaccattttttgagaaattcactccatgatccaatcacctcccactgggccccacttccaacactgggaattacaattcaatgtgcgatctgggtggggacacacatccaaaccacatcactattgttatctgtaaaaatactacattacaaatcttgtaaatataacaaagggcaaattaaagtttgatgtgctatttgaagttgtttcctattacttctgagggacgatggtgttacaaattggcccctcttaatgttaacataaataaatactagctttcaaaactaattatttgttcacagtttcaactcagatgcagcctgattttcaattttaaatagtactttagtttatagtaccgtaatagaaattagcccaaataacggagtagcttgcaagaccccaaagacacatttacattctgacagaaatgtaagtattggtttaaaatgaatctttacatttgaaaaatctaagtttatttacctaaagctattaatttgaacatacgtagaggttcagtagaagaatatgtatggggaagggtttccttcaccctctgaaagttcactaaaaatcaacaaggcagattaattggagaaacacatacaaattcatttaatgtgtctacacaggagccttcagaatgaagactcgcacaggggaaactgtcattttatgcttagatttaacagtgtatggacagccaggtagaaatatggagggacacaaagggtgtgatctactgttaatagacggagcggggtcacccagcaaggcctgtctctctagactctttctggcctctctgagcagcgtccttccttctggggtgggacaagacctccctggaatggggattttatgtgctacggtcaaaaaatttctcaattttctggccagcttttacacaaaaaggcaaagggaaagttcgagtaatacttgtaggttttatggctggatttggggaaaggggatctggttggttaaaagaaaagcctttgccaaattaaattgaacagagtttaactaagcaaagaataattctcaaattgggcagcctcacaacccagagtagcttcagaggctccggcacaaccatgtggtggaagagggcttatgggcagaagacagaaagaggaagtgcaggaacagaaatattggagacagctccatgtttgctttatgtgaacacagtttgaacagttgtgcttcttggattggccaaaactcggcgattggcacaagagtagattacagtctgattacagtctgtttatacctcctttaggttatagttcactatgtgctacaaaacctttaggccgaacttaaaatatgtaaggaggcagctttaggctgaatttcattcaacaggtttgtaaaccaaaagtatctgagacatgtctcaatcaagttagaagtttattttgttaagtttaaggacaagggcccatgacacagcctcaggaggtcctgagaacatgtgccaaggtggttgggtgacagcttggctttatatgttttagagagacataagacatcaatgagtatatgtcaggtttacattcgtttggtcctgaatggcagaacaatgcaaagctgggggtggggcttataggtctaggtggactcacggatttcctgattggcaattggttgaaagggataagctctgcctgcaaagttggagtcagcttgagttaaggtaaagggggttatgaagccaaggctcttgtcatagagaggcagcctccaggtcgcaggcttcagagagaatagatgtgaggccgggtgcggtggctcacacctgtaatcccagcactttggtaggccaaggtgggtggaggtcaggagttggagagcagcctggccaacatggtgaaaccccatctctactaaaaatacaaaaattagccgggtgtggtggcaggcacctgtagtcccagctgctcaggtggttgagacaggagaatcacttgagcctgggaggcagaggttgcagtgagccaatatcatgccactgcactccagcctgggcaacagagcaagactacgtcttaaaaaaaaagaaaagaaagaaaatagatgtgaatgtctcttactcaaggtgtcagactctctgaagagacctactaaaggaaggaatagtgtctggcatattataagcactcaataaagatgtgctgtgaatatttatgagatcgtcaaagagttctcaaatcaatagtgagaatacagcttttcaaatcagcattatgatgtattatacatcaacattttacccttcctcaaacggtgctttacgtgtgggaaagaaatagctgtatttattcaatggtggattttcttcattgcattccattcagtgtctttcaatcgccagggaaacagcaggaattctcgcacaggacaatgcgtcacgacctgtggatccagcatgcattgttgcattttcccaaatgcacccagtgaaggagaatatgataatgtgaaaaacatttcacaccttgtaaacatctgaaagtggatttgacaggaaagcctgcatgttaaatcgaagatagtcttttgattccgtaaccattccgtgaaccattcgatgcagaaaaatccatgctggagaaggctccactatgcctaatgcaggatactgatggaagaatgaattattctaccgtatgttgtttaaaaggtattaaaattgtattaggaggagtggctctgtctatagccgtgggtcagtgctgacagaacttggtggccacagccagctaagacatgccaccatggggaagtaatttacgagctatggaacaagagctgaatttatttgttttctgaacctctttaaaaaatacatacagctttattgagatacaatttacttaccataaatctacttgtgggtgcaactcaatggatttttagcatacagagtgtgcaattaccaccatgatatgatatccgaacagtttcctcaccccggaaagaaatctcatgcccatcagcagttgctctgcaaacccagctcctcccatgttcttctccttcagctcccaaattagacaatcctgaatctgctttgtgtctctatggatgtgagtaatctgggcatttcaaatagagtcacatcatatgtggcctgtggtgactggcttcttttgcccggcataacattttcaaggtctatctatgttgtagcatgtaccggtagttcctcatttttatggcaaaatattccacatttagtgtgtctgtttcttagttgacagactttgggttgttttcactgtttattataaataattttgctacaaacacccatgtatgagtttctgtgtggacacgttttcatttctgttgggtatatatccaggagcaaaatacttggatcatatgggaactttatgtttaatcattaaagaaacctctagactatattccaatgtgactgtactgttttattaggttggtgcaaaagtagttgcggtttttgccatttagaagtactgacaaaaccgcaattacctttgcaccaacctaaaacatttgcaccagcagtgaacgagggtttcaatttctcctcattctctccagcacttgtgtttgttatctttttggtgacaccattctcgtggatgtgaagtggtatctttttgttagtttggtttgtagcacatgttgaaaaaacaattattttctcattgatgtgtctttgcctctttgtcaaagatcaattaaccataaatgttaggatatacttctagagtttccattctactctgctggtttgtccatccttatgccagaatcactctgcctggattaccatagcttgtagtgacttttgaaatgggtatgtgtgagttttccaatttcttccttgtttctcaggattgtttagctattctttcatttaatttatgtaactttagttttatttctagcaaagcaatacatagccatagtttaagaaattgaatacaaataattaaatgtgttttcatatttgtgacttttagatattatctattgccatccttctaaagaaacagcatttaaatttattatccatctaatcatacacacaaatacatcattttgctttttctcatgaaatatatattatatatacacaaacatacatagacatacatacacatatagtgtgtgtatataaatgtggatatatatatttagatatacatacacatcccagttatatatgcgatacacacacacacacacacacacacatacacgcataccagctatgtatagggagtatatatatcccaatgatttcttgtctaatcagtattgaaatatttacattctttgggctatttaaaaattacttgttactgaatcattttttgtacaatgtacataattttgttcttgtgtaacattttgtacttataggtgaatattgcatttttattcttaaatttcatatgcacatatcagaaatttttcctctgatatattactctaaaatatgtataatattttaaatatggcagaatatctaattatttataagattatttacttgttctttttaaattttctttgttatagagacctaatttccgagtcctccatctgtcacttgtaacttgaacagtgtctcactaatctttctctgtcaatcttgtcacatgatttaattctttttctcctaggctgtctcccctctttcgcaggccacaaaagattttctttatattttactttttatattttgggacacagtctctctgtgtcacccaggcaacttcaacctcctgcactcaagggatcctcctgcctcagtgtacaggcatgcaccaccacactcagctaatttttacctttgtgtgtgtgtgtgtggagacaggtctcactttgttgcccagggtgatctcaaactcctaggctcaagtcatactcccaccttggcctcccaaagtgctgggattacaggtgtaagtcacctctccagccttccaaaagacatttcttaattttacctctcatgttcgtaaggtgcactctttagtagctccctgagtaagagtgcactgaaggctaatacatatagcccttgtgttctgaaaaatgtcttcattcaactcccacatttgattggcagttgattgtgtataggatgatgaatcaaaaattattttgtcagaaatatgaaggcttcacatcatgttctagcttcttttttttttttgagacggagtctcgctctgtcgcccaggctggactgcaggggcgcgatctcggctcactgcaagctccgcctcccgggttcccgccattctcccgcctcagcctcccgagtagctgggactacaggcgcccgccactacgcccggctaattttttgtatttttagtagagatgaggtttcaccgtgttagccaggatggtctcgatctcctgaccttgtgatccgcccacctcggcctcccaaagtgctgggattacaggcgtgagccaccgcgcccggccatgttctagcttcttgatatcagcttctccgcatgtggtattaggttccattctgtcattctcactcctgatttgctatgtgtaactttttttcttcctgaagatttttcccagtcttagtgattccatgctttggcgttgccattttttaatttactatgacaggccctcagtggagtttccacttggaaagtcatgtctgagtatgttctgaaattttttctttgtttcttgaatatttttgccttttcctcctcttttttgagaaaatttgttttaggaatattgatgctttagatggatcttcccatttacttacttcttcatccacttttacagtttgttttctttctcttccactccactgagattttctcaatttaaacatctaaatctcctactgatttttctgctaccattgtgtgtgtgtgcataactaattatatgatcttttgaatttttaaaaaatataacatcttgttttaatgtcatggtacaatattttctttcttccaatatttccgagtgcatcagttacttatttctaggctactttcttttctggaaatatcacagtttccactaagtactttttgtttgttaatttattggggtttggcctctgtttttcttatttgaaactctcctcaaaatccggtacgtcttgtccctcagtttatatttcagaatgagatagtgacatggagaggtggaggcagtgagccaagattgcatcactgcattccagcttggaagacagagtgagaccttgtctcaaaataaaataaaataaaatttttaaacttccgggcctaaggaagaatgatgggcttatgaataatgggcttctctatagatagcgtgggtaaaatttagactttttcttttggataatcacatctagcagcatctctctggactgtcttttatcctagttaacttaccagagaaatcctttaccttcaggatgggcctatcagtctggcttctgatactcactgaccacaggaataatttaactaaatcttccagaaatcaaaattttatctgatgtaaactgttcagaaaaatcttcaacctttggagccagtgattaactgctagttttctgggttggagggtagagatcaagaggtctgacttctttcaaaatctttggatgtgttcaacttttcccactcccaagcactctgtgtctaacgcaggcttcctccgttttctgagacctgcttggaatctgccatggacattgaccagtgtcctggtttccgtctccccttacccttctcccactggtaggatgttagcctttaactttttcccacctgcaggttgcttgctatttctaaccactgtccttttcatttttgcatcctctcttttcattttttctgtctttgtaaggctgttttttcacatctttgctataatttcagtgaggtttctttggtggctccaaagtgatatgtgagaccaatctagtacatttaccacaaattcctcattttagtaatttttgtatttttagtagagaaggggtttcaccatgttggccaggctggttgcaaacttctgacctcgtgatctgcccacctctgtctcccaaagtgctgagattacagcgtgagccaccgcacccggccaagaaccaataatttttaatgtagttcagtgaatgataagcctaaagtttattagatcatacttcaataattgaagcagttggtaggtgcaggaacacgcagacctatcaaaacaatagaatttaaa
